United States Patent 6,812,339 (POLYMORPHISMS IN KNOWN GENES ASSOCIATED WITH HUMAN DISEASE, METHODS OF DETECTION AND USES THEREOF) - sequence listing, part 82

SEQ ID NO: 17554 - DNA, 62908 bp, Human
  misc_feature (1)...(62908): n = A,T,C or G
attcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaattccttgtcattcttccctttgtatgctcttgctttctttgtattggggctggaagtctggataaatatatgaagtggcttttgactgagtggaagtgaggagccagagacgagttgaaggatatacaatcaaggtgggaatcaatgggtcctaaaatagggtgcctttcctttctagtattgctgctaggatgtttcccatccctttcctgacagagcattcagtactcagtacattatacacttccttcctcccctccttaggaagattttctggggattcaagctcttcttacagactcactcctgatcaatgtactccaggtgccttccctctatcttataagtttgtgacgtgcctcctgtcccttccttcctctccttccgtgggggcctctccctttcccttcccctgtggtgttatggcccttccatgccagaaagatccattttcacctgtgcctcactcccgagactcttccctctaaaaaatagcttgtgggttccctttttggaaaaaatccattgttgggtctttcccttcctcttttcctggggtctcaggatagaaattgacacaaagaagaggtagaaaggtactccttggaccttcggactactacttacttaccaccatgcattatgaacagattctgagcacatgtattattgagcaggaggatgggcaggaattggttgttccatcccacttggatcctgcaccatcaagatatatagagcttagtggatatgctggtccctgtccatgattcaacatatctcctggtgtcgtggacacactcatctaataatttttgatgaacagtcagttcttgcccctctaccccctttcccatgagtgtcagtcaccgtggtctctataaaggttccataagtcacctgggcccagattctgtgcatgtgcagaaataaggaattaatttccaattccctatttactcctctgccttccaggaggaggttgtatccttttcaggtgaattcttcagattctttgcacatctcttggtgtcatcccctttattccccttacctgttttgacaaactatggcgcctaaattgctctagctgcagtcttattctgtgctttcagactcttgacaattccagactctaaacacaaaggccagaattctctttcaaactccattttggatggtcccttctccactctagaacctacaatgcttcctctattctctggtcccctaccaacccttcagtattcagatctggtagctaaatcgttatacatttctctattagtaggagatcctgaggtttaatcacgtcttctcagtttactgggaatgccatgagagcgggtgtgtttcctcgcagtcgttcgatcgcagcacctcctcattcttcattctgcatgcaaagaattttaacctgatcccttggcctcgtcctgtttctctcctagcttcagtaattttgcccaagtccctagagcctaccccgcccccacccccgcacgcgcagtgcatgccggtcttagcccctctgtagggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaaggtgagaggtggacgaaaccctgggggcctggcctgaagagctagctgtgtgtgagggcgggcgggagaccgtcccctcgggagtgggcccggaagggcgggcgagtgactggctgcctcccttggggagtggcccctgggcgggcccctgctgggcagggctgatttgtgttttcggctccgcggttttttttggggggtcaggccttttcggaggttttgcttccgtggcttcctatcccaaagggtgaggctcttcgctgcagtgagcccgttttctcttcactcggcctgtcaaagcggcgcaggggccgcgattagcttcctgccccgcgacagctgcacttctggcttgccggggcgaaccgaggggctcggagaccttcagccacgcgaggcccgccagtgagcagtcagaaatcacctcggctttggcccacgcctgctccccggtgacagtcgtccgccctatccgcgtctagctggcgacaaccgcaggggttcacttttggccgtcaggtgccacccggagcagaaattaggggaaccttgtgggattggatcacggtgaagggtcggggcaggaattggaaggccagcctttatagtgcagaaagggagaaaaagcagcataaacgaaaaaaaaaattcttgtggatagcaagtatttacttagaaaaccatcaacactttggtcaaaaggagttacccctcccttacaaacacacacccacacattcatcctagacgaaaaagttaaatgtttctcagccagggcagaatttatggatgtttacccacaacaggtcagcagattaatttaaaatagagaaattgagggctaattgagagttgcttaagattccaagcttcctgggagagcctaccaacctcaaacactgctgtggaggtgaaaaacaattgaaatgattctctttaccatgtagcttgattgataaattgaaatcgtagaatgaacttttccttatttgtattgtatttatttttaaaatataggtacttttgttttcattcagcttctcaaatacactggcacagtatttaaacaccgttagcctactttttgaaatctgactcatatgtttccattaaaatatttaaaaacaaggaaaccttttttcttttttttttttaattaaaaattttcaacctgagccttcttcggttcttaaaagaataatactaatttggcctggcgtggtggctcacatctgtaatcccagcactttcggatgctgaggcaggcggatcgcttgaactcaggagttggagaccagcctgggcaacatggcgaaaccttttctctaccaaaaatacaaaaaataaaaattagccgggcatggtggcgcgcccctgtagtcccagcggatcgggaggctgaggcacgagaatcactggagcccgagaggcagaagttgcagtgagccgagatttgcgccagtgtgctccaacctggacgacagagccagaccctgtctccaaaaacaaaaacaaaaacaaaaacaaaacactgatttgcacctaggcttaagttagtagtatatccagttgggccaggcattggaatgagctgaataacgagtttatggaatccttaatacagagaaatcttaaaaaaaaaatagtaatgcagacattcattctatcaagaaatcctggagttttgtgggggtgggaacgggacattggctacctcttcattttctgactgtatttctgtgttgtgtgttcatttccctgggcacttttcaccagactgttagatggggtaaccaatcacattcctgaacaatgagtttatgctatccttacgtttgtgaatcttcttattccttgtcatatatatggtaatgttttttctgtactgctttaatgcagtgaaaataagattccaaacataaggcagattccttaggggtgagttgtgagtccaaggcagtcatatttgcaggttattggtgtggaataaaagccatttgatttagataaataggaaaggagcttgttaatatagaaaattatagttaaataaagcttatggttatcatatttctggtgcttcattgtgccctcttcatagagacaactttcatttctttatggaatttgttaaccagttggaattcctgtatggattatatgttttaaaatggtgtgtaacagactaatttgcactgctcatggagtctcctgcatttactgggaaattcacctttcttacagatccagaaattcacttttaaatttcatcttcaggattcttccttgtcttttattcagtaattatactataatgtgatacctgatattagagaatactggttgcctgatgataaatgatgtgagttcagcttaagtttaacttgttaaaatccaaatttcttttaagtccacaatgtggtggtagttttgtatcgatacattttcatagtagtgatattatggagactgtctgttggcattgaatgcaagtagtctttttctccctggaattttttttttttttttgagacggagtttcactcttgttgcccaagtggagtgcagtggcgcgatctctactcactgcaacctctgcctcctgggttcaagcgattctcctgcctcagcctcccgagtagctgggattataggtgcgcgccaccatgcccggttaattttttgtattttttagcagagacggggtttcaccatgttggccaggctggtctcaaactcctgacctcatgatcctcccaccgtggcctcccaaagtgttgggattacaggcgtgagccaccgcgcccggcctgcctccctggaacttcttagtgtcaaaattttatactccatgcttgtagtcataaggcctacattttatggtcatgtaggtttttaagggtgtataggtctttctgtgtttaagatcagatacctgaaattcactttttgtgaagtttgggagcttggaatactgtaggtgattcatgagtaaatgtgatgagcttgtcactaaaattattagtggtaattccatgtcattgattatgggtcattaggtttttggttgattaaattcagttctgagcctactccagctgctggctcaagtcaaattcttcccctgtttgaaagttgatctaacccacctgattaagcaagatggtatatacccttttaattatattctattaagcattctttagctatgtaggaaataagaaagtggaaaaaaattaggaaaaatatctaaccgtatctgcatgtgtgctttcttaccacatcagcaaagctggtataggtaattgaagcacaaaatcctgaatttatatatattgctttccctcctccccacaaagtttacttgacctgaattgcccagatacctccttttttccccagatacttaaaaaatgtacgttttgctttgtataccaggttctagatttgtaaagctggattgtctcttgagattatcaagactgttagtattaataaaaaattcacctttttacttagagagcattgtcagtattgggcatatgttcattttagcacctacaatgtgagtcattttcttaacattattttatttcatgggttatagtaacctcaaattatcagactttcagattgaaccaaaatgctgaatttatgtgttttaattttttttaagctaaagtatttctgattgacaacgttagaattcatttggattctgttgccagttgccctgcttataaatctgaagtcatttggctaaagtgttttctagtagctttcctttaggaggattactttttgtttatttatttatttatttatttatttatttttgagatggagtttcgctcttcttgcctagactggagtgcaatggcgcaatctcggctcactgcaacctccacctcccgggttcaaacgattctcctgcctcaacctcccaagtagctgggattacaggcatgtgccaccacgcccggctaattttgtatttttagtagagacgacatttctccatgttggtcaggctggtctcgatctcctgacctcaggtgatccacccaccctggcctcccaaaatgctgggattataggcatgagccaccgtgcctagccagattacttattttcagataacccatatagccttggtgtgacatagctacttcagtgtttcttgctagttctatttcattatattttaaagcagcttgaattttaatttttgtttacaaagtctattttgtggacttatctgtgtaaaaagaactagaaattatttttcttttactttccactctcattactgttaaccatactaaaataaatcttcaggccaggcgcagcagtggttcatgcctgtaatcccagcactttgggaggccgaggcggggggatcacttgaggtcaggagtttgagactagcctggccaacatggtgaaaccccatctctactaaaaatacaaaaatttggctgggcacagtggctcacgcctgtaatcccagcactttgggaggctgaggcaggtggatcacgagatcaggagttcgagaccagcctgaccaacatggtgaaaccccgtctctactaaaaatacaaaaattagcctggtgtggtggtacacgcctgtaatcccagctactcgggaggctgaggcaggagaatcgcttgaacctgcgaggcggagattgcagtgagccgagttcatgccactgcactccagcctgggcgacagagcaagactgtcaaaaaaaaaaaaaaaaaaaaaaaaaaaaaccaataaaaacaaacaaacaaaaattagcagggtgtggtggcacgcacctgtaatcctaactacttgggaggctgaggcaggagaatcacttgaacctgagaagtggaggctgcagtgagccgagattgtgccactgcaccctgcctgggtgacagagcgatattccgtctcaaataaataaaaataaataaataaaataaatcttcagtaccatgtgtcctagtgaaagcaaaggaacagaaagagagagagaaaaagagtgtgaggggatggggtgagagggagagggagagggaacactatggtaacaagttaccttaaaaggaaaatgccaagttggaaatacagcttagtagtgaggcaaaagcttcaggttccagagctattgaatgaattggcaagagttgtaaggaaaagtttggtaaaaggaccttgatttattaaacaaagcgtgccaatcatatgacctcatttcaccataaaaaatgttttttatacacagagatgaaataagctgaagctaattgggcatcgtctgtgtatggtatgtaaaatttattttggaacatcacagtcgtgaaatagcaaatatttattaaatgtctgctgtatcacaaaactgtaggagaacaacaaaagtacaaaatataaaatacagacttggttcatgaataaatattcatgaaaaattaacaatatatgacataaggacaggtatagttaataattgccaggtaagttgctgagcccgcaagttgtcagttcaaaggaggtagtgatgactctggactggaatggtctaggaagggcttgtgtagaagcaaaggggccttgaaggatggttaggattaaaatagaggattgggaccatttatttgtgcagtgtttattgagtaccagctttgtaccaggcattgtgctaggcattgatgatacagaagtgaataggatattaagtaagatagattctcttgtagtgccggcattctagtgggggagacactattataaataaataatgtaatgaatttggtacaaagcgctactggagctgtaaagaagggattggctatcttactttgagggaaagcgtcactgagaggataatgtttcgaggtagtccttgaaggatgagtagaatttcaccagaaagtggggctagagtaggtgtaacagaagcagaaaggcatggagtttgaaaaaagcatgaaatgtatggcaaaagtatgtgaagtgcttggcaaggagtgacaggaatgaagttagaaaagatcttttgtattacaagttgaggagctaaaacttaagctgttaagcagtatagcagtatatagtacctggatgattaaaagcacaagctctggagtcagactgcctgggtttgaatcctagctctactacttaataaccttcttgccatggacaagatacttaacatctccaagccttaattttcttatctgtaaagtagagctaataaaatcttattatagggtttttggagaattaatagagaccgtgcatataaagtaggtaccacagttcctggcctggcacatggtaagtactcaaccaatggtaaccatcaccattattattattattattattattgaaggttttaaagtagaatagtgacccagtatcttgttttttgatggctaattctggccatattgtgtgcaacaaattattggagggcaagaagcttaaagcaggttgtctaattagaagattaatggagtagtccaagtgagggatgaccaaggcatgaaaaactagatacgacacaaattcctactaatattagaaggtaagtatattggatgagtgattgagtatggaagtgaaataggtgagcaacagttttttaggaaacaataatcagaataattttgctttagggctagattaaattgggcaattgtagttagatgcaaagattggaatgatatgtaaaagactgagaatggttaaattgagaagaaccttgaaaataagatccaaagttttctttttctttattctttagtcattaagaaactaccccaagtttttgagtaggttaatttactactttgttcagtcaaagaggaagaagagatttttctagtaaatgataagaacttgaactagtattgcaacagtggagatttaagaaaattgaatttgaagaatcaataggacttagagttcagaaagagaacaatgacattaagtgtgagtgatagagaatggtgataccttaacaggtgtaagccaggaaggggagccaattttgagggaaaggtatatttaaaaaccaccacaaattaaaagagacccaatggataccttgaaattttgaagacaatgctgttggatttattgaatctttccttaaagcatgtggccaatccatacttctactcctggcaagcaaatggttatatcattcttcatgatgaggcttttttttttttttttttttaaccctcaagacaggatcttgctctgtcacccaggctgtagtgcagcgccatgatcatagctcactgcaggttcaaacttctgggctcaagcgatcccccaactcagcctcccaagtagctgggactacaggcacacaccaccatgcctggctaattttgtttattttttatggagacagaggtctcactatgttgcccagattggtctcaaattcctgggctccagtgactgtcctgccttggcctcccaaagtgctgcagttacaggtgtgagccaccacgcccagccatgatcagccttttgatgtctccttttgtcaaaagaaaattgtccttgtgttggtataaagacatatgctacaggagcagcattctgaagacttcaatttcaactatggctctacttcttactagtgaaacccctggagaagcaacttaatgtctctgaacctgttatctatcatttgtgaaatgggagataaaacttgcctgaccctaaccccagcactttgggaggtggaggcgggcggatcacttgaggtcatatgttcgagaccagcctggccaacatggtgaaaccccgtctctattaaaaatatactaattagccgggtgtgatggtgggcgcctgtaatcccagctactcgagaggctgaggtagggagaatcgcttgaacctgggaggcaggggttgccatgagctgagatctcaccattgcactccaactggggcaacagagcgaggactctgtggaaaaaaaaaaaacaaaaacttgcctgaccaaactcaaaggatgtccctgggaatcatgtaggattatgtatgtgaaagtacttggtcaactatgaataaaacactataaatatattgtcattgctacataaattagtgtcgttaaacaagtattttggaaactataatcattaattctgtaaacatttcttaatacctatgtttttcctgtttgttttttttttttttttttttggttttggtttttttttgagatggagtctcactctgttgccctggctggagtacagtggcatgatctcggctcactgcaacctctgcctcccaggttcaagcaactctcctgcctcagcctcccaagtagctgggattataggcatctgccaccacgccccgctaatttttgtatttttagtagagacgggatttcgccatgttggccaggctgttctcaaactcctgacctcaagcgatatacccaccttgacctcccaaagtactgggattacaggcatgagccactgcacctggccagttcttaagttttagataggttttgataatggtggaacttagaatggataagacttgtgggccagaaacttgagcctatgatgactagttttcttttgagagaaagtctcactctcgcccaggcgggagtacagtggcccaatcccggcttactacaacctctgcttccaaggttcaagcaattctcgtgcctcagcctccccagtagttaggattataggagcccgacaccatgcccagctaatttttgtatttttagtacagatgggtttcaccatgttggccaggctggtctgaaactcctgacctcaggtaatccacccgccttggcctcccaaaatgctaggattacagatttaagccacggcacccagcctatgattagtttaatagatagcagggacaagggtaaactagccagaaggcatgaatctcaaaggaggaggcattttttttcccttagtggagagatgatgttggaagtgctaatgcggagctaagagaatgctgaagcctccactgagattagtggaatgcggaaaaatgagcaccatccactttgaaaaaagaatttgataagtgttgtccttcaggagacccaagatgtaattaaactagagagatgaagacagtattctgtgtagagctaaagaagagagaggccaagcgcggtggctcacgcctgtaatcccagcactttgggaggctgaggtgggtggatcacctgaggtcaggagttcaagaccagcctgaccaacatggagaaacccagtctctactaaaaatacaaaattagccaggcgtggtggtgcatgcctgtaatcccagctacttgggaggctgaggcaggagaatcacttgaacctgggaggcagacgttgcggtgagctgagattgcaccatcgcacgccagcctgggcaacaagagcaaaactccgtctcagaagaaaaaaaaaaaaaaaaaaaaaaccagtctggccaacatagtgaaaccccatctctactaaaactacaaaaaattggctgggcgtggtggctcacgcctgtaatcccagcactttggaaggccgaggcaggcggatcacgaggttaagggttcgagtccagcctggccaacatggtgaaaccccgtctctactaaaaatacaaagattagccgggcatggtggtgcacgcctgtaatcccagctgctcaggaggctgaggcaggagaatcgcttgaacctgggaggcagaggttgcagtgagctcatgttgcgccactgcattctagcctgggcaacagagcaagactgcatttgaaaaaaaaaaatatacacacacacacacacacacacacacacacacacacacacacacacacacaattagccaggtgtggtggtgtgtgcctgtagtctcagctacttgggaggctgaggcaggagaattgcttgaacctgggaggtgggggtttcagtgagctgagatcctgccactgcattccagccccggcgacgatgcgagactctgccaagaaaacaacaaaaaaagagattgtgtgtagggtttgtgggatagattaaaacaaaatcttataataggaattctgaaggcctcaatgaaaaggatggagggagaacagcaagaaggaaattgtatgagggaaagaaatacagagaaaaatttagaagtatagatgtagagactgtattttggatagttgccaaggatggcaatgatgggaagcatgatgagattaactgaccttaggcatctgaatgatactttggagtcaagttattcacttggcacagactgtacccccgttgaagtcagaggcctcatagggctaagagggcagtccttgcttagaattggggaacaggatcagttaattctcaggtttccttgcccagtggtagaaacagtaagaagatctctgtaccaccaccccctttttcccaattcctgatcagtctgtgttcttggtttctttttccaacttcctaaattaaaatgtttttcagtccttgtttttttagccaccatacattaaatgtgagtgaaaataccttgcgaatattattggttactatatagagatgcccttcatgtcaaaatttggataaaaggaagattttcaacagaacagtttggtcaaaatgaatgttaccaaatcaagatttttaggttttgaggagattttgtagctctcttttttgtttgattggtttatttttttgagatggagttttgttgtcacccaggctggagtgcagtggtgtgatctcggctcactgcaacctctgccccccaggttcaagcaattctcctgcctcagcctcctgagtagctgggattacaggtgtgcaccaccatgcccgggctaattttggggtttttagtagagacaaggtttcaccatgttggccaggctggtcttgacctcctgacctcaggtgatccacctgcctcgacctcccaaagtgttgggattacaggcgtgagccaccacgcccagccgattttgtagctctttaggttgttccaacaaatattattagccatttcagttgttgactatttatattgcatttatatacatttgttttctggtttttccctgtcgcaaatatagaaaagtaaggaaacatagtctgaaaattaggagaaaaaagtatatatggaggcaaaaaaaaaaactctggaaaagtagaaataggccttgcgcagtggctccacgcctgtaatcccagcactttgggaggtcgaggcgggtggaacacgaggtcaggagatcgagaccatcctggcgaacactgtgaaatccttgtctctactaaaaaaccaatatttggggggggcgtggtggtgggtgcctgtagtcccagctactcgggaggctgaggcaggagaatcccttgaacctgggaggtggaggttgtggtgagctgagatcacaccactacactccagcctgggcaacagagggagactctgtctcaaaaaaaaaaaaaaacatgttcttctagcccacatttttcctgtaacttagtacttagagctagaggctcaattaaaatcagatacaaattttaaaaataggaatatttaataggaagttctttgtatttcttacatcatatcagcgaatacataatgtctggtagtctttctattgatgagagggtagacatcatcttaaccctttcttctattgaatctagaaattcccttacaaatggccacctctacctctgcttaaattctttttttttttttttttctggattctcactctatcgcccagtctggagtgcagtggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctcgctctgtcgcccaggctggagtgcagtggcgcgatctcggctcactgcaagctccgccttccgggttcacgccattctcctgcctcagcctcccgagtagctaggactacaggtgtgcaccaccacacccagctaatttttgtatttttagtagagacggggtttcaccgtgttgaccagggtggtcttaaaatcttgacctcatgatctgcccgtcttggccttccaaagtgctgggattacaggcgtgagccactgcatccagccagtacgtagcattttaaatagtgtttcttttcccaagtagagtgctaaaaaaaaaaaaaattctctgacctgatgaaaaaactgattctatcttgatctcagaaatttgtgtttattagtaagagatatttaaccttctcatttttgtaatgtcccaaaagtaacacttgatttatttagtaatcaattcattaaaaatgtttattttttaaacaattactctaccatgagggcaaatttggttatagcatatataatggtttgtttaatctttgattggtaaaaacattctttgaggcttttattttattagaatcttgacatgctatatttgggggtaaaatatactttaatgccttattctagatgagtaaaaagtaatggtaatacatgtttcttgtgaagggaaaataaacaaggtccagttttattttactagatagcaaataaaaaaaaaaagagggattagtgatttcagtcttttagaaatggttggcatctctctgccttagttcttacctcacttgtaaaggattgagttcttccttaatgttttctcctggtatgagaatgtggttatattctttcttaggtaattgataggaatctaacctagtttttttttttgtttttttttagttactttaagttgaaatgtaaaggagcagttggttctgtacatttccaagcttctctgtaataattgatcattacaatgatgaccctaaagcatcaggaaaatactgtatactatatgctcagagatatatatatgtatatatatatatatatttgatggagtctcactgtcgaccaggctggagtgcagtggtgtagtctaggctcactgcaacttctgcctccccgggtttaagtgattctcctgcgtcaccctcttgagtagctgggactacaggtgtgcaccaccacacccagctaatttttgtgtttttagtagagatggggtttcaccatgttggccaggctggtcttgaactcctgacttcaagtgatccactggccttggcctcccaagtctgggatttcaggtgtgagtcactgcacccggcctatttttctaaaaaaaaaaaaaaaaagaaaaaaaaatctggaaagagggagctgccttacatttcagtctatatttattagactcctaatgtacatttctctctcactttctttattttgaaaaacaaagtactattcagtaaagagcctgaaactgcttcagtccaagctgattttgaatgcataaagatttacttgttggattcagtaaaaaaggaataagaaaaacttactatatagtaatttttcctaggtatatgacctcaaaattgtgcttagatgccattgaaatagatgttcatgttttccattccactcaacaaatatcacttaaaaacagtacagttggtgatttcttacagaaatcataaatatgtactgcggagtgaaaaaaccaactacttaactatgatgaaatgggaacttttggttaaatttgtagggataggccaggtgcagtggctcatgcgtgtaatcccagaactttgggaagccaaggcgggcagatcacctgaggtcaggagttcgacaccagcctggccaacatggtgaaacccggtctctactaaaaatacaaaaataagctgggcatgatggcggatgcctgtaatcccagctactcgggaggctgaggcaggagaatcccttgaacccgggaggcgaaggttgcagtgagccgagttcacgccactgcattccagcctgggcgacagaacaagactccatctcaaaaaaaaaaaaaaaaaaaaaattacagggataaatttgcagtggtaacattttacacatatgcaaaaagtgctgtatctcaaacagtttaggtggaaatgagtatgatttgctttcagaatgtgtgttaggtgactcagaaagtgacttcaatgataaggaatgcactggtttcgaatatatgcataaagattttgaatgaaggtgttttgtgaaacgttaagtaaggtaggagaaaaatcagtattttgaaattatgatttattattttaagcctcctaaattaatttgcatttcagaagtaaacatctggtgtttggtctatatctctaaaagtgtatagtcaagttggtcagaaaacattgtttttatgttcttattagaaaggaacatggtaaatcaccttgtatttgggttttctttctagttaggcttatttggtattaaagtgttgtggggttttttttgagatggtgtctcgctgtgttgcccaggctggtctccaatttctggcctcaagtgatcctcctgccccagcctacgaagtagtcgtgattacagacatgcttcactactcccagcattaaattatatttattgtacttcatttaaggtaaagaatatctaatactataatacaatattttgagagttctgcctaaaaatgttttggcttaaacaaaaaagttttggttatcctgaaagaacttaattttgtgagacaactcatttctctaataattctcaacaaagaacatgttagtataaatagctttaaaagtggtataatttgcttactatttagaaaaacacttctacccaataaatgaagaagaaagaaaaatccctgctttacagtttttagtcttatctagatccaattattagtttttaagttaatgtatttttggtgacttatcttttattaattaaaaacatttgcagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacaggtaagcttattcatgttttgggtattatttttattatgtcattatttagttgcctggatttacaacttactgttttcaatgatactgtatgctaaatcaatattacttggacattatcttgaatttcaaattattttccatacttaaaaatgattgcctgttttcagtgaatagacatgattctaaataatctgagtgtagaagttagtctaatatgcttttgtgaaggtttcatcaattgtgttgaccatacttcaatttgatcaatacttactttgctttcaattgttagggtcaaataccttgatgtcatatcagataccaaaagtgaccatttagagagcaacagaaagtattgagttagaatggatattttaactgccaccattgtaattttgtcatcttgaaacttaaaacacatccttggagtcctagagacgatctttataaatgtagatttcagtttgtcactgaccacaaatttcgttatttctgttacatctttttctagatcttgagcacatgaacacttggttacacatcatcctaatcatgactgttcatagactacttccttctcagacatttcttgatagcatttgtactatgtcttatgtaaaatacgttttaacttaagtaaaatttgttgttttagagatttttttcccttatctaataatcttcttgtttcagtgtgtggtgacatccatggccaattttttgatctgatgaaactttttgaagtaggaggatcacctgctaatacacgatacctttttcttggcgattatgtggacagaggttattttagtatagaggtaataatcataaactgtcatttgatttgctgttaagtgttaacacagatgctttcacttaatcctagttttcacaagtacctgtgttaggtttttttaataactctgcatattctgaagtttttatgaaaagctactatttattcctgttctgtctttcaaacaattcaaataaatttctttgtataactctgtttatataattataattgccatttttttcccagtggaatttatgagctgactgaggggtctttattgccctgttaactagtggccttaaaaatttagtgctatttatctctcttgcccctaaaggcattaaaccatgtgaaaaaagattacttgaattctgtctgattaaataaagtatattgtgatttttttattgcttgagccctagtgcttctgtttctccttgtgtagctattaagactcaagtatatcctatggaatctttgtgtatttggaaagtattaatttgtttttaaaaacttgaggcattaaaatgaccttttgattatcacttaacagtagatggttccttttcttcctttttctcttttctttttctttttttttgagacagggtcttactctgtggcccatgctggagtacagtggcaccagcatggctcaatgtagccttgacctcttgagcttaagggatccttctgtcccagtctctcaaatagctgggaccacaggtacacaccaccatgcctagactaatttttaatttttttgtagcaatggagtttcctatgttgcccaggctggtcttgaactcctgggctcaagtgatcctcctgccttggactcccaaagtgttgagattacagatgtgagccacattgccctgccatctttttaaattatataaacaaaatgcagcaaatgtagaacaatatgtattttccaatatatacattttttctttttttaatgaaaaggggatcatattataatattgtctgtaacttgctttttcatacatgcctacaccaaatatccttccaagtcagtaaatataaactcgtagcatcattttaatatctacattgttttccatctaataaacaaaccataattaattaattccttgtgttagacactgaagatgttcccagtttttttctttacaaatgatgctttaatgagtcatattattcatacatctttacatacttgcctgattatttttgtaggacaaattcctagaggtagaattgtggggtcaaatttctaccaatagatacctgtgttgcacatttaatatgttctaagcatgttctaggcactgaagacatatcgattaatcctcacaataatattaatgaggtaagtactgttgttttattcattttatagatgaggaacctgaggcttagagaggttaagtaacttgcccaaggtattattagtaaacagcatagccaggcaatgtgactcccagcatatgcttttaaccaccttccctagtagatactgaaaccttacctggtgaatttatgttggttactgttgtttatatctccttctccagtgtttccaatatacctttttttctgaggtgtgctaggattctcagagtggaaggaagttctagactctgtctgtcctgcttcccttaggaattttgctattttgagttcttcttcctcctgctgatagttgattattagcctcgtcaacttttcccaaattgtcacagggcttcaggcaaatcagaaaatggcccattttaacaaaaaaatttcaggcatttgaccaaaacaataaaataaacagttttatgaagcttatttggtaactaagttggtgtgcatgtccttgtgtaagattgttttgcagctgactctttttttttttttttttaattgagatggactctcactctgtcgcccaggctggagtgtagtggcgtgatctcggctcactgcaacctctgcctcccaggttcaagagattctcctgcctcagcctcccaagtagttgggattacaggtgcccaccaccactcccggctagtttttgtatttttaatagagatggagtttcgccatgttggtcaagctgatctcgaactcctggcctcaggtgatctgcctgcctcggcctcccgaagtgctgggattacaggcgtgagccactgcgcctggatgtagctgactcctttaatacattttgttgttataaaaggaaaataacaaagaatcaaaataagcatcgagaacagattatttccctgattttattacttttttcccttttgaataaaatgaaggatatgaatagttacatgtttagatataccttaatttattaacaataaagttttgttgggtgtggtggctcacacctgtaatcgcagcacaggttggccaagtcaggcagattgcttgaacctgggagttcgagaccagccagggaaacatggtgaaaccctgtctccacaaaaaaaaaaaaaaaaacttagctgggcctggtggcatgtgcctgtagtcccagctgctcaagagactgaggtaggaggatttcttgagcccagaaggtcgaggctgcagtgagcagtaattgtgccattgcactccaacctgggtgacagtgagaccttgtctctaaaaataaaaaagtttgttttttctttttgcatatgattatataaaccatgcttatttccatatcaaatatttcttccttttttaagcaaataagtaaaatgtgagtctctttcttatgttaaatctatttagagaatagcatctgctataatgtttaataatatttttatttgaaaaattacatttgcattgaattagttcagataataagcacttaccatatgtaaggcaatattcataatcaatgaaacaaacataaaacatggaccttcccttcatgggcagcatggcataatgcttaagatcagaggatcagaatcctatctccatcacttagaagttttgtggttttggacaagttacttgagatctttgcttcagtttctcatttgtaaaataaagatgatattacatacttcatagtgttgtttgaggaataaattaggggaattatatagtgcttcacatattgtaagtacttaataaatgttagctgctgttattttgacagtattatttactaatacgcatctgtagaccagtgtgctaattgtttttatattgggcagtctgtaaatccaaagtaattaaatagattgtttgactcattcattcaacaaatatttattgctcttctcctatttgctaggtactcttctgggagtggagaatcaaaagtgaataagatgacaaaatctgtgattttgtggtgcttatattttagtaagggacaaagaaagataatagaggatggtaagggtagtagaggaaaaggagcaaagatcaagcagcttcattaaacaaaagtacaagataaattcactagaaaaattttcttttgcagtgtgtcttatatttatgggttctgaagattctatacccaagcacattatttcttctgagaggcaaccatgaatgcagacaccttactgaatattttacctttaagcaggaatgtgagtactgccagaagaaatgttttcacttcctcagtattcttttggacttaagtgggtagtaagagttttgaagactttacagtgcaacatgtaaggacagatttcatgtccacacataaagctttgaggaaagttgtcgagcactctctggtgtttaatggtattaagaagtttttggtggggcatggtggttcacgcctgtaatcccagcactttgggaggcccaggcagggggattgcctgagctcaggagttggagaccagcctggccaacatggtgaaaccccatctccaccaaaaatacaaaaaaaaaaaattagctgggtgtggcggcacactcttgtagtcccagctgctcaggaggctgaggtgggaggatcgcttgagcctgggaatcggaggtcatagtgagctgagatcatgccactgcacggacaattgcctgggcaatagagtcagaccctgtctcaaaaaaaaaaattttttttcatttcagaatttcttattatgtttaacttttacaaacatacttagagttttatatataagttttaatgttacaattaatttttctaagccaggcacggtagctcacgcttgtaatcccagcactttgggaggccgaggcgggtggatcacctgaggtcaggagttcaagaccagcctggccaacacggcaaaaccccatctcctaaaaatacaaaaattagccaggcgtggtgacatgtgcctgtaatcccaggtactcaggaggctgaggcaggagaatcacttgaacctgggaggcggaggttgcagtgagccgagatcgcgccattgtactccagcctgggcaacaagagcgaaactctgtctcaggaaaaaaaaatgtatatattttttctaacaggaaaaaataaaaaccaaaagaaaaaaatgttattttgcattggagatttttgtccttcaatcttgaggcattcctgtgaggaatcctaacaaattgtttatcctgttaccattgcagatcatttcaatcatgctattaatgattgaaattcttcttaaaatttttttgtttttttaaatatcattgttttaagactagtcaggtacagttggtgaaattcttaacctgcaatgtttatcccttttctctctcaaattattatagcaatggtaatctaatacctgtaagtaaccatatgttacagaacaagattaggcctttttcacacctcaaacctttgtgcttttttattatttttgttatttttattttttttttgagacagtctcgctctgtcgccctggctggagtgcagtggtacaatctcggctcacagcaacctcctcccgggttcaagtattctcctgccttagcctcccaagtagctgaaattacaggcatgcgccaccacgtcctgctaatttttgtatttttggtagaggcggtgtttcaccatgttggccaggctggtctcttaactcctgacctcaagtaatccacctgcctcgtcctcccaaagtgctgggattacaggtgtgaaccaccgcatctggcctgcctttgtgctttttaagttaatatttatgactgtattaagtagagttaaattctaaaagcagaaataatttcaacgttttgagactcaaaacatgatccaataaaggtcatactaagtagagacttgcagcaacaggagaaaaatacagtgatgggtagtggcagaagtggcatactcttataacttcaaggatcaggcagttaacctaaatgagtaagataagacctggaaagtgcatgcttgacctaaaagcagtcaaattagaatttttattaaaccacagtgctagaaaacagagtcgttagcagactgccagtgtagaatctctggttgctggatatatatatagtttttttaatatttgaatattacagtattaaaacaggaaataggaactaagttctttttctttgcctagataaataacaaaccacctaccaaaatctcatcaaaaccaaaataggaatttaaagttgtaaaggagcaaatgaaagtgcatgatatctctctaaaagtaaatgatagtttgatttggtagagttttgtctttcttgtgtttctatattggcttcctgcttcactgcccattttaaagtattcattgtaggcaagaggaacccctcagcttttctgacatgagcatgctattatcttttatttttcagaaaaaatggatgaaccttgaattttgttgtgatgatgtagtcatcttgcctgtaataagaataaagtagtcattgactcttagaataaaataaagcaagtattaaaatgattttaacctcaagtacagttctaattttgccttatttggccgataaaggtgaagggttgagctgtttttaagagatttctttcttttttttttttttttgagacagagtcttgctctgtcgcccaggctggagtgcaagtggcacgatctcggcccactgcagcctccacctcctgggttcaagtgattcttgttcctcacccattgagtctctgggattacaggtgcacaccagcatgcctggctaatttttgtatttttagtagagacagtgttctgccatgttggccagactggtctcaaactcctggcctcaagcgatctgcctgctttggcctgtcaaagtgctgggattacaggcgtgagccaccgtgcctggcctgtttttagagatttgactgacttatttttaacaatacgtgatgacttttctgtcatccaaaataattttagagagcaaatattttgcttcataagacataacatcatcgagaataattttagagagagcaaatattttgtcttcataagacagataactttgcatatttttgttgattcttataggggaagatgctttccttaaaaaaattgtgtgcagtaagatttattctctgtggtatttacttctgtgacttttgacactgcatagagttgcccactaccactatcatgatacagaaaagttttatcatgccataagttctctcttgctacctttttatagtcaccccttcactcactctgaagccctggccaccactttgctgtttactgtctataattttcttgccatctgtctgtctgtctgtctgggctattactacagttgaaactgtaactatctcaatttcattataaatagctataagatataaaggaggggagagaacaagaaataaaaatctaatatatatgtttttaaaatggtcacaccaccaccagtaatgtaattttcaattagttttttgtttttctaggtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagagtaagtatatattttacttccgagattgatttctatttatagtacattgttgagtagagcagaagtttcaaacttcacttcactgccaagattaggtaatagtaaaaattagtatactgatatcttaaggaaataacttctgtttattcacaataatatagtatgaactgtattcaaagttggtatcgttttcctatgcacattttatccttactttttgatgagttacttctgttctttcttttctttctttcacagttagatagattcaaagagccacctgcatttggaccaatgtgtgacttgttatggtccgatccttctgaagattttggaaatgaaaaatcacaggaacattttagtcacaatacagttcgaggatgttcttatttttataagtaaggaaaaatatccaagattaatcacattttagttgttaacatagcatatgcttcatacagaaaagccattattttacttaatttactctttttcccccacagctatccagcagtgtgtgaatttttgcaaaacaataatttgttatcgattattagagctcatgaagctcaagatgcagggtaagaattctgtttccctgacccaaattaacacctaaaatataaatcaaacttagtaaccatgattgatgctttacgatgcatattaagctatttgttttgcagctatagaatgtacagaaaaagtcaaactacagggttcccttcattaataacaattttttcggcacctaattacttagatgtctacaataataaaggtaagatattgttgataaaaaaaattgttaaacaacttagtattttaattgactttttttaatataataaaaaaggggtgttgtttgaaactattagtatccagatttctttataaataactgtaagatggaggggagagaacaataaataaaaatccaaaatgtgaaactaagtaatatgtaaccccattccacaacttgtctcttggaaaagccattttgtaaaacgtgctctgagttaagtgcatcaagcaaaaccaaacatgattttctcaaactcccctttcttaaatcttttcccttattgaggatgttttcttatttgtataaagctgctgctgctttgatgattttatttgcactgtctacttgtttagtttatcatgtttcttgttttatgttcactgatctaggttctctttccctttcttatttccttcttttacctccacagtcttatcactgccccatgaagatttgtatttgagcttttttttaattaattcagtttcatctcatttgagggatacattcttctctttatttttactgcttttttcctttgccttccgttccagagattttcatttccccaccttccctgaaaatttgacctgtctatagtaattggatttcattttattttgaatacagtttattgacagaaagtgccaaagggtcttaatctagttaagtgtgtgccaaggacattgaagatgagattgggtatgtttatgtagtttacatctttggaagatgatattaagaggccagcttctcttctgtcttgacatgtctggaattcagttgactatgccatagcttcaggatcagactggagtggatgtgccaagaggaaagaacagaaggttaaagactttaaaaaggacatttagagagagaatgaggtcattgctaaataagggtcatggtgtaagttcaaaagaggaacagaggaagtttttttggatgatgagaggtgatggttaaaagattaaaacacttgcctgagaccaaacagtagcatgctggataacttgggtacagaatatgctacaagaacttacactatagatatcttatgaaatatgacttcatttttgagaagaaacatatctaagttttgattccattctttctctctctagacagggtctcgctctgttgcccaggctggaatgcagtggtgcagtctcggccgactgctacatctgcatcctgggttcaagcaattctcttgcctcagccctccctaatagctgggatcataggcacccgccacctcgcccagctaatttttatatttttatagaatgaggtttcaccatgttcaccaggcttgtcttgaactcctgacttcaagtgatctgcctgcctcagcctcccaaagtgctgcgattataggcctgagccactgcgcccctgccctgattccattctcaaaaacagaaccaagtgttaaatttaactttctaccagtgctctaattcctcaactgtgacttcctcttgttaatattaagggagctagtgttcagtgtccagttgagtactgccttactgattgtcctttgttggtttgactcaggaggttaagggatggattttttttagcacttagaaaagaggctcaaaccattgactgtcttatcaaaaatcagatgtctctttgtagtcctgagtctgtacataaatagtgttaatggtttgagtgtttacgttgtatgggtatgtttgtaatttttcattctatccataaggcaattttctagatttttctctcttttatcccttacaaaagatctgaaagcttggtatcagctcataatttttgagactaatttaaaatactcttttttcccactttgaactgattgtcaaaacatataatttaaaatacttttatttcagatgggaatttcatatgggaaacaaacatatacttattaagttagtaaacagtaacatgtagcaggattacttttgattctctattagccacaatcacaaatgttggaatttaacatctgcatttcagtgcttttcattaaaatgaaaaaaaagtaaccataaaattatatctacaagacattttatacttttatgtattttcatgtgaaatgcattgtctgatcttaaacttctgtggtaggcagggtagacatattagtcctgttttataaatgagaaacacattagttgaataatttaccaagcattgcacagctagtatgtgctatagtttagatgagaatccagcccttctaacccagtgttctatacagtaatataaccagtaactgaaatctatgtaggtcatttaagattttaattatatcaacatattgaaacattagatacctgcatttgagatgaaaatgttatctctggattgtttggttataatattctcttttggtgttttagtaggattttttttctaaacaaagtaaaatatttctttgtagtaattttgtctgattttccatattaaatgaaacaaatacattcatacatttataagtaaaatgttccaaatgggtgggatttttttgtttgctttattaccattcagctatccttttcaggttgcctgaagctagaaagatcttaaattctcaatttgtttgaactttaaaaacctagaaaattgctcattgccattctgtgtttcctctaaaaactgagttttcacaattttggatttagtaaaaatgtatgttcatcattggattataaagtaaaacaaacattctggaaagaatctggaaatttcattagtaatgtgaagacctgactatagttatagttctacataacagtgttaaaaacaaaacctatgttattattaaaaattagttccttcctccctctaccagccctgattccactcacccccgatctcccttcctcttaatatttttctgcttttatgtattttatatttttaaggctaatgacaaatagttacttatctattaagttattgatgttcaacttatcttgcagctgctgtattaaagtatgaaaataatgtgatgaatattcgacagtttaactgttctccacatccttactggttgcctaattttatggatgtcttcacgtggtctttaccgtttgttggagaaaaaggtataatttttatttttaaaaaaaatttgttttattactgttacatttactccagtttactatcataggcacatacttgctaaaggaaaccaaagtctagtttcactgtggttacagctctccttgtgtcagtgggtgtggacataagagtctcaaagatattttagttagctgtttacagcccccatgtgaggctgtctgggggactgggagaagatttataaatagcccaatgtcttcagctgttggattttctttttttttttttctttagcttaaatcttttatgaaggggtggagagattgctttgcttgaaatgggcccttctgcatatcttaacaccatttttgggcattccaccgaaattcttggggaaatttagtagccttcattttagcaatattagtcattttaatagctgttctatactttaagagaaatcataaagagaaattcagattgtaacccaatattccttctcttatataaaaaatatgtataaaattttagtagtgatgcctttctaatttagaggaacacttgttagtacataataggctttttgagagaaaataaatgctatttaagaaattctgtttctgtgtttcatttgtagttctatagaattcttaggattttgttacctatcatgttcttttccattttaagttaatttttttcataagaaaatgcctcagtttccatatgtggaaaatgacattatgagagtacagacatgattataaaacattttgttcagtatccccctctattttttctcacctcttccatattacaaaatgttcctttctgtatgagatacgtcacttctgccaaggcaatttgtagttctgaaattcagaattaatacttaaactgtgtatgttaaacaggttttctgcagattgcatttggtgttcttcatttactcagtaggtccaatgttaatacggagatagaattaccctttagcatttgagaagggggccagttaagggcttaggtgcaagggatgcattacacttacaaccttctatctttggtgtatgagaaatagttcaatcatagcatcatcagatgaattaaataattcatcctgctcactctcctgccttcaggctagactgcaactcaactgttttaatgtaatatgggaaggatggaggggccaggaagataaggtaggaggaaaatggacatttcatagattctaatttgattctctgatagtcccacataaggaaatatttcgttatatctaatctaaatatttatgctatgagtatttaaacaaggaaagaaatagagataataggtttttctcaactaatgcacctgtcaaaaaccagggcatcatagggttttagagctcataagtggatataacagtcatttagcccaactccttttgagagatgagataatttaagatgaattctgtggatcccttacaagtgaagatggagaacagtaggcttttatcagtattcctgtatttgaggtctggtactaagtgatctttagtttttccattgccactctaaatcatcttttataaacaaagaaatattcaaactttttgaccatttttgttgtttttctttagatcttctctaaattattcacatctctctaaaaatgtaaagctcagattttaacattacatgcaaatagaattctagccagtgttgagcacagtaagaaaatcttctcaaactctttgcatattttgctattttaatacatgatggctgtttagatagcctgactacttcttgatggtaatgagcattttcttttggtgtgaaaagcagcaagtgacatttgttttacttcgaagaagccagctggactctgggtctagttcctgagaagcaggaactaacctaagccagaggcttcctgaaaggctgatttaatcccaaaattaggcgaaagcagtgtttccttacccttttgggagctaaaacccccactatttttttttatagagacagagtctcgctctgtcacacagactagagtgcagtggtgccatcatagcccacagcagccttgaactcctgggcttatgtaatcctcctgccttgggcttgtaaagcactgagattataggtgtgagccactgcacctagccaagaaccccttttctgtttcactaaaaatattcctacattggcctgtagtcccagctgctagggaggctaaggcaggaggatcacttgagcccaggagtttgagaatacactgtacaacaatcaaacatctgaatagccactgcaccccagcctagacaatatagcaaaaccctgtctctaaagaagtaaaataacttacattgggaaattttcaacatacaccaaggtagagtgaataatatgaatttcctatataccaattattcatcttcaacaattatcaaatcatagccaatcttgtatcatttatgtccccatccagtactccccacctcatacctcaattattttgaaacaaatctcaactcttttctatctataaatactttagaatatatttctaaaagataaagagtcacattttaaaagtacaaataaaaacatttattaattttttttttttttttgaggcacagtctcattcagttgcccaggctggaatgcagtctcattctattgcccaggcacaatctcagctcactgcaacgtccatcccccgggtttaagtgattctcatgcctcagcctcctgagtagtgggattacaggcatgctgtaccacacctggctaatttttgtatatttagtagagacggggtttcaccatgttggccaggctggtctcaaactcctggcctcaagggctctgtttgcctcaacttcctaaagtgctgggattacaggtgtgagccactgccaaaaacgtttattaatttcttaatatagaatccctttgagaatctgataaaagttatggacttttgcttcagaaaaattcatgtataaatgtatgtactcacaacattttcaggatggtcatagttctgaaatgaatttgcaaccttcacacttattggccctcctttaagaacctctgttctagaggatctaatattatatgatcttccatagaaggtcatacatgtaagatttatttattgactagattttttttaagtgttttattcaaggtaccaaggaaatacagatacaagtaagatgggtctttgcagattaatgtgggacctgtgatatatataaataatgataataagatgtaatatggtaagtgctccaagacaagcgtagttttataggaattgagatggctgggcgtggtggcttggggccaggcgtggtggctcatgcctgtaatcccagcactttgggaggctgaggtgggtggatcatcaggttaggagttcaagacccacctggccacgatggtgaaaccctgtctccactaaaaatacaaaaattagctgggtgtggtggcgggcgcctgtaatcccagctactcgggaggctcaggcagagaattgcttgaacccaggaggtggaggttgcagtgagctgagattgcaccactgcactccagcctgggcaacagagcgagactctgtctcaaaaaaagaggagaggccgggcgcagtggcttacgcctgtaatctcagcactttgggaggccgaggcaggcagatcgcgaggtcaggagatcgagaccatcctggctaacgcagtgaaaccctgtctctactaaaaatacaaaaaattacaggtggcgggcacctgtaatcccagctactcaggaggctgaggcaggagaatggcgtgaacccaggaggcagagcttgcagtgagccaagatcgagccactgcactccagcctgggtgacagagtgagactccgtctcaaaagagaaaggaggttatttctgtcagagggattaaagtagcttttgaacaggggcttgaagaatggtggaattgtgctggtggatatgagcaacagaattctagataagagaacttcctgagcctgagtctgaaagcaagaaatcataggtctctttgagggtttaatttgattagtgagtaggatctatgaaggacagtagtagaaaaagaatgaaaagttaggttagggctagatcatgaggatattgatcaccacacagagaagttggaactttgataaatggtgagcaagccattgagatggaatttgactgtggtcgtcatttagaaaaattactgtggtgaagtagactggaaggaagacttgacgttgagagacctgttatgaagttacaccagaagtcaggtagagacataatgaaggcctggtagcattaggaacggagagtggggagaaccaaaagaatggtagaagtagaatcagtgagacttaacaagattacatatttaagggtagggaatggttggagatgacttggatattttgagtctggtgaagatagtgccattaacacactccaatgagaaaactcttgttacaacaaccctttactcaggttactgctgttcttcatgttcattggaatctctaggcctttcagtatgtcattttcttcctttttttttttttaatttttttttttgggagacagagtcttgctctgtcacccaggctggagtgcagtggtgtgatctcagctcactgcaatctccatttcccaggttcaagcagttctcatgcttctgcctcccaagtctctgggattacaggtgcatgtcaccacacctagctaatttttgtgtttgtcgcagagacagggtttcgccatgttggccaggctgctcttgaacccctgacctcaagtgatccgcccacctcaacctcccaaagtgctgggattacaggtgtgagccactgtacccagcctaactaagtcattttcttactagtcaaatccctttttacctctcttccttattaacataccctcaaactcctttcttttctgtttttctacttcatttgtcctataaatcttaggtctagtcaaatccagccatccattttctccattcctacagccacagtacagagtgctgctggagatttttacggacttgtgaattggcaccaccccttgatttataacattagctgagctcccagtaggaccctcataccgtttatatccctagtctgcttttttctcccattttgcttaggatagagtccaaattttccttttttaaaaaattgtataaagaaaagagggccaggcacagtggcacatgcctgtaatcccagcactttgggaggctaaggtgaaaggattgcttgagcctaggagttcaaggctgcaggctgcagttagctgatcactccactctactgcactccaacctgggtgatagaatgggactctatctgaaaaaaaaaaaaaaaaaaaaaaaaaagaaggagtttaattggctcgtggttctgcaggctgtacaagcatagcacctgcatctcctcggcttttggggaggcctcagggaacttctcatggtggaaggtaaagtgggagcaggcacttcacgtggtgagagcaggagcaagagagcgagggggaagatgccagatacttaaaaaacagccaaatttcacaagaatttactcactatcgtgaggacagcaccaaagggatggtgctaaactattcatgagaaatccacccccatgatccagtcacctttcaccaggctccacctccaacactggggattacaattcaacatgagatttataggtgacaacatccaaactatatcattctgcccatggtccctataatatcatgtccttctgatatatcaaaatataatcatctcctgccaatggttccccaaagtcttaactcattctagaatttaaccgaaaagtgccaactccaaagtctcatctgagactcaagcctagttccttctacctatgaacctgtaaaatcaaagacaaattatttccaagacctaatgaggatataggcattggataaaataaacattcctgctccaaaagggagaaatctgctaaaagaaaaggggttcagacactatgcaagtctgaaacccagcaggcagtcattaaattttttttttttctttttgagacagaatcttgctctgttgcgcccaggctggaatgcagtggtgtgttctttgctcactgcaccctccgcctcctgggttaaagtgattaccctgcctcagacccccaaatagctgggactacaggcatgccccaccatgcctggctaatttttgtatttttagtagagacagggtttcactatgttggccaggttggttttgaacacctgagctcaagtgatccatgcacctcgacctcccaaagtgctgggattaaggtgtgagccatcacgccagtcattaaatcttaaagctccaaaataatcattgactccatgtcctacatcctgggcacactgtttcgatgagtgggcagttctgtccctgtggtttttccacactgaggttgcaagctgccggtggctctgccattctggagggcagcagccctttctcacagccccactaggcagtgcctcagtggggagtctgtgtggggcctccagccctgcattttcccttggcactgccctagtagtgtctctctgtgagggctctgcccctgggcacctaggctttctcatacaccttctgaaatctaagtggaaaccaccaagcttcattcactcttacacttgcctaggggtttaacaccaggtggtggctggtgctggagcagtccctggctgtggggagcagtgtcctgaggctgttctggtcaatgggctcctccctgacccccaaaactattctttcctcctaggcctctaggcctatgatgggatgggctgcttccttttttccattgtcttggctattagcacttggttcctttcatatttttttcttaaacattttcttctatccatttccctcactagtgaaaacacattagtagttggagtgttctctacttactgttttcttcctttatacagtacccttatcttgaattcttcccttgttgaagaggtgacccttccattcaagccagtctaacttgtctctagattctattacctttctgctttttcaggaaacttgctttatcgtttatgtcctctatatcttcacattctcagtactagttcttttataaattattcaaatctatctgatctttaaataaataacatttctctcatctgatgtcattttctaactactgtgctgtgactttttttttttttttttttttttgctattactttcttgcctttctttcagaagccaagtttctggatgaaaatgtatactttaaagctacgatttaatatccgttaaatggctccatgtagctttcgagataaaccttaacctgtcaacacaaagtccttggaccttccctactttctcttcagcctcatttcctgcctttctctttcacgttatcttcgttctagccataacacagcaaagccagttttctgaacgtgttatgctctttaagttttataccctcatacttttctttattttttataactgctttattgacatgtaattcacataccataaagttgacctatttaaattgtacaattccatgttttttatatactacagagttgtgcaatcattaccacagttttggaacattttcatcatcccctccaaagaaaccctgtgcccattagcagtcactcttcattttcccctaaccccccttgctaaccctaggtaaccaccaatctgctgtccccatagattcacctattctggacagttcatataaatggaatcacacagtgtgtgctcttttgtgactggattctttccatggtctcaaggtttatctgtggtgtagcatgaagcagtacaacattcctttttatgatggaatagtagtctattgtatggatatagcacattttgtttgttttattcatcagctgatagacatttatttctactcttggacttactaataatgctgcgaagaatatgcatgtgcaagttttatgttttcattttctttttgagacagaatcttgctctgtcgcccaggctggagcgcagtggcgcgatcttggctcactgcaagctccgtctcctgggttcacgccattctcctgcctcagcctcctgagtagctgggactacaggtgcccgccaccatgcccagctaatttttatatttttagtagagacagggtttcactgtgtagccaggatgatctcaatctcctgacctcctgatccacccgcctcggcctcccaaagtgctgggattacaggcgtgagccaccatgcccggcctatgttttcattttcttgagtatagacctgggagtgaaattgctgggtcatattgtaactctatgattaaccttttaaggatctgccaaactgttttccaaaacagctgtaccattttattgttgttgttgtttttgagacagagttttgctcttgttgcccatgctagggtgcaatggtgcgatctcggctcaccgcaacctctgcctcctgggttcaagtgattctcctgcctcagcctcctgagtagctgggattacaggcacgcaccaccacgcccggctaattttgtattttttagtagtgacggggtttctccatgttggtcaggctggtctcaaactcttgacctcaggtgattgtcccacttcatcctcccaaagtgctgggattacaggcatgagccactgcgcccggccttagctgtaccattttacagtttcatcagcagtgtatatattctttggatgaaaaaatatatatattttaataaatatacattttaatatataaacatatactttacatatgtaaaatatattttaatatagaaaatacatgtatattttaatatagagacagggtttcgccatgttgcccaggctggtaactcctgagctcaagcagtctacccgctttggcctcccagggtgctagggtgacaggcatgagctaccacacccagccgaggatgaatatattttcaaatcctttgcttattttataattgggttatttgtcttaaaattttctttattaaaaaatttttttgccaggtgcggggctcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattgcatagaggtgaagtcaaggcttttagtgtatctatcaccaggactagcatacattgtacttattaagtaatttcatcttccacacctctcccacctctctacccttccaagtctcctttgtctatcattccacactctacctccatgtacatatattatttagcttccacttatgagaacatgcagtatttttctgtctcagttgtttcatgggagataattattgagttgtgttttttagatattctatatgcaagtcccttacgtatatgatttacaaataattttctcccattccactttcactttctttctttctttctttttttttttttttgagacagggtcttgctgtgtcacccagactggagtgcagtggtaccatcttggctcactgcaacctccacctcccagattcaagcgattctcctgcttcaccctcccaagtagctgggattacaggcatgtgccaccatgcccggctaatttttgtatttttagtagagacagggtttcaccatgttggtaaggctgatctcaaacttctggtctcaagtgatccacctgctcagcctcctgaaatgctgggattacaggcatgacccccggcctagctgactttcactttcttgataatgtcctttaggctttcactccatcatctaggctagaatgttggagtgcaatcgtaactcactgcaatctcaaactcctggactcaggcagtcttaccgcatggccttccaagtaggtaggactacaggcatgtcctaccatgactagcttttttttttttttttttttttttttttttcttttttagagatgggatctttgtgttgcctaggctggtctcacacaaattactaggctcaagtgatcctccttcttcattctcccaggtagctgggattacaggcacatgcttccatgcctgattttttttgtcctttgaagcacaaaagttttctaattttttaaaaaaatacattttattgtgtatatttaaggtatacatcgtaacagctttattgaaatatatatactatgcaattcatctatttaaagcatacaattcagttggttttagtatatttctagagttgtgtaaccatcagaaagactaatctttctgtctctatagatttgcctttgctagacattttatataaataaggtcatatggtatatggtattttgtgactggcttctttcaaaaagttttttaattttggtgaagtcatatttatctgttttttcctttgttgcttgtgtttttgttgttatacctaagaaatcattgcctaatccaagctcataaagatttgcccgtttttttctgagagttttagttcttacattaggtgtttgatccattttgaattaatttttgcatgtgatgtgcagtagggggagtgcagtttattctttcgcatgtgaccatttgcagctttattcttttgtagttgaccattgttgaaatgactgttctttagccactgaattgttttggcacccttgtcaaaaatcaattgaccttaaatatcaggttttctttctggactctctgttctgttgtgataaatgactactacatcacttttttaacttctgtttagaatgccttatctgccctctccacttggcaaactcctagttcatgattcctctcaaatgttatctagcaaaagccttgccttccccagcaggtcttccccagcaggtcttttgcatatctttgaacacttacagcatgttttccatcaaccttttgcagttgatatttaatgtctccttcagtagttagtaagcttgttgaaggtagagactgtgcctttcatatctgaatcctagagctttaatgtagtacttgacatgtggggtgcttttagtatatttattagcaggaaaaagtggtttgtagaagtattgaattttgttttggatatgttcatttctaggtgccttcaggacatctaggtgctaatattcaatagacatttttatttattaattgaaatttgcttttatctttcttattttgtgtacttatttgttagatatttattgagtacctgtcatgtgccagggcacagtgccaggctctgaagttataatagtgaattaaacaacatcctacactcatgaagttttcattctagtaggggaaacatacagtatacaaatggtttaagacagttgacaggctgggcgcggtggctcacgcctgtaatcccagcactttgggaggccaaggtgggcggatcacgaggtcaggagatcgagaccatcctggctaacacggtgaaaccccatctctactaaaaaaatacaaaaaattagccgggcgaggtggcgggcacctgtagtcccagctactcaaaaggctgaggcaggagaatggcgtgaacccgggaggcggagcctgcagtgagccgagatcgcgccactgcactccaacctgggcgacagcgagactccatctcaaaaaaaaagacagttgacaataaaactagccaaggacatctagagcctgaaggagaggtcaacactggagatacagactttggagtcatcttcaacgaggtgataattgaaactgtaaatatgataatagacagaaattccaagtgattgaacatataggaggaataataatgcagagagaatcttgaggatatccaaagttttggggaaaaatgatccaaatgtgggaaaaccagaagagcagaatcttgggaaccaagggaaaagagaaggaaaaaaatatacagaatagtcaaagaggattaagcctatgaaagagccaagggttcagattgttagatagtcattagtaatctttagaagtaaatttcaagagagttgctgagccagtttttaaaagattaaggccaggcgcagtggcctacgcctgtaatcccagcactttgggaggccaaggcgggtggatcatgaggttaggagttcgagaccagcctgaccaacatggtgaaaccccatctctactaaaagaaaaaaaaaaaatacaaaaattagctgggcatgacgatgggtgtctgtaatcccagctccttgggaggctgaggcaggagaatctcttgaacctgggaggcagaggttgcagtgagccgagatcacgccactgcactgcagcctgggcaacagagcaagactccatctccaaaaaaaaaaaaagattaaatcctgagactttttggaaccactaaaactctgccatgattttttttcttattatgctatatccatgaatgaagatttgaaatgtatacattcagttgttattcatctctgttcttatctctatggggcttcatttttttttttttttgagaggcctgaaaatttgttccataaagaatctctttctctcagagttgttatccactgaatttctttcattttgaaagcctttgcatttttaaattccatcgatcttggtataagaatgtgtttgctttcttgggctaaacattatttgaccatttgtaaaaatagttgctatgtgtatgtatagacagttatatatggtcagctaacatgtaacttttttttcccaaatagtgacagaaatgttggtaaatgttctgagtatttgctctgatgatgaactaatgactgaaggtgaagaccagtttgatggtatgattattcatcttactatttttttttttactgtgaaatggtatttctttactgcctagcctcagtacacactattttgcaaaaaatagtcattgctttcagagactatgctatttgataagtaacaagttactttttttggatattaagatttgaaaataatttcagtgatttcatttttttattgtaatatggggaagaagatgaactttgggaaaggagaaatttggaagaaagaagataaggaaaggaaaattgaagtgttaaaaggatgtagttcttggcaaatatggacactggttagagaaaagaggataaaaatactatttgttttattagaacaatattcttagtgcatcagaagcatacctgaactcccaattttgcttttcctgccttttagacactaaaatagactgcttctaaattagtgtgattgtgttctaaaagaccacttgctaatttagtttcagattctgaaagcatttttttccacagaaacaaagttatacatggttgttgttacgtaagccaacaagcctatgtacctaatgcatgtttatagtaaaaagtaatactatagaaacaattcattttattttgttttgaaatttttatttaaaactttattatttaaatgtttaattaaaacctgagtacataaaaaggtaaacaatatataaactgaaaacgattcccttccatattcccctcatatctttgttgtagtatactttttatagttgtaatcaatatttcaatgtttccgtgtattaaacatggtctgtatattggtaagatttaatagctacgtatttctaagtccattgataaactataatgtttggctagatgtggtggctcacgcctgtaatcccaccactttgggaggccaaggcaggaggatcccttgagcccaggagttggagaccagcctgggcaatatggaaagatttccttgtctgtattaaaaaaatatatatatacacacacacacacacgaaaatttaattttcataatctcattgtttggcaactgggttctaaattatccttatgaatagcagtaaaataaacatatttgtataatagcttttattttcctccttggaataaatttattggagagaattatagagttacagaattaactctgtaattcttttagcttcatcgttttagctgtgaactaccagattgctttgcagaaggattggaccactatgaagtgcctccagcaaggaatccataaacatatttctccacaggactacctcattggattttggtcatttttacttattttcttcatggctatatagtagtaaattatagttgcttaagtttacatttctttgatttctaatgatgctaagaagaaaattactgtttttccaactgtgtaaactatccatttcatttgatcacttttcgagtaaaatctgaatgaagcctatttagaaatttctttacttacaaacaggtttgattcttaaacatttgaaagcccatttgttgaaagtacaaggtaactgtacaagcgctaccattgccatctgttagtggtaggcagagatgtgcttttattcttacacatttgttaataactgacatagtatatttattatcagttattttttagtttggatagtaaactttagtgaataataattactcttccttattttaattctctttcctttttttttttttgagacagagtcttgctctgtcacccaggctagagtgcagtggcgtgatctcagctcactgcaagctccacctccctggttcaagcaattctcctgcctcagcctcccaagtagctgggattacaggtgcccaccatcacgcccagctaatttttgtatttttagtagagatggggtttcaccatcttggccaaacttgtctcgaactcctgacctcagatgatcggcccgcctctgcctcccaaagtgttaggattacaggcgtgagccaccatgcccagccattgaatagtttcaaatagatattttgtttccctgttctgctgtcactgttttaagaatagacctgggctcagattctagttccttctaatggctctgtggcatcagacgacttacttaacctttctgagtctcagtttctctcatgttcaaagaagtgacagtaatacctacttcataatgttgtaggtattgagataatgaataattgaagtaattattgccacatagcctacttttttttagaaagttttctatttttcaaaatctgtgaaatatttagtgagagttttaattgatattatgttaattctatatctgaatctaggggaggttttttaaatttttttttttaagagatgaggcttccagccgggtgtggtggctcacgcctgtaatcccagcactttgggannnnnnnnnnnnnnnnnnnnnnnnnnnnnnnnnnnnnnnnnnnnnctgggcgacagatggagactccgtctcaaaaaaaaaaaaaaaaaaaaagagatgagtgaggtttccctatgttaccaaggctggtcttgaactcctggcctcaagcagtcctcccacctcagcctctcaaaaagcgctgggattacaggcatgagctaccaggcctggccaagtcttttgtttttccttccttccttccttcttcctttctctttctttcttttttaaaaaatagtatttagttttccaaactaagaccaagaactcttgctctatataattatttactatttcctccatttaaggttatatagtttttctttgaaaaaattttgtcattatcaagttaaattaatacatctgtattttatgttcttattactattacaactggtgtctcttattttctatctgtgtaaaagaatatactatatatttgtgggtttatcttatatctaacaaacttgaatcagcagaattattttctatgataattttaagtttgttttctattacttttaaaaatatgtcatttataggggattgatattgttatttattttctgtatttttacctttcttttattctttaaaagttattatgagtattgcaatagtatgttaaataggcatgatggtagataatgctttagtcctcttcttataataataagaaaaaaaggttccttgttaagtctaattatagtacttggttttaggtacctatgatttatatgaataaagatactgagtcatattttgagatggaaccagaaataaatataaaattttattatattctaatgagaagattttatatatcatcagtatttttcctattagtatgataatttatccacttgttattatcattcttgcattccagggatgaattgaatttgatcattaaagaggcagtgtagtttaatgaaaaggatcagtggtttaggtgtcttgtcactaccgttcactagctgtgtaatcttagaaaaggcacctaatttctcaggttttcttattcagaaactgagggaatagagaggatgaaaattctttcccactcttaaataattttaaaaattgttaagcaccatttatgacaatgtttctatgggaaaatacactgagttccagctttgaatattagaaatagatctccctttactgctaacagggcaggtacaattactcttcattgttttcactcttccagtaccacgtattaggagtagggactctaagaaagttttaggaatatgagtctgggagtttgcatggagaaatgggaatggtttgaaagagaaaagaatgttgaggaaatggaggacagaggaggagattcggatagatactaaggtttaaagtggggtagggaaagagctactggaaataggtttatttcccttccttatttgtactccctgatttcttccctctaactccctccatcttttctcctttcctttcactgtaatggcgtgccttctgttctctccttcctcttttcctacacaacggtgaaccattctatggaactggtctggggagatatctgactttagaaagaaaacttgatgggatggctgtggaatcagagtaagggtttagtttttctttggggaaagagagcgggattggagatttctgagtgtcaggaaggaagaagtaatttttgtatatttaaagctaagatggccgggcgcggtggctcaggcctgtaatcccagcactttgggaggctaaggcgggtggatcacctgaggtcaggagttcgagaccaacctggccaacatggcaaaaccccgtctttacttaaaaaacacaaaaattagccaggcatggtggtgcgcacctgtagtcccagctattttgaaggcagaggcaggagaattgcttcaactcgggaggcagaggttgcagtgagccgagatcaccccattgcactccagcctggttgacagagcgagactcggtctcaaaaaaaaaaaagctaagattaggtaaaggcataagactgttgttaagtggtaaatctttggtgctctgtattgtttaatgtatgtgtggggtcatttttaagacaaaaatttgcattaacactaatgtataaacccacatagcatccgttttagaagtgttaatcataaaagagaatttttgaaaactgatttctgtgatatttaggttgcatgcagttttttccaggtgtttatcttttgtcttcagtttggtaaagggaagtacataatccatatgtgttgcagtttcactaaaataaatacatttcctataaaggaataatatatctcagcattagaatggaagatatggaaagctcaaatgaaaccaccccagctgcctactcttagaactgttacttgatttgaaacaatctgttgctatttttgcaaaaagatgtcccccaaatttcccagattggactggggacagaaagcacatactgttgctcctgagtatatgcaaaagttctgcaattcagatttaggaaatcatgtgctcttgttagggaatatgggaggtttagcttttccttcgttgggagggggtgaggttttctactgaggcagtttataaagttacctacatttctctgaatgtactacagattttgcagatgttggtgtccttgaagaaccacacaagtttgtatttcatttgtgtcattaccttttacttaacatacttccacaggtgacacatttccttaggggtatgactataaatgtgcaatatttgttagcagtcttttttacagacttatgtgttttcacatgtttttttctgtccctaattatgtctgcttccatcagatatgatagttattctgtccataatttcttccatgcacatgtcttttaagaaatctttactttagagttctacctagttgcatccctctttattcaccagattctacagtactacatttttcaaatttccaaatatgagggccttcatttttctctctttctacattcattcttcagtaccactgccaagttaaatctctatctttttatttgtcccaaccaccttttctccatcattcacttccttttttctggactctccatctgaagaacggctcatatatggcaataaaaaaggtacagaccagacagagtaacattgttttgaaatatgacttcataagttatcttcatgtccatgtaagttagcacattcattgagtaatgtctatgcagagtcctcttgggccttgtgcaaatttagcttaagttttatctgtgttagtgtttggtatttttagaagtcatattccaagatatctgtctttctgtgcatggaaatattttccctccttttcattcctgttttaaaatttcattcttttgcttatttgtaatgttttgtacttttccctgcatgattagggttgtttgattgtctattatttcccaaagaaatgttactgtgaccatttactttaatatgatgcatgatgtgtttgtagactgatttaaaatcctgatttgtacagtgtttttatattcctgtgaatttttcatttgatatcagtatagtttacatgtcatttggttttatagatatagaaattaaatctgaaaatatgaatgtacttattacagccatcctccccaacaccctactgcttatccccagtctagctactttaaaattctgtcaattttaaaacaaaatgtttataatcatttattagaagagaatcagacttaccttctatccttgaacaagtcacttaataacctcagtttctttgtctataaaatgaggagattgcactttatagtatctccattgtctcttcaaattctaatattctatgattcttatatttttagtttttgggggtttttttgtggtttttttttttggtattttaaaaatacctgtttagagtgctgtggtacccaggtacccacacagttttggacttgtaaaagctgtagcttcagtgctcataatatttaccctttagaagatcataaacatgtcatggagcctatttttttcccctaaaatatgtcttttgtttctgtctttcaagttggatttctttttctcttttcttgcagtcagatccagtcattatcttagtttttaattatatgtaattgtggactgcttgaattttaaatgagatgttctctcccagaagacttacagttgttcagacctctgtatacctaaggccccttttgaattagtgtctttagcctttccttaaccttctcctcaaccatggtgcttccatgtgtgttttcattgtgttgaagcacggctctaaggaaccacacttttgggtccagagtgattctagttgctatatatgaaataacaggactgagattgatgttgttctttctggaggccaagggaaggaagataaaacctttgagtcattcttcagccaaggatttagttattttggtttattctcttctacatcagttgtagacagcacagctaaccctttagagatgaagcagtagtgatcctttagccatgtttttcttgttgcttatgtcatactcacctagagatgtaaaagattgtatatatttgcatgaccttaggagcacctggtacattaggcacctggtgcattgttgaaatgctggtatggcccttagttcaggattacctgcacagtagctccttcatgccattcattttagaccaactcaaagcaaagaagcttattctgtcatagtctgatgggatattgtcagcctgcatgtcaaatactttgtgatagttaaataagactacaggactgttagaaattcttgtctgttagtctgcatgccataggctgtcatgaaaattaaacagagactataggattattatcagtttttgccctctggtttgtaatgcaagttgggctcaagtttgtttgtttttttttccccattgctgttttactgattagccagtagagtgaaatattaaagtttgtggattactttttatttctatatttatcagaccccagtattagaccaatgctgagctaaacattgagagagcaagacattttttagcatgagttcatctagtcccctccatgtaagctggtggcaggggtcttggtactggtttagatgagtgtggaacaggctaatagaatattgtaagcatgcatgccctaaacttgagcctttctctctatttattccattgaaagtaggttcagctgcagcccggaaagaaatcataagaaacaaaattcgagcaattggcaagatggcaagagtcttctctgttctcaggtaatgatatattttcttgattatttgttttgcagaaattacgtttattgtaccttgttacaagcattgtcccgcatctaaaagcaaaatggggccgggtatggtggcacactcctgtaatctcagcattttgggatgccaaggcgggcggatcacctgaggtcaggagtttgaaaccagcctggccaacatagtgaatccccatctctactaaatatacaaaaattagccgggcgtggtggcatgcacctgtaatcccagctactcgggaagctgaggcacaagaattgcttgaacccaggaggcagaagttgcggtgagccgagactgcgccactccagactgggcgactgagcaaggctctgtctaaaaaaaaaaaaaaagaaagaaaaaaagcaacaagcaacagggtatcattcttcctataaagaagttacttaggcctggccaggcgtggtggctcacgcctgtaatcccagcactttgggaggccaaggcaggtggatcacgaggtcaagagattgagaccatcctggccaacatggtgaaaccctgtctctactaaaaatagaaaaattaactggatgtggtggtgcatgcctgtagtcccagctactcgggaggctgaggcaggagaatcacttgaactcgggaggtggaggttgcagtgatctgagatgacgccactgcactccagcctgggtgacagagtgagactctgtctcagaaaaaaaaaaaaaaagggtacttaggcccttaggctgggtgcagtggctcacgcctgtaatcccaacactttgggaggccaaagcgggcggagttcaagaccaggctaggaaacatggcgaaaccccatctccacaaaaaagaatacaaaaattagccgggcctggtggcatgcacctgtggtcccagctactcgggaggctgagatgggaggatcacctgagccccaggaagttgtgagtagtgagccgtgattgtgccgctgcactccagcctgggtgacggagtgagaccttgtctcaaaaagaaaaagaagtttatatatttgtatactgaagatgggaacacaagtccctttgaagctaagatttttgactctggtgattgttattgctcatctttggtatctcttttccgtttgtgataacactaaattcacaccttgaaaattagagcaggataagaaggaggggatactttttagagtattcttgatgaacttgttcatccatataggaagtcccttgtgctggagccataaattgccttccctggggttaattcaggaagaccaggttaaagggtacaaatgaataggtcagtctttaaaaatttgtttgcacaactgactacatcagacatttgaacttcagagcatatgaaataccatattttctcaatagtatgatgccccttgatgaatcttaccacatatttaataaagcttttcaggaaaaacaatatatgcctcaatggtaaggcacaccctcatacctgaaacacttaaaatatagaaaaattaatgtcttgaaattgaggaaaatatggtaatagcaatgaatgtcatgaattttatatatggcctatatctagaccctatgtcttcttttaaattaagtacttgttggaagtatctgatatttgttatatctctctgctatagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagcattcctgtaatctggctcattgaatattttatacttaaaaaactttttttggcgtaaatatttgtgtaaatactgggttaactttttaaaagcccattacagattaaatagaagagagtgatgtgagtattagtgaccatacacagtaattcagtctagatttcttttcctgtggttggaaagcaaaaatacatgatgtggaaaagcctgaatttcatgtagtcacttttgacagccctctaagggtcattgtctattaaaatagcaacagatctgatgttttccttagtcataattaggtttctttttggtgttgtaattagtgacttttttagagggaaaaaaataggcaattttaacgttttgaatgaatttacatttgacttcacaatttcatttcacttggttccataataagtgctctttttttttcttttctctcttctcttctctttctttttctttctttctttctttctttctttctttctttctttctttcttttctttctgtctttctttctttctttctctctctctctctctctttctctctctctctctgtctttctttttttgtgtgcatgtgtacatgtgtgtgtgtgagagagacagacagggtctggtttcttgctgtgtcacccaggctggagtgcagtgcagcctcaacctcctgggctcaagcagtcctccatttcagccacccaagtagctaagaccataggcacatgccaccacagccagctaattttttttattttttttattttttatttttttatatttttgtattgcccaggctggtctcaaactcctgggctcaagcaatcttctgacctcagcctcccaaagtgctgggattataggcatgagccactatgcctggccaatgattgcttttcaataaaaaaaatttttttcctgtaaacaatttttacttgtagcctatacatgttctattttaaatgtcattgtattgttcactaccaccactggtatatctgaaaagtacactgtgttttgaaattataaattttcattctgaatgaggtttctttttttgattttctttaaaaaaaaaaaacaacctgctttgatttgctttacattccttgccctccatttttcttattatattgtaaacattagaaaaatgaactaaaaagaatttcatgaatgtacattaaaacaagatcttaaacatttgataaaactagtaaaaatgttaatagaaaaggatgaactttaatagcttcaaaaatattatactcttctttgttcagaaaagaaaaataaaaccaaaagggtatcatacttaaataaatctacagtatagtcatctctcagttatccttggatataacattacttttatattgtatccgcagcaaaccttgctttcagatttcacgattagcccctgctaattacatgctttgttgacttctgtttattcttaatttgtacacggcttgaagctcattccttcaactttgaaaccaccctcaactgcaggggaggtttgaaagacagcagctttgctggagggactctctattctcagcatggactaagttactggaaggaattgagtttaaggggtctaatttgggaccccttaaactagatagcttctagttttgctagctcttgatagtgtggtttgggcatttggtcaaaattattttcctagcataagataaatccactttgaaacaaataacaaaggtcatacaaaagctgcatgtttgtgattattttttaaaaagttatcctacattttaaattttagtagataatgttccctgatgttagtgtgtataactgagagttaggtattgcaaaaggaaaaaattttaattctaagacctcgtgcctatttgtcagaaaataaaaattgtcgtttcaagaactttaaaagttaatttacatgatgtttcttgagtgtttttacaaactgcacaactctattggaggtggattttctgttcatctttattttatgtatgttttctttctgggaaatttgattgggagctagcactgtaatgctaccctcaccaggatctatatgggaaatatatgtggccaattctatgttagtaataccaaattcctcttggtcatttatcttgcatagtactgaggaacacagtttgagatagcactatgctcaaacttattaaggccatgacaagatgccctatataactgaaaacaaatagaggagaaatagtgcctttcagatagagtgttgcaattagcaatctgggctcaagtgatcttcctgcttcagcttcccgagtagctgggattacatatgcacaccaccatgcccggctaattttttaaactttttttggggggagatgaggtctctctatgtgttgcccaggctgggctcaaacgctcaagggatccttccacctcagccatccgagagtgctggggttataggcatgatcttccatgtcctgcccgatttgtaatgtagtttaacagttaaggaaaattaactcttcctttattcagtgttcgtcctaattcttttgggtccccaattcactttactgtctggttaagatcaacattttctaacttagttcactttaataccttagattcatcagtttcttttacattaataattgctttggataaaattatttctaaatcatgttaattgctaaaagatcacttcaggaataattattctaattggccttattgcagaagaagcaaaataggagagaccagggcattacttttacaaatattctgagtaataaggggaatggacaatattgtaaaccagtattgttgtgtgctatcttgagtcctggtcctcagtgtgagctctttatacagttcaaacccagaaatgagcgaaaaaaagaatctttgactataaaatgtttgactaattatggtgaaattctctaaatggaccagtgacacactataccaataatgtatttcttatttataatatgacctatgtgtctatatcatgaaataattagaatttatgcctgtaagacctcacttctcttccttaatgtctctttaattggtagatgagtttgaaaagatgctcagtagtctttttctgaggcaaatttgagttcatgataaactctgtcagtataaatggaattttttaaggctatagatgttagtatctgtaggtatttggaacatcagtactagaatagaaaggaagttactggtagacaggagaagtcctttcaggtcccccacaaagaacagagccacagaactgttctacttatagtaattcatcaagtttactgcccttaaatttcactgtagtcatatcagctcttgcagcttatgttttgccttataaattacaagtaacaggtaaagcattgctgaccccttctagtttatgtcttagggaaccaactggtaatgagtattgttctcactgacatgaaagaaaagacttttctgtttgcttttctgctacaattctattataattttaccctagagcattttcctgtgattgtgatggatgtgatataataaacataatggaaaattctaaggccatcaaattactgattcaagatgggtaattaatactggagtgcatttgcatgggtgctgaggtgtctgtgtttacagtaggtttatgtgttctgtgctctgagtgatgttgtcatagtgctgtgtgtaaactgtgctgtgtcaggaattgggggtttggatggggctctctaatttgggtactatttatgttaaattttaaatgatgatgtagtatgggatactgtgatattttaagtgatcattgccttttctgctgtacaatatgacccttctcatctctctcattcattttgcatgcctctgctcacttctgtacagccacagttgaggctattgaggctgaaaaaggtatgatcagagtccttgtgctgggcagagatctgtggtgtgtgggtgggcatcagagaatgtcctgtgggtgtgttttactcctagcttttacagcccaagatgaatcagactcactgattcatcaagtttagaagccttgcagccctctttttttaatttttcatttttaaatcagaagggctgatgtctatggtgacagtctttttcttctttccggtgtaatatgcaatcagaaagtaatgtttctgatttctttagagtatagcatgttatgctatacagtatagctttataaagttgcctgttttaatggaaattgccaaactgacctgcaaatagagatctgttccatattttgcatgattctatgctactcagattttttttccctaagtgaatcctcctctaggtataggtgtgagtttgtttttacaaactagtgtgcctgactgagaatacaggaactgtcactataatgattttcttttttcttttttggccgcagtttgggctatagtttatggataagattatgttcatatatatatgtgttggcttggtatttcacattcctcagtgtttgtagccccagccatttgtttggttcatgtgccagactaagacctaaggattgcagatattaagcaaccagattataaccagtggtttgaaaatatttcctatgaacactttaataatggaggatgcatcattctagatgaagtgaatgagaaaccatacaattggtggagaattgccatttattttgatttgagtttccaaagactgtgcagtatggccaatgaattaaggagaacatcttctaaattacgagattataaatacttttttgctatcagccatacacagatctaactcttggaggcacttccacctttttaatgttatattggtggcgatgggctgaccttgacctccaagatagttctgatctactgtattttaacctttctttaactctttctcctcccaagctcttggtacagatttgtatattgaggattaaccttgtttagcctcctcacttgcccctactctcattgctgccttactgtgatagtcactggtgatcttagggactgatgtaggagataattggtatagtagaagtcagactgagaccctgagaccattgcctggaggttgattttgggggcaggagagggttaacattttttttgtatttttattttttggaaggctttgctaacacttgtcacctataaagctatgatgtttatatttaggtttaaacatttcacattttaaggaaagactgaaatgaggataggattcagttaaagtaagatttatgtgttgctacttacagctactaatttctttcttcttaaaaatcattaattatgtttttgaaatctcagaaatgtttttcaattactgacttatcaaatttgcattttattaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgctttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcctatctctgtgttgggttttatttggaagatgcaatctgatttgtccttttgatgcaaatcagaaaatcctgttactagagctgggatgtcctccggagattatctcgtggatagttcatggtaatttgattaattaaattctttataaattttgccttaaaaaaaacttttgttatatacttgttttacatgagcattagtaactgagcactagaggactttgaatgcctactgtaggcctcctaagtctaatatttaagatcactgtttattgtcttttaattgaaagaaaatatgttattgtctagaattttgttatagtggtattgggaatttactgggtgttctaacaataagaaaaatattagtgataattgcattttcctatcattcctttcttctttgtcataatcacaataagtataggattttgcacattgagggatattaggatattgctcaaaattatataatcatacaataacttgaattatagttctcaacaataattacaatgagatatattataaaacactaagtcaaaatataggcagggcacagtggctcatgcctgtaatccaaacactttgggaggctgagacagaggattgcttgagcctaggagctcatggttgcaggctgtgttgagctatgattgtaccactgtactccagcctgggtgacagagtgagaccccatcccttaaaaacaaacaaaatatatgtaaatatattaggcaagcgcacacacacacacacacacacacacacacacacacacacacacacatgcttgcctaattccaggtaacaaacagaacttctcaaattgtttcttttttctttttcttttgcttttttttttttttttttgagacggaatctctgtctgtcacccaggctggaatgcagtggcatgctcttggctcactgcaacctccgcctcctgggttcaagcaattctcctgcctcggcctcccaagtacctgggactacaggtgcccaccaccacgcctggctaatttttgtatttttagtagagatggggtttcaccatgttggccaggctggtctcaaactcctgacctcgtgatccgcccacctcagcctcccaaagtgctgggatttcaggcgtcagccactgcacccggccacaaattgttaattattataactctctgcttgccaaaatattaacttacaaagcagtccatgagttggctctaaagttattatgcattgcataccttaaagattgttgtctatgttgtttatgaaagttgcataccttaaagattgttgtcgatgttgttttatgaaagctattcagtaaagagtttatctggctaaaatagacccaatagaaaaattaaaaagtaagtaagagtttaactagtatattaggtgccaggaactttcctagcccttaggtacataactagcattatatagtgtttgtgggaatcatgggtgagcattaagtagtattagcaaaaaaactatggattgatggtaaaaattaagaggaaaataagagaaaggaaccaaactcaggaaaagcaaaatacctgaagagtgataaagtatcacatagtgcctcacagaccacttcctacatgttgaataggaacctctttctagtctttcttcataattcatttcacagcataccatttattaagattttttaaatgcaactcatgatgaatacaaattgtgaaaagttcagacttcgtaactttaaatgtttaccagagcaagtcatagtgatagtaaaatataagtattcaacatcaaagtttttctatattactattctcctttatattcattgacaacttctgaattagaaaagtcaatctctgatgtcttgtatcttctgcagttcagccattattaacagaactcaaaacatttgaggttctcagataaattttgaagcctgttaaatttg

SEQ ID NO: 17555 - DNA, 34047 bp, Human
  misc_feature (1)...(34047): n = A,T,C or G
cttgacctttagttttaatctcctttaggacgtgccccccaccgtactgccttccccagtccccgcccctcctctaggtgcccaccatccctccacaaaccacagctattgtcatggtaataattccattattagaaggagctttatgctcagcggaccagagctccctgagagcagggattgtggtattatttcaagcactgaatttgttctagtaatccttaaataaacatatgttgaatgaatgaatgcagtaacaggaatgttgagccaagttttgtttttgttttttgagacggagtctcgctctgttgcccaggctggagtgcagtggctcggtcttggctcactgcaagctccgcctcccgagttcagccattcttctgcctcagcctcccgagtagctgggactacaggcgcccgccaccacgcccggtaattttttgtatttttagtagagccggggtttcaccatgttagccaggatggtctcgatctcctgaccccgtgatccgcccgcctcggtctcccaaagtgctgggattacaggcgtgagccaccgctcccggcctgttgagccaagtattaaaccacataaaacacaggaggagaggaaagtattcagagatacgacagggagaactatttgaaacagtgggaccacagaccatgtgaactgtgcagagaggcctaaatagcctggggtttctggagggaagggaggttcctgggtggtggagcactggtgcacagaaaaggagatgaatcctgagagagaggttcctcactgtgaagggtctggtgttggggccaaaggtttggggtttccacctgtccagcatggcttttcaaactgtagggttttttttttttgagtggggggcagggggtgtctcactttgttgcccaggctggtctcaaattcgtgggctcaggcaatcctcccacctcgccctcccaaagtgctgggatgataggcgtgagccactaagcccagcagtaggttgcaattaaatcatgcacttatggccctcaaaatccgtctaggagctgccacaggttcggcgctgtaaaagtaaatatgcccacttagaaaatggggataattcctatgtcacagagttgtaaagattaaatgaattaatacagattaacacactgggaacagtgtcaagtgcataagcattatgtaaactttagctattatttgctattattgtgtttgctgttatttctctctaggagctcccagggggctaagaagtggtgggaaagaaagaaatgattctaagagcatccaataagggctagaatggaagtgagcaaaaaatgctgaggcccacagcacaggttgtactgcggggttcaaatcccatgaggccagcagcacccagggtctgtgagccctccagagttgggccctggtggtcgagtccagtcctgggggtcattgcattccctccctcattataaaatggggcctggaggcccggggcggaagaaaggggtccacaatactgcacggttagaggccgagccaaggctggatccggccagacctccacaggtcttccttagcctccacattgcctcagagtgtggggcgcccggctgggggcgaggtagcggaggcccaaagggggccgaagctaactggacggcagctcgcgatgggaactacgcttcccagcatgcgacggggcaaaggggcctttcagccgcgagcagcgcctcgcaggttctgctgggagttttcattgacctctgctccccctctcattttgatccccgctcttctgctctgggctccgcccccttctgagagccgatgacctggcagagtcccgcgagccgctttcttcttcccctctcattggcccagcctagctgccattcggttgagaggaggagaagttgcttactgattggtggattccgtttggcgccaactaggaaaggggggcggggcagcagctggccccactgagccgctattaccgcgaaaggccggcctggctgcgacagcctgggtaagaggtgtaggtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcaggtaaggagagaccggcgggcggtgctccgggcccctggcctcggtgtcggcctcggagagatcaggccaggaaacggaccgggagaagggcgagacccgtccgtccgggttcgccgctcggggacagccgggctagggcctgccatgtgcacccccgcccgggcggaatgttgggcgggagaggccgtcgggaccttccaggggaagaggtggagatccttgggcctaagcccgagccaggcccaccttcacccctttcggattgctccgtacgctccttctatctctatccctggaagctctttggaatctacccccgcggggaaaatcaggctcttctaggcactcactttcacccttttctaaaccatcctcaggatcttcgtttgctgtgatctttgttccttctcaacaaaggaccatggcattttctttcctggcgtttatgtaaaatcatctcagtccctcgccctgtgcacattcctgatgtccactctgctgctttcctaaggccaggtctttttacccaactttcagaaagcttcctgggcttttcctgatagcaaaaaatgcatcccacggtgtttcccgcggaagagctactttcccttcaatctctggcatcccgtttgctaagcacatgtcttgtgcgtttcccaacttctgaaaagcagaaagtgtcctgttcaactttcatcccgactctgtctcagtacttagaacacatgcttttattttaggaaataccccaacatttgccatagccatcataacctgcaatgtggtccaaggccatgcccacccactccttttttctcctttgcccaagtgctaattgggtgttcagagtggcaaagtgggatctttgccacttgtggtgtggcctagaaatggtttctggcagcctggctgcttcttaatctcatggcctatctcctgcatgtgaccttttaattatatcctataaatcattcatggtttatttctgttggtttcagtgattatgagcaaccactggaggtgaagaacaacagtaatctgcagagaatgggctcctccgagtcaacagattcaggtatttaagtctgctgtgtggggagcaatactctgaatttcctgaaacatgccttttcacccaggaggttagttttggtgagaacttgaggaagtcatggcattgggtgataaacttttttttttttttttttgagacagagtttcgctcttgtcgcccaggctggagtgcaatggcatgatctcagctcactgtaacctccacctcccgggttcaagtgattctcctgcctcagcctcccgagtagctgggattacaggcatgcaccaccacacccggctaattttgtattttttagtagagacagggtttcttcatgttggtcagcctggtctcgaattcacaacctcaggtgatccgccttcctcggcctcccaaagtgctgggattacagcgtgagccaccgcgcccggtgataaacattattgagaacaatacaaaggagcccttgtggctgtttatgaagaaaggaaataggtttcaaatgtctataaggaggtggtgtgtgcttgcccttgaaggatgggtagtaaagtataattcaccataccactgtaagtggcattcaggcaatcttactggttaaaatacaggatcaaatgattggaagtacagtgtcatgaaatcatttcagtgatgctgctatggaggaaattgccagtgcatttcattcttcatgaattcatattactgcagagtttatctgtatttgtacagataagaccattggtgcaaagatcctttaggttaaaggaactgcaagagcaagtcttaaaatgtaatgtaggcttctgtatgtagaatgtaatttaatatagaactggggataggattatcacttgtagcagtgtggtgagcaagggctgtaacacctcactttccataaggctgtatagacacatgagctatgggtgggtgggtctgcgtcatctgagctggcatattagtaatgctgaacagtgtctccttcaccctgctgccttttgtgagatggacaccttggtgtcattttgttaaaggcagcaagtgcttgccttgcatgtcatgaccagtagttgtatttttctttttcattttgagacaaggtctcaactctgtcacccaggcaactctgcctcccagatttagagaattcttctgcctcagcttccctagtagctggaattacaggtgtgggtctcaaacttctgatctcaggtgatccacccacttcgacctcccaaagtgctgagattacaggggtgagctactgcacctggcctttttttttttttttttttgagacagggtcttgctctgttttccaggtctcaggctggtgtacagtggcacaatcagggttcactgtagcttcaactttccgagctcaagcgaacctcccactccagcctccccaagtagctgggactacagacacgtgccaccacacccaactaattttttttttaactttggtagagtcaagtctcactatgttgccccaggcttgttttgaacttgtggcctcaagccatcagcctgcctcagcctcccaaagtattggaatcacaggtgtgagccactgtgcctggtcagtagttgtatttttcaagcctcatatgatttgacaaggtaaaacgtttaaaaactatgccaagaaaatctggtacctattgtttctatggttggaactcacagaaagttatctgggtcacctctatctgaataaccaaacaatcatgatatgaatcagttttattcaccctcttctcaaatcctatttcccttgatgttatttgcaaataggagaaaaaacagtaaatacgctatgaaaatattaagacttgtacaaacatgacatttttgacaatctaatagacgtaacatcaattctggcaaaagtacaagccatgaatatttgttgcctgacttaaataaagacccaggtactttgtttagtgttttaattttaatgacaaaatggtgttttttgtattatttcttgagaggttttttttttccccataggtttctgtctagattctcctgggccattggacagtaaagaaaagtatgtattcactgctttcaaatgtttatatgtagaaaaaacgtgtctaaacttaaataccttatttaaatgaagttcttcatacactggactggagccctggatttacctgtgcctagaaacactctggaatctcaagaatgaatagtttgtgtcagcaattttcagaactttttctcctttattttagctataattttggtgttctgtttgggtcttacccaaacccttactctgtgctctgacatcatagccttacaagaacatgtggggtttttttgtttgtttgtttgtttgtttctgaggcagagtctcactctgccgcccaggctagagtgcagtggctcactgcaacctccacctcccaggttcaactgattctcctgcctcagcctcccgagtagctgggactacaggagtgcaccaccacacccggttaatttttgtatttttagtagacacgaggtttcatcgtgttggccaggccaggagttcgagactcctgacctcgtgatataccctcctcggcctcccatagtgcccatagtgctgggattacatgtgtgagccaccgcgcccagccgaatgtgtgtattttaagaaaagacatgggtttgttttttttcacctagaagtctagtgttgggggtgctcctgagaacaggacagcttcagaaatttattctcccatctcttgcctaaaatgggagtctgtgactgtacccccaagctacaggctaaacactatctctctgctaatatgaatacctctttacttgttttattctcattatttaccttctgatctcattacagccttgaaaatcctatgagaagaatacattccctacctgtaagttagttccttgtttattttgagctaatacctgttatctgttccttagctaccagcatgaccttgataggagacttaatttagagagtaaaaactgcttttctttagtctcttttgagacaaggtcttgctctgtcacccaggctggagtgcagtggcaaaatcttggctcactgcaacctctgcttccctggctcaagtgatcctcccacctcaacttccagaggagctgggactatatataggtgcacaccatcacacccggctgatttttgtattttttgtagacatgggggtctcactctgttgcccaggctggtttcaaactcctgcctcggcctcccaaagtgctaggattataggcaagagccactattcccagcctttccttagtctcataagtactcaagatgttcggtctggaggaatttgtcctccatctctaacagagctttattaaaccaggaagggttcttttgatgcaaatgttatttggggattgatttggcactgtaatccctgttgaggggggcactgtagaccttgtgaggttagctgtaaacccatggaatggaaacttctatgctgtgtcctggctgtgtcctggcaaggtggattcctggccacatttactggttacctactgcagtgtgtgaggagctagtctaccccctattcaaccccccttttttttcttttgagaactgaattttccactgaaattttatttgtgtgccttaattattttccttttttactttgatagcagaagctgttgggatgtagtccagctctgaagaggagccattctgattctcttgaccatgacatctttcagctcatcgacccagatgagaacaaggaaaatgtgagtgtgacttcaatgtactaacctgaggcagaggtgaaacccacaggctgtcagtggcttagaagtggctgggctgctttctgggagactaaacttggccattatgtgcggtctttggagtcagagaattctgggtttggatcctgcttactagctgtgtgatgttggcaaattcttctctttttaatctttgctcttttgtaaaataggagtagtaataccttttagggatgttgtggcaataagtaagattatgtatgaagtattgaaaatggtgcctgacaggcgggagttgctcagattgtagctcacaggagtaattacatgtacaaatagtgtttgtctggaaggctctgcccaggctgtccttgcctctttgctctgaccctgaaatgaattgtaagcttaggaaaaggctctttggcagtatttgtaagaacggggtcaacaagttctagggaatctcagagtaactgaaatggtggcttggaaggtgaatttctggttatctaccctgaatgagcctggcttttttgttcttttagacattgcacagagtaggcatccaaaacagttgtaattttttcagccttctctctactgtatttctatatatttactttctccccttttccattcctgctgaaatgccacagttcataatccttgtccttacaatcttcaggtttagtgtgaaacccactgcctccatgaactctcctgatgatttctttatcaacctgggaagtgtcatgagaaagaatatggaaatgagttccagccttgagtgcttggaacagtgtatcagcctctagtgctttttaccagggcaaagctgtactgatgcctggttttcccccgaaatagcttctcagggttgcttgcctggagctttgttttaaagggaaaacagcatagatggtggttaaagagctctcactctggagttgtcctgttttacttcaatattttgggcacattccttaacctgcaaggtctagttttctcacctgtaaaatcgggacaatcaggttgtatttgatggttaaaaagttaatgcacagaaagtacttagtactgtgttggcatagaaatcactgtaatattagccattactgctttttttttttttttgattcttcatggttttatttctctcagaactttaaaatgtgaacattctataattcagccagtctttacttccaggtaacttctttattgggtcgcaatacccttttaaataacatgctcttgttccggaaggtagttagccgttcatcactctttctgtctaaataacatccagtgacaaatcccatagggacaagaacatgaacccagtggtcccgcacaatctgaagtaagttcaccatgatagctgcagcctcagtgccgaccgcgaccccgagaccaagggcaacggggaactcagccacccacgccagtgctagccattactgcttttaatacttaattatgagttcttaagtgaatattttagggcaagggacctgtgagtgttttcattccataaagtggaatcatacgatatgtattctatcatatctggctttaaaaaacattatgcttgtaagaatcgtccacgttgagtaaaccagtagggcttttttttttttcattgcttttagtatagaatagaataattataagtagaaaaaattatctccagttggtaggaagaggtggaaaatatgaagccctgaaacagatggacctagatggaaaattttgacaactattcacaggcaattatattagattttatttatttttgctttagatttcagaaagtttgtgatttagcttattcatcgtgttttgtatatttggcagatacttgtgttaggaaatacagtatgacaagaaaaagatgttactttagaagttagctgttgacagagccttggaaattcttagttacgcagatctattgttggaattaggtgaaactttaatttggaggcagaaaggtgatcagtgcccactttcttgcctctttcacccaagctgaggcctgagttggttttcatggacagtagatgtctcaactatgtcttgcaggaagcctttgagtttaagaagccagtaagacctgtatctcgtggctgcctgcactctcatggactccaggagggtaaagatctcttcacacagaggcagaactctgccccagctcggatggtatgtgctctggctttcataggggaattcctgacaggaagaaaggattaaaacaccttctttcatccagaattgaaggcactacagtagcactagctgtttttaccttgactttgtcttttgaaattagactgtcaagcattcttggtggttttgctgtgtctggagaacagacaggcggtagtaagagtgggagatggtgtttgaaatattggagttgtgcaaggaataatcgaccttgttaatctgggaaatcctgggtcatcctaaatgtatgtatggtgggattatatctcttcctatttttttctttttttctttttttttttttaagggctttctggcaaaaaccggaaagcctgcgagacaaattttaaaagagccgtaacactagatctcttacttaaaacttggtctttactatgcattctaagtgcttctcaaggaactggagagagagcacttgacttcttccaaaggtggtttgttaagaacagttatgggccaggtgccatggctcatgcctataatctcagcactttggaaaactgagacaggaggatcgcttgagtcctgggcagcatagtgagaccacatctctattttttttatttttaatttttttaaagaactattatggattacagtgaatgctcaggctgctgggcagttttggggtcactcgtttcagggctatgtatttgccagacagggactgtcattacttccaaagtttcctgctgttggtctgaattggattaactgatagcatctatagattggagaggcccaacttgagcaagatgaccacatttggcttccaggtttacctaggatcttaaatctgaaaatatacctttccaatctgctttgtgttctgaggttcagccagtattgttactctgtctatcatttgcacaaagcacttttatatgttcttgtcttgtgaagtggagttaatccacttgaacagattaggaaagtaccactagagaggtttggatgatttaccaaaggatatacataagtaggaaaccaggatttaatgatctctggctgggtgtggtggctcatggctgtaatcccagcactttgggaggctgaggtgggaggatcacatgaggtcaggagttcaagacagcctgggtaacatagtgagaccctatctgtacaaagttaaaaaataagctgagtgtggtggcttgttcctatagtcccaattagtcgggaggctgaagtgggaggattgcttgagcccaagaattcgaggctgcagtgagctatgatcagaccactgtactccagcctggacaatgaatccctgtctcaataaacaatctctaaattcccaagtacacagtaatgctttaagagttgggtatcagaaacaatatatttggtgtgtgcttagcgactagagcctgtatcacatctgcacctaggaatcccagaacatacctcacaaatgttggtgtgatatagtgtgagctttcgtgataaaggtactgccccataataaagttatctacccctaggctaaaaaaatttgccatttcccagagtgtgcacttggggaggactagagactgctcagaacttgttttatattgtgaagcaaagctaatgccagaaccagaataggccagctgcagagaggattccttggtgcatgatccactcagaaaatcagagggccacttaactaacaacagattcataccccaaagagatttggattttaaggattacttgtaggtcataacattgggactaccctgctactgtgaaaaaaataactctaaacttttttttctggatttgaaagtgcctagaaaataaataattcagtattagcagtgtttgtattggtaggatttatcttcaggtgtggatttatgagcagtttttctaaattttctatattccatgtttagaggtttcccaaaaaaagtatgactataggttggctaatgaggtaccgccattttaattccaggaatggttttctcctagggagatagtgtggtgagaagagtttggattttggagtcaaacagatgaggtgtataatcttggtaacctcttaagcaccagtttcctgatttgctaaagaaaaaggaaaggattagctacctttagtgtattgtgaggcttctattggattatatgtataaagattatatcgtagtatctggcacacagtaattcctcgtttaaaaactgagcatttaaatcccaagtctaaagaacgaggatagattttatagaaggaagttaccctttattcccccctgtcagaactggagttatatataagtgcattctctaggccattttatggtctttatagagatttgcatctgcttgccctaactcatttcagcagattctcatactgtcacagtcctcaatgctgatcggtgttcactgatgcaaccttctaataaaagaaaccttgttcttcacaagaggctatctctagtacccattataaggtgaattgcttctggcaagagttctctgtaaaggctactgactactcagggctgtgtgtggtcatcaaatcatttataatcttgggatacattttcatataatcagtaatggctaaaattttgctttgtataacaagtataacatagtatgttttcatcataaaaactagtgacccattcaaggaaatgaaagtggatcagagctctcattattaatccatgaattttgtcttacagctttcctcaaatgaaagagatagcagtgaaccagggaatttcattcctctttttacaccccagtcacctgtgacagccactttgtctgatgaggatgatggcttcgtggaccttctcgatggagagaatctgaaggtaccgtgtgtgtgtgtgtgttcctatttgttctactaattaattacctctggagaaggcatgtgatgtgaaaaagaacagcaacagcagttccccggggcttgcttagctgatatttttgttcatttggtgataattcatttaataatagggctaccagccttattaaatcctttggattgggggatgggggcatcaaaagaagacacatgatccttcttaccctgaaggagctaactaacaatctatatgcaagaaacatgaaatcagaacggtataggatggtacattaaggatacttcctatccaggcctatctggtattgttcagggagaaacacacctaaagcacttaaacaaatgttagtctctacaggctctttttaaaatcagtttttctgtttctttagaatgaggaggagaccccctcgtgcatggcaagcctctggacagctcctctcgtcatgagaactacaaaccttgtgagttgttctagtgtgtctggaggaagccctgcgtgattggggcactggacagagtagtccttagttgagtatagccaaagattgaaatgcatgataggatttggggatctgggttttaggcctcactttggctacctacaaattatgacctttagtcatgatatctctctgcatgtctcctgatgtataaggagtgtgggttaggagggaccatggtcattcctagcttttaccatctagtcagtttgaaaaaagcctatctgaagcctttagcctgaatactttactttttttaggttattctcatttatattccacagaacctagcataaaattagacaagcaacagtaactcacaggattttttttgtttctgtgttttttgtttttttttttgagacggagtctcgctcttgttgcccattctagagtgcagtggcacaatcttggctcactgcaacctctgcctcccaggttcaagtgattctcctgcctcagcctcccgagtagctgggattacaggtgcctgccaccacacccagctaatctttgtattttcagtagagacggggttacattatgttggccaggctagtctcgatctcctgacctcaggtgatctgcccacctcgacctcccaaagtgctgggattacaggcatgagccactgtgcctggctggatgttttttgttgctgttttgtttgtttgttttgttttgttttgtttttcattgaaaatacctacctgaggctgggtattttcaggtagatattttcgattttaaaaattatatataatatatattttatatatatatatatatatatatactcacacacacacatacacagtatagatttgtgtttccatcagggatactttcaaacagaaagcatagtatatgtagatacagaatctatagtgtatgtgtgtatatatattcaaaatcacatatatatacacacacatacacatgctatagattcgtgttttcatcatagggatactttcaaagttagaagcaagaatgtgcctatacagatatatacacctgtatgttcagagatatacacccttaggtacacatctaaattgataagttcatattttttaattctcaataacctgaactataattacagaacaaatgagctacagtttttttgtttgtttgttttgttttgtttttgagacggagtctccctctgttgcccaggctggggtgcagtgcagtggtgtagtcttgacttgctgcaacctctgcctcctgggttcaagtgcttcttctggctcagccttctgagtagctgggactacaggcttacgccaccactcccggctaatttttttggtatttttagtagagacgaggtttcactatgttggccaggctggtctcgaactcttgacctcaggtgatccatccacctgcctcccaaagtgctgggattacaggcatgagccaccgtgcccagccaagctacagttttgagatcacttatggattatagtacattcatgtgcatagcttttgagaaaatatgttaacgcagtacaaatgttatgagtaaatttaccaggtcattttgataggcataaaattacataaaatgtgagaacactttggaagtggctgttagttttatagatttgattttagagtcataagcatgggcttgtaagctcttaatagtggggaaatgtcttccacaaatggttattacaaactaaccattgctgggagctgtaatggaaaataaacttcacacaaaagaggaagaaaatccccggtctctatgggagcagatgtgggagtgatccattctactggggactatcaggaagatttcaaagaagtgacattgaaatgttagcatcaacttgaaaatgaatggtttactgagatgtgaaaggacattctgtgcagaaggaaaagccaggccaagacacatggagtcgagaataggctgagatgcgtttagagagctgactcttgctaccactggtcagattggcttcccttgggctctggaaaatttgtctttatttatttatttatttattgagacagagtcttgctctgtcacccaggctggagtgcagtggtgcaaatcttagctcactgcaaccaccacctcctggtttcaagtgattctcgtgcctcagcctcctgggtagctgggattaaaggcacgcaccaccacacctggctaatttttttgtatttttaatagagatggggtttcttcatgttggccaggctgttattgaacttgtgacctcaagtgatcccacagtgttgggattacaggcgtgagccaccgcgcccagcctgggaaattagtctttaaaagaccaagtagaaaaaaagactttgaacacaattttgaaaggcatttgctactctgcccatccccactccctccaaatttaccatcttaactataccttaaccaaagatgcccccatttttattataacctggctactgtgcatcttttctggatttaagtggggtatttaaacccgttgacctgcttaattaagcaaggtgcaagtaataaaatggaggggaagataggcaagccaaaaatgtgttcctgactggaaggtcacacttctcttgacgcaggattatgtagacagtttttgtgagggcaaaggacgttttgctcatctctatataatgtcagctgagtatatattcattgagcactaagtgctcagtgcctactatgtgccaggccctgtgagagttgctaggactagatgaatcggcagtgtctgttggctaatttagaattgatcttagatcatcccaggaaaccttcggtttatttgtcttaccattcaagtgaacaggttttaatgaaagatgggtctgtctgttttttttcctgtaaggacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgaggttagtttcctaggttcctttttgctctagcacagatactgtatttttcagttctaaaaatttctacttagtggttcatttattttctttgctaagatttgctggggttttgtggggttgtgtgtgtgtgtgggtgtgtgtgtgtttcttttaatagagatgggatctagcgatgttgcccacgctggtcctgaactcctagcctcaagtgatcctcctgccttggcctcccaaagcactgggattacaagtgtgagccaccacacctggctgatacttggctgttttcatgttggtttttcatttgctttgagtatgttcataattgcctgttgaagcatttttaagatggctgctttaaaatctttgtaagacaaatccaacatccatccatagtgttgttggcatctgttgattgtcttttcctgttcaagttgggatttttctggttcttggtatgaccggtgattcttccattgtctcctgtatatttgtgagtctccggtctatgtaaattttacgttttagcaggcttcctctgatactgcaagaaaggcatgggtggaagtccgggttccccagcacaaactccattgacaccttgggtggggacttgtctcattattgctgggagggagtggaagttcattccatccccgtggggtggtgactggggcactgtatgacagctgggcaaaggtggaggcccccgcttgctgttggccataattgtttctgtgttgactagtagaatgattattgtctaaaagtcttctgcctcaataggccatcctttgcctagggagagcaggcttttcttggggcttgttgtgttgctgtctccagcttcatgagttgaatggttaactcattcgtttttaattttcttatttctggataaatctatttgaatctatgaatttcccactgctttagatttgtctcataacttttgacctgaaatgtttttattatcatttgttgtagatattttatttccttttaatccagacctatcatggcctattaaatacttgatttttataaaggtctgtcttttttttttttttttttgagacgctctgtcgcccaggctggagtgcagtggcgcgatctcagctcactgcaagctctgcctcccgggttcatgccattctcctgcttcagcctcccagtagctgggactacaggaccccgccaccacgcctggctaattttttgtatttttagtagagacggggtttcacagtgttagctaggatggtctccatctcctgaccttgtgatccgcccgcctcagcctcctaaagtgctggaattacaggcgtgagccactgcgcccagccctgtctgtctaattcttcaagttaattcattgcattgctcatagttgtataggctgttttgttgtttcctgtttctgagacagggtctctctgtcacccaggctggagtgcagtggcatgatctccgctcactgcactctccacctcccaggctcaagcagtcctcccacctcaggctctcaagcagctgggactataggtgtgtgccaccaaacccagctaatttttgtattttttgtagagacaggctttcgccatgttgcgcaggctggtctcaaactcctgggctcagggcaatcctcccgccttggcctcccaaagtgccaggatcataggtgttagacacagcacctggcatgggtgagctagtgtcatggttgtctgggcctaagtcctatggtcctttgtgttattttttctatttattctgtggctagacacacaaaacactggtttatttgtatgtttttccttcattatactgtccttatattgaggtttggtattaagcattataaaatggtgaactacctgtgttttctgtggcatgaaaaggtttaagtaaatctcatcacagtcttaaaaggttagagagatgacagctaggaaaacatttagcatttaggcctactgccttatcgtatctgcttttgtttttaatgctttatgaatgtttttaaagtattgttctaaaagaatattttaataattgcatagtatttttgttttgggagagttgtttggttttggtttttgttctttttgtttgtggggggcacagggtctagcgctgtcactcaggctggagtgcactagcacgatcacagctcagtacagcctccatgggctcaagcactcctcccgcctcagcccccctagcagctgggactacaggcatgcaccaccatgcccagttaatttaaaaaaaatttttttttattttttgtagaaaagaggtcttactgtgttgcccaggctggccttgaattcctgggctcaagcagtcctcccacctcagcctccaaagtatctgggactacaggcacaggccagtgcacctggccgatagtgttttgacttacaagtatactagaaataattgaataaatcaccttctggacatttagaatttcccttcccctgattttccttttatttctaattaaaaatgaaattctgggttataagggcaagaacatttgtgaaactttacattgtatacatgtcagaaaatatctatcaatatttaataatattctggctgagtgctgtggttcactcctgtaatcccagcactttgggaggacaaggcgggtggatcacgaggtcaggagttccataccagcctggccaatatggtgaaaccctgtctctactgaaaatacaaaaaatagctgggtgtggtggtatgagcctgtaatcccagctgctcaggaggctgaggcaggagaatcgcttgaacccgggaaatggaggttgcagtgagcagagatcacgccactgcactccagcctgggtgatagagtgagatttcatctcaaaaaaaaaaaaaaaannnnnnnnnnnnnnnnnnnnttttgagatggagtctcactctgtcgcccaggctggagtgcaatggtgtgatcttggctcactccacccaccccctccgggttcaagtgattctcctgccttagcttcccaagtagctgggattacaagcgcctgccaccatacctggctaatttttgtgtttttactagagatggggttttgccattttttttttagatgggatttcgctttttgttgctcaagctggagtgcagtggcaggatcttggctcacggcaacctccgcctccccagttcaagcaagtctctgcctcagcctcctgagtagctgggattacaggtgcccactgccacgcctggctaattttttttgtatttttagtagaggcggagtttcaccaagttggccaggctggtcttgaactcctgacctcaggtgatatatccgccttggcctcccaaagtgctggggttacaggtgtgagccactgtgcccggccagaatattcattttcttttaccgtaatagagattgacctttttatttccatatttgtaaaactttttttggataaaataatactgttaataattattttgtatatatattggccctcatgttttggtttattttcatatattttaatttttagtattttaaattccattgtggagaaaatgtcaagcattgctagagtacagttatcatacctgtgatattgtgaaatatatatttagtcttcttccccttctgtcatataactcctaaaatctttggaatatccaaggtcatatctttttgtatactaatgattgatagcttcagggtgggactggtcactggaaagacagagacatgattagaggttggaactttcagccccaccctccaatgtctacggaaaggagaggggctaaaggtcaagttgatcactcatggccaatggtttaatcaatcatttctatgtaatgaagcctccctaaaaccttgaaaggacagggttcagagagcttctggatagctgaacacatggaggttcctggaggttggggcacccaaggagagcatggcagctccatgtcccttctcccatacctcaccctatgcatgtcttcttctatatcctttgaatatccttcataataaactggtaaatgtgttttcttgagttctgtgagccacttctagcaaattaaacccaaagaaggggtcatgggaacccctacttaaagctggtggtcgtagatcagaagatccagaggcccaactggtgtctgaagggtggtgtggttttgaggactgggccctcaacttcctgatctgacgctctgcaggtagatagtgtcagaattgaattggacggcacccagctattttccactgcagaactgcttgcttgcttgcttgcttgctggtagggagaaatcccctcatatctgggggtaacagcacttctgtcttctgttgctgttgagtgagggaataagaaaaatcactttgagtttgtggggtgttttcctcacacaaacatatcatacagggctaaatttctgggtgtttttttgtttgtttttttttttgagaccaagtctcgctctgtcgcccagactggagtgccatgggtcgatctctgctcactgcaacctccgcctctcaggttccagcaattctcccgcctcagcctcccaagtagctgggactacaggcgcccaccaccacgcctggctaattttttatatttttagtagagacggggtttcaccatgttggcaaggctggtctcgaacccctgacatcaagtgatccactcacctcggcctcccaaagtgctgggattacaggcatgagccaccacgcccggcagagctaaatttcttactatcaaatgtcaaatatccagtctgggttcagttttccccagttgtctcctaagtacttttacagtttatttgttaaaatctggatccaaataaagtctatacactgtagttggtcaataggtctcttactcttcagatttcagtgctccatctgtttccctcttgcatatttttatttgttgaagagctcaagtcatttgtcctgcaaaggttcccacagtcctgtggggtcttcagacattgtcttctatcccctatattgccttaacctaactctggaaaggatggattgaattccagttctatttgtttggcaagaatatcacataggtgattttgtctactttgatcaggaagtataatgtgccaggcagccattggtgattgctgcccagattttttacttcatttcaccagggtttcagaaagatgatactgcagtttttacattctttcctcattaattagctagaatatatctataaagagaaacttacactcatcaaacactgtggttacccttgggaaaggcaggatgaatattggatctctttatttgccagtttccaaataatgccctaccaagcatcttccaaagttgaaagcaagacttatagttgtttttcaataataatcaggaattcatgggttaaaacatttaatgtgtttctgtgtattacaagtattatccttttactcaaattatcccctttttaacagctggcttcctcttctcattgaataaagctaagacgtaggccgggcgcggtggctcacacctgtaatcccagcactttgggaggccaaggcaggcagatcacctgaggccaggagttcaagaccatctggccaacatggtgaaaccccgtctctactaaaaatacaaaaattagctgggcgtggtggcgcacacctatagtctcagctgctctggaggctgcggcagaatcgcttgaacctgggaggcagaggttacagtgagccaagatcactgtactccagcctgcactccactcctgtactccactgcactccagcctgagcgacagagcgagactctgtctttttaaaaaaaaaaaaaaaaaaaagttaagacatactttttctaaacttaatcctagttttaaccccccttgtttctttctctttttctggagatagtttcagtctgtcacccaggctggagtgcagtggcaccatcaccacttgctgtagcctcgacctccccaggctcaggtgatcctcccacttcagcctcccaagtagctgggactacaggcacacaccaccatgcccagcttgtgtgtgtgtgtgtgtgtgtgtgtgtgtgtgtgtgtgtgtgtgtggacagggtcttgctctttgatctggtctggaactcctgggctcaagcgattcacctgccttgcccaggctggtctggaactcctgggctcaagtgagtaacccaccttggcctcccaaagtgctgggattacaggcatgagccaaaccacctgcacccccttttttttttttttttttttaaggaaggaaggaaaacttagtttcagagcaattcggttagacactggaataataggagacctagtcaataacccacatctgtttttgttcactccagattcaataaaataaaataaaaacttcttactaaatgtaggcattaacattttagtctcctcgagacatgctccaagtgaatgttttcagaagttccattcagaacccttgtctcattctctacctttgatttgttacagactcttcatcagtctttatccctggcatcttcccccaaaggaaccattgagaacattttggacaatgacccaagggaccttataggagacttctccaaggtaattgcaagcagagctgctctggcaagtgtaggagggagtgtgggtatttagaatcccactcagcctgtctccctccccagggtggttcctggcatacctccaaaaggacacagttaaaagaatgttaaaggtagggaagcaaacttagtttctcatgatcaggtatatgttggtttctgagactgtagatatcactatagctgatgggcagttttaggtagggagctgtccaccaaccaccttgattgtaacccaaagactaggctctctgggaactgtgttattataaaaatagtaattagcaggatagtgtacagcagaaataaatctgtagccacactacaagtctgcatgttgaaaggttatcttagaaggtctgggattgagactgaatttctccgttcagagaagcttggccattgagggaaaagaccctccaggaagtctagaggaagatcttctaatagcctgatatactacatgaaggcttggctgcagtaaaatacaaggctaggacagggaatgtgtcaatagcagcttctttaatcacattttgacttgaaggttaccagatcaatgttttattcattaatttagttaacatttattgaagcacttatgtgttaggcagagattccaaaatgagatacagttccttccctcaaagaatttagcatgtggttggagaggtgagacgtgaactacatgtaccacatggtagactgaaataaattttagtgaggtgtaaacataaacagcatgccgtgagaagtaaaagggtttatcttggctagggggttggggaacgtctggggttgggccgttgatatttcagcccaaatgggttttgaaggaacggagaatgaagagaacaagcaaagatccagctgtatcctcagttttggaaccttctcttgtttggcagggagagatgtggtcttactatgttgctcaggctgtagtgcagtggctattcgcacatgctatcatagtacactgtagcctcaaacttatggcctcaagtgctccccctgcctcagcctcccaagtagctgggactacaggcatgcaccaccacactcagtggaattttcaacttgaattgaggcctggttatatttgtcttaatgggcctatgcatggggatagatgaactcttggctcagccagtcaccctaatgagtaattgctaatgtgtgcatcttcctcctcaaggctgggctaggtctctttttttcctatccccagtgcctggcaccatgctggacatagcaggtgctcagtaaatgagtgaaatctgtatgtttaagtgctattcgcagtctaactactgacgtgtggattcttgacaaaagcaggaggaaaatgagattacctgaggtttctttatttaaatctgccttactagctaggtaaccttggataaggtgctcaaaatggggataatatacctcattggtttgtgtgaaaattaaatgtcaggatgttaatgaagtaactagaagagtaactagtgtgtactaactaatgtttgtttgcttgtttgtttgtttgttttttgagagggagtcttgctctgtcacccaggctggagtgcagtggtgcaatctcagctcactgcaacctccgcctcctggattcaagcgattttcccactccagccttccgagtagctgggactataggtgcatgctaacgcccggctaatttttgtatttttaaaagagttggggtttcaccatgttggccaggcttgtctcgaactcctgacctcaggtgatccactagcctcggcctcccaaagtgctgggattacaggtgtgagccaccgtgcctggccattaatgtttgttttttaaaagatgcctcctaccagccagacaaaacagtataagtgtgaataatatataggctttcagattctctaagtatctttttttctttttaagggttatctctttcatacagttgctgggaaacatcaggatttaaaatacatctctccagaaattgtaagtccatccttttgaaacccaccacacatcgggtacttgaatctagttttccctgacggtcaaagttgattctccctaattttctctcaacagatggcatctgttttgaatggcaagtttgccaacctcattaaagagtttgttatcatcgactgtcgatacccatatgaatacgagggaggccacatcaaggtatggattcctgagacttgctgtagaaggagccctaaacaggatctgtggttttaaagtggggaggacagtgacacctggccacttagctcatatgctagttgttagaattttgaaacaatacagtgagtgtggaaggcatttgattccgggtgctcttaacgaatgttcccttgtctgcaatactctctaccaccttgtgctacagttattcttcatgtttgtccctcacaccatcattatcaaggacacttgtaggaggtacccactgatgtttaagtcattcgggggacaagaatgggtttcatagcatttaagaggcttgggtaccaatgtctgagcaccccagggctcctgatgaggagaagaccatctctggcaacatgtcctggtgtctgtgccaggcttagtgatgcctccaaagttgattgttcagcaagctgcctggtggaggggcgtgttgggacacacgttcccaagaagaaaggaactgattttgccattttaatcttttttttttttttttttttgagacagagtccgctctgtcgccaggctggagtgcagtggcatgatctcggatcaccacaacctctgcctcctgggttcaagcaattctcctgcctcagccttccaagtagctgggactacaggtgcacgctgccacgcccggctaatttttttttttttttagtagagacggggtttcaccatgttgcccgggctggtctcaaactcctgagctcaggcaaaccgcccgcctcagcctcccaaagtgctaggattacaggcatgagccacggcgcctggcctgccattttaatgttttacccgattaatagtgtttaaatatagtaaggaggtactttaaatacgatgttactgtttgccattgtcttgtggcttttgaaaatccccaaatttataaaactacctataaagtgtaccattgtcatatttgaattgcccatttccagtccccatgtgcattactgtatgatgaacgtgtacggacccacaaagctccattgagatacaggtgccaaatggtctactgggctattcagctagaagaactgcaaaaatcacaaactggtcttgtggacttaaagatcactcttgatgaatcattacatcttgctgaatcattacttcatgtgtgaaacgtgcaggttccaagggtctctgttgtcttcacagggtgcagtgaacttgcacatggaagaagaggttgaagacttcttattgaagaagcccattgtacctactgatggcaagcgtgtcattgttgtgtttcactgcgagttttcttctgagagaggtccccgcatgtgagtgctgcacggaactgggttctggggcacaggctccatgatgcttttgtgggacatggtggtttgtggcttgcacttggagcatattttagcatatcaagcaacctctggcacataacaagccattttcatatgtaattttatcctgaggtgaactttggctcttccagtctccccgactgtccttagtctgatctgtggggctactgttctcatgtgacctccttcaagtacaaagtgaccgttccttatgcaaatgccagaaaagtgtgaagttctcattctgtaaaacctcatatgatatgatgctttgaaacacttgatattattaccaatttcagggtgaaaagaaaaaagggggccaaagagctgcccatcagtcatctgtgtccattctaaaaggattgcaagcctgctgtttgtcaggcactgacaataaaaatgtaactacagtaaaacacagtacagtaaaaataccacagcgagcaggaccaacaaggaccctactgcagcagagatccaagtggggatccgtataaatgctaggaggacaggcagagaggtaggacagagagtgcagcttaactaggatggtccaagggagacttctgcaggaccacgttcttatgccacctttttattttgaaccaatttattttaaaaaacatttttaaattaaaaaatttcaattttttttttttgacggagttttgctcttgttgcccaggctggagtgcagtggcacaatctcttctcactgcaacctctgcctcccaggttcaagcagttctcctgcctcagcctcccaagtagctgggattacaggcatgcgccatcacgcccggctaattttgtatttttagtagaggcagggtttctacatgttggtcaggctggtcttgaactcccgaccttaggtgatccgcctgcctcagcctcccaaagtagtgggattacaggcgtgagccactgcacctggctttttctttctttctttctttcttttttttttttttttttgaggcagaggcacactgttttcacccagactggaatgcagtggcatgatctcggctcactgcaacctccacctcctgggttcaagcgattctcctgcctcagcctcctgagtagctgggataacaggcgtgcaccaccacacccggctaatttttgtatttgtagtagagatgggggtttcaccatgttggccgggctggtcttgaactcctgacctcaggtgatccacccgccttgacctcccaaagtgctgggattacaggtgtgagccaccacgcccagcagaaatttcaaattttgagatggggtcttaatatattggccaggttggtctcaaactcctggcctcaagcaatcctctctccttggcctccaaagtgctaggattgcaggcatgagccactgtgcccacccctttgaacctttttttttttttgagacggagtctcgctctgtcacccaggctggagtgcagtggcacaatctcgacttactgcaagctccgcctcctgggttcatgccattctcctgcctcagcctcccgagtagctgggactacaggtgcccaccatcacgcctggctaatttttttgtatttttagtagagacagggtttcaccattttagccaggatggtctccatctcctgaccttgcgatctgcccgtctcggcctcccaaagtgcttggattacaggcgtgagccactgcgcctgacctgaaccattttaaagctcaagaagaggtgaggttatggctgggcacagtggcacctgtaatcccaacactttgggaggccgaggcaggaggatcacttgctcgggagtttcagaccagaccaacctgggtaacacagtgggaccacacctctacaaaaaataggaggtgggaggatcgtttgagcccagcaggtcgaggctgtggtgagccatgatcatgccactgtactccagcctaggtgacagagtgagattctgtctctctctcacacacacacacacacacacacacacacacacaaaggttatacttgcacacacttcacctgattttattaatttttaacattttgtcacatttgtatgtacatgctctacacacaggcaactacagtacaacttgacacttttgactgtcatctcataagtccttcaaacatctgtctccaaaggatgctcattcatgaatggaattattcactcagcagtttttttgtttgtttgtttgagatgtagtcttgctctgccacccagactggagtgcagtggtgcgatctcggatcactgcaacctccacctcccgggttcaagcaattctcctgcctcaggctcccaagtagctgggactacgggtgcatgccaccatgccaagctaatgtttgtatttttagtagagacggggttttgctacattggccaggctggtctcgaactcctgacctcaagtgatctacccgcctcagcctcccaaagtgctgggattataggcctgaaacaaactaatctggacacacatacacacacatgtaaattgtttttaaacccacaaaagatgctgctctcttttttttttatttttgagtcagggtcagtctctgttgtccaggctggagtacagtggcaggagcacagctcactgtagcctctgcctcccaggctcaagtgattctcccacctcagcctcccaggaagctaggaccacaaacatgcatcaccatgcctggctaatttttgtattttttatagagacagggtctcactgtgttgcccaggctggtctcaaactcctgggctcaggcaatcctggcctcccaaagtgcttggattacaggtgtgagccgccatgcccagcccaaaagatgctattctcttaatctctcatttccccatcttcctctttaacacctctaatataaaggacattattataccatattgaaacttcacctagatatacagaaaacgccccatctctgtattctgtatttgcaagctgcatgtttatatcaccatctacagataccccttacacttcgttccccacttgagtttcgccatcactggctttctgttgttccactggggaaagatttgggattcacaggtgaactcttttttttttttttttttttttttgagttggaatctcgccctttcgcccaggctggaatgcagtggcacaatctcggctcactgcagcctcctcctcccgggttcaagcatttctctgcctcagcctcccaagtagctgggattacaggcacctgccaccacgcccagctaattttttgtagttttagtagacacagggtttcactatcttggccaggctggtctcgaactcctgacctcgtgatccaccgcctcagcctcccaaagtgctggaattacaggtgtgagccaccgcgcccagccaaactccttttaaccacaggcaaatggtttaagctacgtgctgcagaggaagctgctgcccatccctcatgagcagctaacaaaggccccaaaccactgagcttcaagagaaaatcagcagatactcttggctcttgtgtaccagatacctttctagatactgagggagaagagcagtgaacaaaacagaccaaaaaatctctgccttcatggaacttacatttcggagtggacaggagatcgagaccagcctggccaacatggtgaaatcccgtctctactaaaaatacaaaaattagccaggcgtggtggcggacacctgtaatcccagctactttggaggctgaggcaggagcatcccttgaacccaggaggcagaggttgcagtgagccgagatcgcgccagtgcactccagcctgggcgacagagtgagactccatctcaaaaaaaaaaaaaaaaggtgactgggtgcggtggctaactcctgtaatcccaacactttgggaggccaaggcaggtggatcacaaggtcaagaggtcgagaccatcctggccaacatggtgaagccccatctctactaaacatacaaaaatcagctgggcggtggcacgcgcctgtagtcccagctatttgggaggctgaggcaggagaattgcttgaacccgggagacggagattgcagtgagcctgaggtcacgcccttgcactccagcctggtgacagagtgagattctgtctcagaaaaaagaaggtgcttcagaggaaaataaggccagtggtggagctcccaggcaggctggaggaacagtagtggggctgcaggggctggcgtggggtgaacaaggggcagagcagcagtaggggcctgtagagctgtaggcctctgaaggacttggggcctcgggctttttcaccaagggcgaggcagtaagcagccattggctggatattgaagaccattcagtccaagtagaggatagaaacagggccccgaggcaggagcaagttcagcctctttaaaagccacagaaagaaacaagcccacttatgtagaaggaggtgagtgagggagcctggctgaagagaaggctggggtggagaaagcaaggggaagctggctcatatagtgaaaacttgccacaaactgtggtggtgaaggtgctgggcaggactcagatgctaggattgttggagaaaggaaaattggggaagagaccatctactggcactggctgtgagtgctgctcatgtggccaggaacttgcaactcagcactgattgtttctaagaataaatgtcaagttgggaagatgtgtataagggggacttagaccacaactgctgctttgactgcgttgccttgttgctgtgctggaaaagctaaccctgctttggccttccttcccctgactaggtgccggtatgtgagagagagagatcgcctgggtaatgaataccccaaactccactaccctgagctgtatgtcctgaaggggggatacaaggagttctttatgaaatgccaggtaagactggggttgtggagagcatctctcctcccctgcccccagtggtagactaatggatctgtctggtggtcatgactttctttccaggggtcgggggacaaggtgggtatctgctgaacccaaagaaagcccctgtagaactggctccctaggtctgcctggccgctttcagccttgtagccctaggcagagaggaaaccaggttgtgggtgtgaggcaggtgtaccctaaccttattctctcctgtcccctcagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaaggagaattacatttccctttaaggtcctgggaccacattaactaaaattagtgtttgggatggccacatttcctcaagaagctctgactccaaaaacttgtggttcagattgatttgcaagatgaaatgggtgcataaaaagtgtgcctgaggccagccgcagtggctcatgcttgtaatccccgcattttgggaggccgaggcaggcagatcacttgaggccaggaggtcaaggctgcagtgcccacacataatgtgatgctgggggctactggggacaaaatatattgggctgaagcacagagggacgcccagaatagaaaacacatggtcctttaggtatgggttggaaaaccaggggttcaggcatatttgattatattatatatacatatatttttctgagacagtctcactgttgcccaggctggagttgcagtggtgtgatctcggcttactccagcttcgaccttccaggctcaagcaatcctcccacctcagcctcccaaagtgctgggattacagatgtgagccaccatgctttttaaagtttactttgagcaagtaatatttccctggattgctgcaaagg

SEQ ID NO: 17556 - DNA, 74644 bp, Human
  misc_feature (1)...(74644): n = A,T,C or G
acaaaatgtgtgtgggggcagatagggggacaggaggaaatcagggacaggaatgatggggtacataggagaagtgtaagtaaggtacaatgcctgctctcagggagcctgggtttcctgggatggctgatttagctttgccagccaaaattggtttctccccttctctctcctctggccaaggtttgtaaacctggcctaaaacaatgtctaaaatcattgctcatgaaaatatagcctgaaggaaataaagtacccattttagatgctgaattaagagacgcatatatctgtatatttgaacccatccattagtgctacagaaacatgaataaatgtatttgtctttcaatattactgtcccaccaaaggatgtgggttggctcaaaagaataagtaaaagtagtgtcaaggcaaagtcaaaatgagaaatcagggtcaatgaagagagcatcaaatgttaagaagagaggttagcatttctacttaattattttattatatatttctctgtaaaaacctatcatgttataaactttttcagagtcaacaagaacctaccttcttttatttgccctttctaatgtcctttcatactggtcggtagatgggtttcttctacgacttacttaagagggaaggtgctcgctgcccctacctttctaggcccatggcaccctaaaaagcgcaggcgtgggctcactcctaaccgtgccctacctagctgctgatttggggcaagttagtgaacctctctgcacatctgtttccccacctgaagatgataaaacacaaaaatgggattatttttacaacttaaatgggataacatagcaggccctgaatccattagtttgccaggggttccctaacaaaataccactgactgggtggatcgaagaagaatttcttttctcacagtcccgaaggctgcaagtccaaaatcaaagtgtccacagggttggttctcctggggcctctctcctgggcttgcagatggccaccttctccctgtgtcctcacatggtcttccctctgtgcacccacatgtctgggggccacatttccccttctttttatttatttatttttttgagactgggtctcactctgtcgcccaggctggagtgcagtgttgtaattgcggctcactgcaacctccgcctcccaggctcaagtcatcctcccacctcagcctctcgagtagctgggactaccaggcacgccaccatgcctggctaatttttgtatttttatagatacagggtttcggtatgttgcccaggctggtctcgaactccggggctcaagtgatcgaccctcctctgcctcccaaagtgctgggattataggcaaatttcatattatcagaaacatgtcagattggattagagcccagccatgtgaccccattttcttctaattacctctctaaaaagcctatctccaaatatggtcacatctgaggtcctgggggttagggcttcaacacatgaatttttggggacacaattcagcccgtgtcattaggaatcaaaagaaaccctttaaggcatctcttagtctcaaggaaaatgcacccctattttataaacaaatgcaaatcgctctgtccgagtgaatatgaacgcagagtcaggcttgcatgctggtgccctgggccgttctcctctgatagagacaggagcagtcgtcctaggccaggctgggggcagtccatgaggagaagctctcacaatacctggcgcagggaagtggtcagaaatgttagctgctgctgttacacaaaatagacccaccaatggcaaactcataccaacagctgaagtggtggtctcaggtgtcaaaaatattagttttctcctaagcaaaggagagtgaattttgccatttcagactcatattttaagaaaactatggacacaaaacaatatgtcttccaatagtgtaggtaccaatgccttcgctatgtttgggatttcatttggaccttctcttgaatttagggaagtgccagtgaagccaccctggtggccctgctggccgctcggaccaaagtgatccatcggctgcaggcagcgtccccagagctcacacaggccgctatcatggagaagctggtggcttactcatccgatcaggtgagtgtgttgtgggggtatcagccaagacttcaagacccgaatgtttggttttatgtcaaattcaaaccaaaccaaacagcatccttccaaatctaagaacagttcctcaggtatcactaaatagagacctgaactacagggaaggggtggattcttgggtgggaactggatagatcaagttaagaaggaaataaatgtgtggagacatcaccgcgactggctctgtcaccttttctaccagtgcggacttctgttgtgattatctggccttctgagcaccattgcagagaaactagatatggggatcaaagtcctcggccctaactgcagctttgttattctgtgatctcaggcccctgggtagcgtcaagcaggagacagtggcggtgggggctgcagggcaaaaggtggccggctttcatgagaattgcctttcctgagaatctctgagacaggatggatctgccacagtggtgatgcctcctggctggtttctttcctccaggtactgtttactgagcctggccaccaagctccccaaggctccacagtcaggggcagggcacagatttgagcctaggatttctaagtccacctctgggatctactttccagggtctcgccacttatccttgagttcaaacaaatgaaaaacttcataaatattgacccagcactttacccttgttagtgcctgatactttaaacttaaaagcaagattccacaggaacagaaacaactccaggaaaaaaggggtctcatgaaggtgcaggggagagggagcagtcaggagcagttctgcctcctgtgccgttaagagggaccttgtgtttgcaatgttggctgctctctgccgatccagggcctggtaataactgcatgcacacacctgtacaaatccaactctgctgtcttctttccaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttgtaagttcggcagcacttgtggctcctggccaataaggtgaaactccgtctctactaaaaatacaaaaaaaaattagccgggcatggtggcgcattcttgtaatcccagctactcgggaagctgaggcaggagaatggcgtgaacccgggaggcggaggttgcagtgagccgagatcgcgccgctgcactccagcctgtgtgacagagcaagactctgtctcaaaaaaaattaatctttgagaaacgctttttacctccatttttttttttgttttgtcaattcaagtcaattccacagtgtaatgtggaagaactgacatggctcaaagttagcacgcagagcaaggtgacagccaagacattttgaaggatgcaaaaagagtctgccagtggatcaaggtgtacctgccatcttatcccaaaagtcttatctttctccgttgcgttcatctccacaggccatacaggtttgttcctatatgtgtttactgcttccttcttcccaacagaatgtgcggggaggtaaggtccatttgaatccctgccttatccctagctcctgaaacagtgcctggcactgaacagaagctcgataaatatttgtcaaacaaataaagatttggaagaaagatcattcaggtagaaagaaagatctcccttaaaattcccacaaacaatttcagtacaatttgaatagattctatttaaataaggtgaatttctttgaacctatagtgtcaatattaagactcagaatactctgtctagggaaaaataaatctgtcaaaacacactcttttaggtttcaggaatgaaaacaatgcaggaaacatcacttaaaatgttaagatcgtattttacaaaaatttcaaaactcatgaaataaaaagacaaatgctggcaagaaccacttatagcatatgtcgtaaagtaaatcttaaaaagaaggcttacatatcagtaagcaaaaaggcaacattccagtgggaaaacatgcgaaatatatgaagtcggtttcatatataaccacaaaaaactaagaacacaaaaccgattctgatcctctaataaccaaagaaatgcaaattagttgccgagagaggtatgttatatctatgagtgtagatatgtctatttccacttttatatctgttaaattgtgtacatattttgaagcatattaatttggtgcatacacatttagaattgtcatatctccctggtgaatgatcgtttatcactaggagatgccctttatatctctagtaatgcattttgtcctgcagcctactttgtctgacattgctataattacatatgttttctattggctaatgtttgcatgatatagacattttccattctactttcaacctccctgttcatttatatttaagatgtatcctgtgaaagcagcattgattgttgctattttaaaaatttgtttttaaaatccagtgtgacgattgatatttattttgttcatttacactcaaggtagttattgatacatttaaatgttatctgctgtctatttgttttttatttggctcaactattatatgattgcttttctctatgttcttgcctcttcttggattaattatttcatattattccattttcttatctctgcattttcttatttccattcggcatcttttcttttagtctgtagaattccctttagaaatttttagtgtgaatttgatataatgaattatctcagttttgttaatctgaaagtgtctttactgtgccttcacttttggaagatattttttctgggtatagaattctagagtgtttggtagctagttttatttttggtactttgtataagtccattgaattctttcttccatgatttctgttgagatgtcagttgtaattttaatgttgtgatgatgaagaacatataaaaatatgacatttccttctgtgccgccaatggaggtgctgcttgctttttgtctttgttttactgtgatacaaggataattttctttttatttactcttcttggatttcacagaacttcctgaatctgtaatttggtgtctctcctcggttttggaaaattctaacctattatcttcccaaagtttgcctctcctcatttcctctctcctcccattctgggactctgattatgtatatgttaaatctttctgcagactgccatatatctcttatgcccttttacatgtctcactttctttttttttttaatctccatgcttcatcaacttatttacaatttaccaattaatctctttagctatgcctagctgataaatatgtcatgctcataattctaaacattaaaaaattttaacttattttattttattttatttttttgagacagagtctcactctatcacccaggttggagtgcagtgatgcaatcttggctcactgcaacatctgcctcccaggttcaagtaagtctcctacctcagcctcccaagtagctgggattacaggtgtgtaccaccacgcctggctaatttttgtatttctagtggagacggggtctcatcatgttggccaagctggtctcgaacccctgactgcaggtgatctgcctgcctcggccttccaaagtgctgggattacaggagtgagccactgtgcctggccaactttttattttgaaataatcatagattcatagaaaattacaaagttagcacaaagaaattctgcgtactaacccttcacccaatttcccctaattgttccaacttttataactatagtaccatatcaaagacaggagactgacactggttcattgtgtgtgtataggtctatgtcatttatcacaagtgttgattcatgcagccaccatgccaatgagaatactgaaatcctctagcaccacaaaggtctgcctctgctactccctgatagtcactctcaccttcctgatctcctaccatcatcaacccttggcaatcactgatatgttttctacctctacactcttgtcattttgagaatgttatataaatggaattatacaatatgtgacatttcaagatcagcttttctcactcagcataatggccttgagatccatccaagttgttgcatgtatcaatagtatgttccttttcgttgctgcaccacagagatttggtaccatgttatctatactacagtttgtttacccattcacctgttgaggggcattgtagttgtttccatattttggctattacaaataatgcatccaggaacattaatgtataggtgtttgggtggacatatgctttcatttctctgggataaatgcctaagagtgcaattaagggtcctatggtagttgttacatttaatttttttaacaaagaaactgacaaggtattttccagagtgactgtattattttacatttccattatcaatgcttgagaaaatcaggctctttatacatccttaccagcatttggtattgtcactattttttattttatccattttgatagatatgcattaatatgctatcatggtcctaatttgcagttccctgataactaatgaacatcttttcatgtgcttattcactatctatatgtcctcgtcaatgacatgtgtctttatgtcttttgcccattttctaattggatgatggattgattttttaaatgaataagcttaattttgttagagttgttttaggcttacagaaaaataagtaggaagaacatataccttcttatatcccaaccttcgtttcccccattattagcatcctgcagtagtgtgatacatttattaaaattgattcaccaatacataacatccataatttaccttaggggtcactatttctattgaattttctatatgttttaacaagtgtataatgacaagtatctaccatttcagtgttacacagaatagtttcactgccataaaaatcccctgtgctccacctgtttatccctctctccctccacttgaaccactggcagccactaatctttttggctgtctccatcatttgttcttttttagaatgtcatacagatagaatcatacaatatgtagcctttttagattgacttatttcactaacatgtatttaagtttcctccatgtctttttgtactagtttatttctttttattgttgaatgctgttttctgatatgaacacgccacaattcatttatgcatttatctattgaaggacatcttgtttgcttccaagttttgacagttattaatgaagtgctataagcatttgtgtgcaggtttttgtgtgtacataagttttcaactcatttgggtaaataccaaggatcacaattgctggatcgtatggtaagagtgtgcttaaagttttataaggaaaggctgaactgtgtttcaaagagactgtaccattttgcattcccacaatgaatgttagtgtaggtttttcaatatctttgtcagctgttaatttttttcagtgttttttattttatccattctaatagatgtgtagtggtatcttattgttattttacttgaaaattctgtaataacatatgatgttgagcattatttcatgtgcttatttgctacatgaacatcttctttggtaagatgtctgttcaggtcttttgcccactttttaattggattgtttcattattattgagttttaagagttctttgtgtattttgggtagcaatcctttatcaagatatatgttttgccaatgttttctgccagtctttagcttgtcatttcatcgtttaaacaatgtcttttgcagagcagaagttttaattacaatgaagtccagattatcaattacttctttcatggatcatgtttttggtgtggtctccaaaaattcatcatcaatcctaaggtcatctaggttttctcctatattatcttctcggaaatttatagttttgtactttaaaacattaaaatagatgtaggtctatgatctattttcagttaatttttgtgaaaggtgtaaggtctatgtctagattcattttttgcatgtagatgttgatatggtttggctctgtgtcccaacccgaatccatgtggaattgtaatcctcagtgttaggggaaggacctggtggaaggtgattggatcatggggatggatttctcccttgctgttctcatgatagtgagtgaattctcatgagatccggctgtttaaacagtgtgtagcacctctccctttgctctctcttgctggcaatatgaagatgtgcttgcttccccttcaccttctgccatgattgtaagtttccggaggcccccccagccatgcttcctgtatagccagtggaactatgaaccaatagttcctttctttgtaatggaacaataaacctcctttctttataaattacccagtctcaggaagttctttatagcaatgtgagaatggactaatgcagatgttcagttgttccagcaccttttgttgaatactacacttcctccattgaattgcttttgttcctttgtcaaagatcagttgacttcatttgtgcggatctatttctgttcaactcatttatttgtctcttcctttgccaataccatattgtcttgatttatagctttctactaagtcttgaatttgggtagtgtcatgtcagatctcaaacactgttgtttaatattatgttgactattctaggtcctttgcctcttcatataagcattagaatcagtttagcaaaatgcacaaaataactttctgggactttatataggattgcattgaatttacgcattttgttgaaataactgacatcttgatgatattgagacttcctatccatgtatgtgaaatatgcctacatttatttagatcttttaaaaaattttcttcattagagtattgtagttttcctcatataaagctcattctttttttttttctttttactttttttggtgctaatgggaatggtttttattttattttcaaatttcatttttttaattgctggatgataagaaaacaattaacttttatctaatattatcattttatcctacagcttgccataattgtttacttagttctgggagagttttgtttttgtttattctttgggatttctacacagataaccacgtcatctgcaaagatacttttttttctttccttccaatctgtatatctcttatttcctcttcttgtcttattgcattagctgaaactctcagtacaatgttgataggagtagtaagaacagacatccttgcctcattcctgatcttcgtaggaaaacatctagtttttcatcatcaagtatgatgttaagagtaggtttttcgttcatcaagtatgatgttaagagtagatgtcattcatcaagttgaggatgttctgctcgaatcctagtttgctaggagtttttattatgaacaagtgttgaattttgtcaaacacttttctgtatctatttacataatcatgagattcttgtccttcagcctgttgaaatgatagattatattaatttattttcctatgttgaatcagccttccatcctggaatagatctcacttggttctgatatataattttttttacattgttggattcaatttgctaatattttgttgagaatttttgcatctctatttatgagagatattgttctatagttttccttcttgcaatgtctttgtaatactggtctcatagaatgagtcagaaagtattccttttgcttctatttgctgtaagtaatccttacttccttaaatgtttggcagaactcagcagtgaattcaattggcatggtttctttgttttagaaggtttttaattattgatctaattttaaaatagatgtagcaccattgaggttatctctttctctttgtctgagttttggcaaattgtatccttcaaaaagttggtctattttatttaggtttttgaatttgtggccttggaatccattttgtttctttattatctttttaatgtccataggattagtaatgatggttctactttcctttctgatattagcaatgtgtgtcttttttcttaacctgtataaatgtttgaaaatttatttatcatttcaaagagtcagcttttttctttatttcctatttccaatttcattgatttctgctctaattcttattatttcttttcttttcttctgcttacattgcatttatttatttatttatttatttattttctgagacagagtcttactctgttgcctaggctggaatgcagtggcacaacctccacctcccaggttcaagcaattctcctgcctcagcctcttgagtatctgggactacaggcatgcatcaccatacccagctaatttttgtatttttagtagagatgggatttcaccatgttggtcaggctggccttgaactcctgacctcaggtgatccgcctgcctcggcctcccaaagtgctgggattacaggcatgagccactgcacctggccacattgcatttaaattgcctttttttctaggttattaaggtggaagcttagattatagattttagatttcccttcttttctaatgtactcattcagttctgtaaatttccctttaagtactgtttcactgcatcccacaaattttgatgagttttattgtcattttcattgaagttgaagtacttttaaatttttcttgagacttctcctttgaccttaaaatgtgttgtttgatctctaagagttttcgggtcttccagctatctttttattattgatttctaatttaattccaatgcagtctgagagcatactttgtataatgtccattattttaaatttgttgagatgtattttatggcttggaatgtggtatatcttggtgaatgttgattgtgagcgtgagaaagaaaatatattctgctgtcattggatgaaatattttacaaatattgatttgatccagttaattgatggtacttttccattcaattatatccttacctattttctgactgctggacctgtccatttctgacaaaggggtgacaaagtctccaactataagggtgagtttatctgtttctccttagagttctatcactaataatatagtaactgtgaaaagtagattctcgcccatcttcaggatttactggtttttgtttgtttgtttgtttgtttgtttttgttttgattgttgtagactacctctgtgctgaaaattggccttaggtgtaaactttttttcccccataagttattagggtacaggtggtatttggttacatgagtaaattcctttagtggtgatttgtgagattttggtgcacccataacctgagcagtatacactgcaccacatttgtagtcttttattcctcacccccgctcccactcttccccccaagtccccaaagcccattgtatcattctcatgcctttgtgtcttcatagcttagctcccacatatcagtgagaacctacaatgtttggttttccattcctgagctacttcacttagaatgtgtccaatcttatccaggtcactgcgaatgctgttaattcattactttttatggctgagtagtattccattgtatgtatatataccacagtttctttatttattcgttgattgatgggcatttggttggttccacgattttgcaattgtgaattgtgctgctttaaacatgcatgtgcaagtatctctttctaataatgacttattttcctctgggtagatacccagtagtgggattgctggatcaaatggtagttctacttttagttcttttaggaatctccacacagatttccatagtggctatactagtttacattcctaccagcagtgtagaagtgttcctggatcaccacatccatgccaacatctaatgtttttgattttttgattatggctattcttgcaggagtaaggtggtattgtattgtggttttgatttgcatttccctgattattagtgatgttgagcatttttttatatgtttgttggccatttgtatatcttcttttgagaattgtctattcatgtccttagcccagtttttgatgggattgtttgtttatcgtgttactgatttgtttgagttcattgtagattctagatattagtcctttgtcagatgtatagattgtgaagatttcctcccactctgtgggttgtctgtttaccctgctgactgttccttttgccatgcaaatgctctttagtttaattaggtcccagccatttatctctgtttttattgcatttgcttttgggttcttggtcatgaaatccttgcctaagccaatgtctacaagggtttttccaatgttatcttctagaatttttatagtttcaggtcttaggtttaagtcctcaatccatcttgagttgatttttgtataaggtgagagatgaggatgcggtttcattctcctacatgtggctagccaattatcccagcaacattagttgaaaagggtgtcctttcccccactttatgtttttgtttgctttgttgaagatcagttggttgtaagtattggatttatttctgggttctctattctgttccattggtctatgtgcctatttttataccagtaccatgctgttctggtgactatggccttatagtatagtttgaaatcaggtagtgtgatgcctccagatttgttctttttgcttagtcttgctttgactatgctggctcttttttggtttcatatgaattttagaattgtttttttctatttctgtgaagaatgatggtggtattttgatggggattgcattgcatttgtagattgcttttggtagtatggtcattttcacaatattgattctacccattaatgagcatggaatgtgtttccatttgtttgtgtcatctatgatttcttttttttttttttttgagatggagtctcgctctgtcacccagggtggagtgcagtggcatgatctcggctcactgcaaccttcacatttccaggttcatgccattctcctgcctcagcctcctgagtagctgggactacaggcacttgccaccacgcctggctaatttttttgtattttttagtagagatggggtttcaccatgttcgccagcatcttcttgatctcctgaacttgtgatccgcccatctcagcctcccaaagtgctgggattacaagtgtgagccaccaggcccggccccgtctatgatttctttcagcaatgttttgtagttctcctggtagaggtcttcaactccttggttaggtatattcctaaggtttttttttttttttttttttagctattataaaagggttcttgatttgattctcagtttggttgctgttggtgtatagaagagctactgacttgtgtacattaatcttgtatccagaaactttgctgaattcttttatcagttttaggagctttctggaggagtctttaggattttcaaggcaagcaatcatattggcagcaaacagtgacaatctgacttcctctttactgatttggatgccctttatttctttctcttgtctgattgctgtggctaggatttccagtactatgttgtaaagaagtggtgagagtgggtaaccttgtcatgttccagttctcagagggaatgctttcaacttttccccattcagtattatgttggctgtgggtttgctgtagatggattttattatattaaggtatgtccctttatgccaattttgctgaaagttttaatcataaaggaatactgggttttgtcagatgctttttctgcatctgcatctattgagatgatcatgtgatttttgtttttaattctctttctgtggtgtatcacatttatttacttgtatacattaaaccatccctgcatccctggtatgaaacccacttgatcatggtggattatctttatgatatatttttggatttggttagctattattttgttaatgattttagcatttatgttcatcaaggatatctgtctgtagttttcttttttggttatgtcctttcctggttttggtgttagggtgattctgacttcatagaatgaattagggagggtttttctttatcttctgtaatagtgtcaaaaggattggtaccaattctttgaatgtctggtagaattctgctgtgaatctgtctcgtcttggactttttttgttggtaattttaaaattaccacttcaatctcactgcttgttgttggtctgttgagggtatctaattcttcctgatttaagctaggagggttgtatttttccaggaatttctccatgtcttaagggttttctagtttatgtgcataaatgtgctcatagtagccttgaatgatcttttgtatttcagtggtgtcacttgtaatatctcctgtttcgtttcttagtgaggttatttggattctctgtcttcttttcttggttaatcttgctaatggtctatcaattttatttaacttttcaaagaaatcagctttttgtttcatttatcttttgtattttttttttgtttcaatttcatttagttctgctctgatcttggttatttcctttcttctgctgagtttgggtttcatttttttcttgtttctctagttccttgaggtgtgtccttagaatgtcagtttgtgctctttcagtcttttcaatgaggtgtttagggctataaattttcctcttagcatcccctttgctgtatcccagaggttttggtaggttgtgtcgttactgttgttctgtttgaagaatttttaaatttccatcttgattttgtttttgagccagtgctcattcaggtgcagtttatttaatttccatgtatttgcatggttttgaaagttcctcttggagataatttccagttttattccactgtggtctgagagagtgcctgatataatttcagttttcttaagtttattgatgtttgttttatggcctattatatggtctatcttggagaaagttccatgcgctgttgaacggaatgtgtattctgtggttgttggatgaaatattctgtatatacctgttaagtccatttgttccaggatatagtttaaatccattgtttctttgttgactttctgtcttgatgacctgtctagtgctgtcagtggagtactaaagtctcccactattattgtgttgctgtctatctcatttcttaggtctagtagtaattgtttgatcaatttgggaactctagtaataggcacatatatatgtaggattacaatattttcctgttggacaatgccttttaccattatataacgtccctctttgtctcttacaactgctgttgccttaaagtttgttttgtctgatataagaatagctacccctgcttacttttggtgtccatttgcatgaaatgcctttttccaccccttaagtttatgtgagtccttatgcgttaggtgaatctcctgaaggcagcagatggttggtgagttattatccattctgtggatctgtatcttttaggtggagcatttaggtcatttacattcaattttggtattgaaatatgaggtacccttgcattcatcatgctctttgttgcctgtgtactttttttgtttgtttgttttttgtttttgctttttaacttgtatttttgctttataggtcctgtgtcatttatgctttaaagaggttctattttgatgtgtttccaggatttgttttaagatttagagctccttttagcagttcttgtagtggtggcttggtaatggtgaattctctcagcatttgtttgtctgaaaaggactgtatctttccttcatatatgatgcttagttcagctggatacaaaattcttggctgacaattgttttgtttgaggaggctgaagatagggtcccaatcccttctggcttgtagggtttctgctgagaaatctgctgttaatctgataggttttctttgtaggtaacctggtgcttctgtctcacagcttttaagattctttctttcatcttaactttggataatctgatgtgcctaggtgaagatctttttgccatgaatttcctaagggttgtttgtgcttcttttatttggatggctgggtctctagccaggtcggggaaattttcctcaattactcccccaaatatgttttccaagcttttagaattctcttcttcctcgggaacactgattattcttgggttcaacataatcccagacttcttggaggctttgttcatattttcttattcttttttctttatctttgttggattgggttaattcaaagaccttgtcttcgagctctgaatttctttcttctacttgttcaattctattgctgagactttccagagcatttcacatttctaaaagtgtgtccaaagtttcaagctctgaatttctttcttctacttgttcaattctattgctgagactttccagagcattccacatttctaaaagtgtgtccaaagtttcctgaagttttgattgctttttctttatgcatctatttccttgaatatttctcctcttacttcttgtattgttttgtggattttcttgcattgggctctgcctttctctggtgcttccccgattagcttaataactaaccttctgaattatttttcaggtaaatcagggattttttcttggtttggatccattgctggtgaactagtgtgatttttttggggggtgttgaaaagccatgtgttgtcatattaccggggttggtttcctggttctttctcatttgtgtaggctctgtcagggggaatatctagggctgaagactgttgttcagattcttttgtcccacaggggtgttcccttgatgtagtactctcccctttttcctatggatgtggcttcctgtgagctgaactgcagtgattgttgtctcttttctgggtctggccacccaggcagtctacccagctctgggctggtaccaggggttatctgcacagagtccttcagtgtgaactatttatgggtctctcagccatggataccagcacctgttctggtggaggtgagttggggagggggtgcaatggactccgtgagggttcttagcgttggtggtttaatgctctgattttgtgctggttggccttctgcaggaggtagtgctttccagagagcatcagctgtagtagtatggagagggcccagtggtgggcagggccctacaactcccaagattatatgccctttgtctttcgctactagggtgggtagggaccgaccaccaggcgggggtggggctaggcatgtctgggctcaggctttccttgggtgggtcttgctgcggctgctgtgggggatgggggtgagagtcctaggtcactggagttgtgtacctaggaggattatggctgcctctgctgagtcatgcaggttgtcagagaagtagggaaagccagcagtcacagccctcacccagctcccacacaaaccgaagggcctgtctccctcccaccgtgcccctgccaagagccccaagtctgtttctgggcatgggcgagaggggcttaaaaacttgccccaggctacctacttcccagctatgaaagaaaagggcttggtttttcccctccctctggagcctgcacaccggatttgcaccgtccccgagttctggccaggaggcttctcatccgttcgaactgttacaatgttcagctggagatttccttctccctgtgaagttttacccactgctcctctggctgccttcccaatggatccctgtggtgccagcaggaatgacctgcttgggaacccagtgagttcccagtgcctttctgctgcttcctctacccctgtattttgctcgactgtctaaattgactcagatccaggtaaagtcggaaacttctcccgcaacagaccttcactttctctagtgggggtgtgtgttcaggagaggagggtctccctttcccgcttctgcagctggggcactcacagtacttagggtgtctcctgagacctgcaggagcatttcacttccttcacagagtctgtgggtcctctcgggattgctggtttgttcttgcagtcaacctggagctaaaattcacaaatgtgagcctccacacgctgctctgtccagtgctgcaatctcaatctagtcctgcctcccatatgccatgatgattggccttaggtataaatgtaaggttctttcagttattttctgagcctgtgtcttttctgggtatgtgtgatgactttctaatttcccctacataggtgttagtctttgaatatccaagtcttcacactgtctgtatccttaaaaagggaaaagaggaaaataaggggggaaaaaggcactggccctttttatcccccagaagtcacttcagttggataaggtgggtcttgcagcaatgggcagggtgtacaacaatggccaccacctctttgcacctgtgactgggatcagtaatcaacaatcaacaatcaaagtgcagactcccaatatttggaggacagttccctttttctcactttggctcttgcaagctctgtgcaagctgctccagggacacatgctcagctatgtgccatgggcctgggggtggtggatgggtaggtactactgtactagagctaaaattgaccaaaattaactgtattttcctgtccaacccttatattgaagttgcaagccttcaatagaccccagagtttcaaaataattgcatcaaacagattctgccagtaggtaaaagttttgtttagctgggagacagatttcctggtgcttcctactccttcatctcctctttaccctatatctgtaatgctcttttttatccctgacaattttctttaacaattttcttgatccactttgtctaaaattaatatagctattccagctttattttcattggtgttagcatggtatatttttctacatcgctatacctttaatctgtatcttgacatttaaagtgcatttcttatacagaaaatatagttgggtcttgttttcttacccattctgacagtctgtgtgctttattttatttttaattattttaattttaattttttatttcaataggcttttgtggaataggtggtgtttggttttgtggataagttttttagtggtgatttatgagattttggtgcacccattacccttttcaattagtgcatttagaccattgatatttaaaataattattgatgtagttggataaatatctacaatatttattaccttttcctatttgctgctcttattctttgtttcatttttggtcttctattctttgccttctcttgttttaactgagcattttatagaattccatcttttcttctctcttagtatgtgaatcaattttttttctttttctttttttctttttgagatggagtctcgctctgtcgcccaggctggagtgcagtggcgcgatcttggctcactgcaacctctgcctcccagattcaagcaattctcctgccccagcctcccaagtagctgggactacaggcgtgtgccaccatgcctggctaatttttttgtatttttagtagagacacggtttcaccgtgttagccgggatggcctcaatctcctgaccttgtgatctgcctgcctcggcctcccaaagtgttggccaggctagtctcgaaatcctgacctcaagtgatccatctgccttggcctcccaaagtgttggggttacaagcatgagccaccatgcctagtcagattttctttctttacatcaaatattacaagcatttttttcaggtcattatatattatataaaagtataattttgttaaaaaaagtcgcatagtactctattatatctctatctttcccagctatctctctcatatatacatatatgtacacacatacatataacataaataaatataaatgtaatttatttaataggaattcacatatatgtacatatatgtatgtatttgtattttatgtattcataaaattcatattttatgaactcctattaaataaattatatattattttgtgtgtgtgtgtgtgtgtgtgtgtgtgtgtgtatagatatatcctaatatcctagcaataagctagtgttaaacagttgagtttttttttttttttttttttttgagacagagtctcgctctttcgcccaggccggagtgcagtggcgctatctcggctcactgcaaactccacctcccaggttcatgccatcctcctgcctcagcctcctgagtagctgggactacaggcgcccaccaccacgcccagctaattttttgtatttttagtagagacggggttttaccgtgttagccaggatggtctcgatctcctgacctcgtgatccgcccgccttggcctcccaaagtgctgtgattacaggcgtgagccaccgtgccctgccatcttacttacattttttttttttttttttgagatggagtctcactctgtcacccaggctggagtgcagtgatgtgatctcagctcactgcaaccactgctacttaggttcaagtgattctcctgcctcagcctcccaaatagctagaattacagatgtgcaccaccacacctggctaatttttgtatttttggtagagatgaggtttcaccatgttggtcagactggtcttaaactcctgacctcaagtgatctgccagccttggcctcccaaagtgctgggattataggcataagccacagcacccggcctacttacattctttcttgtagtaattggtgcacttaaaaattttattcatttacttatttacttatctataatagcttatgtaaacaaagtaaataagtaagatacataagtggccaggtgcggtggctcacacctgtaatctcagcactttgggaggccaaggtgggcggatcatgaggtcaggagatcgagaccatcctggctaacacggtgaaaccccttctctactgaaaatacaaaaacaaaattagccgggcatggtggcagtcacctgtagtcccagctacttgggaagctgagatgagagaatggcctgaaccccgggaggcggagcttgcagtgagctgagatggcaccacttcactccagcctgggcagcagagtgagactccgtctcaaaaaaaaaaaagatacgtaagtatcttatataagtaagataagtaaatgagaaaatttacttatcagaatttcttgggaatgatttatagccctgaaattacttaatgaaagagatgggttttttttccccaagactttgatacatactctcacattctacttcaaaaacattgtaccaatttataccaaaagtttctttataaagagttattaaacataaaagtcatgttaaaatagtgacttctactgaaagaaatgtaatggtgaaattgctggaagtgccaagtaatacaggcactaagaaatgactcattcattcattcattcattcatttgctaagaggaagtaatttacgattttcttaggagtttatttactagagtgtctgtgggtgaaattcagattccactgggcaaatgaggaaatgaaaaatgtgggaatggattcctttataaagaagtttgcctgtgaaggaaagaagagtaaatagtgccattgctggagcaagttgggccgagggagatgtgctgagagagagatttatctgtgcatgtgaaggagctggtggaggaggcagaagcacgaaagagaagactacacatttcattaagagaaacaaaatcaaattttattttctttgaggaagatggaaggaccaaattaatatgcctctgttggaattttgccctaaagaccaaaattccagaacattctgctgatagaagccacagatgtgggccaattgtaggtatcggatcagagaggagaatcacttttttgccgtagactgccccatgcaccggcaccgtaccagccctggaggtgtgtggcgagccatggtccctttcctcatggcatggttcttggtggggaagacaggtatgttcccatctccacgccatttgatgagaacaatgcatatatacatgggtagagggcgcaaataaacttcctagaggggatttggaaagcctgttgctgagagagaacacaggagctgtgtcaggggatatccaggcaggtacttctgggcatgctgcctttcttgttggagggaagagggctgcagcgtacagagatcagaaaagcacaggacattccaggaaatgcaccttgtttgttgtctttaactggcagccaaaggattgtaaagctggagagagtctgggccctcataggagaggggttggagcctgagccttgtctcactgcccagctgtgcccttgtggttataactgggcatgtgcataatgactatatgcgtccttctgggatgtagccacatggtcttcattatattctcaaaggggctgtagatcccttaaaattgaagacttgctgctgagggcaaggggcacatttggcagggtttgaaccagaaaagctgaatcattgcccttccatgaacaggcttggggcttgtaataaagtttccccttgtttctcaggacagcttgcttccctaatgagccagcttgataaggtcgggccacagagggcgatgcctgcgaggcacttacgtgagcacagagggctagtcgaaggggcaaggatgcagaagagaaggttgtgctgggctctgccactgcaggaagactgtgggctctttgagatggaggcctgaactgtcccctacccctccttccccctgcacaaatgtgattatgcctctgcagagcgcctggaatcaggttagcgtcattgagcaatgctgagctggagtaatcagagcctggagcggagcaggtgctggctttaaagtggcttctgagaattaggacaggctgacttgtagctcagccccacgtagacaagccacttagaacactgtccttgcagcccccaggcctcctccttaccacagcaaagtgcttgggtttgttggaggggcctctggcatggcccaggtgctgagctcgttaactgatgttcagggactggtgtcccaggggtcctgtttgcccagcatgtggcaggacaacaagagctaaccaagcctggggtcacatttggtctgctcctgcctatctgggtgtcctgggacaattacccacctcttggagcctcacataagtcaactgtaaagtgggaatcacgagcatatctaactcataaggtggtggcaattaaatatcatataggaaaggctgtcagcattaggcctgctgcagagttagccgcaaagaacatcacccctattctcaacctaggccactgccaggacaaggccgggttttattgtttctgcaaagatgtttcatactcagaacaaaaaaaatcagtaattacataagaatctaagaataaaggtttatgttaaccaaaatcttaagagaaatgcagtattactgtttggtgaacatcactctagatactcttctatgcacacattaatagagagaaaataattttaataagggcacatttaataaatttttaataatagaagttattggctgggcatggtggctctccccagtaatcccaacactttgggagaccgaggtgggtgaatcacctgaggtcagaagttagagaccagcctagccaacatggtgaaaccccgtctctactaaaaatacaaaaaattagctggatgtggtgcctgtaatcccagctactcgggagactgaggcaggagaatcacttgaacccaggaggtggaggttgcagtgagctgagatcgcaccactgcactccagcctcgacaaaaagagtgaaactccatctcaaaaaaaaaaagttattgcatttagtttagtgtttaactgaagaaagtcagatgaaacagaaggaattgctaaactagagatatgtcatttctaagatatgactctgggagttgagaaaataagtttcaagcaatattaatattgttaagtcattctttttcgctattctcttaaggataaagataaggcattctaagactctcatgctctacaaactgagtagccaggtgtcttagacaaagtgctttaacattcaattatatgtcaagatgaaattgcaaatagcagagaaaaacaacacactgacttcaattcccactaaatgacttatcttgccaaaatgaaacaaatgcggagaattattgatgcttgacatgaggaggggacatccagaggttaagaaaggatgctgacagcaccaggagaaacattgaggtatgcaagatgttagcccgttggcacctgatagaccgggcaggtctgtaagtgcaatacgttgctttgtaggtaagaaaaataaagcccagccaggtgccaatgtgacatggagttgggcctccagcccaggtctctgtgccccacatacatggtttaactatctgtattcactgtgcctttttactatctgtgcttctgatgctgtgacacctttgggtcttgctgaccctggagggactgcccttctcagggagaggggtttcctagagctcttaaaggactcacttgcaagttcacctttcttttcttttcttttttattataagttctagggtacatgtgcacaacgtgcaggtttgtacatatgtatacatgtgccaggttggtgtgctgcacccattaactcgtcatttacattaggtgtatctcctaatgctatccctccccactcctgccaccccatgacaggccccggtgtgtggaactcaaacaaatttgtaaaaaaaaagcaaattcacctttgaaatgcaaaatcatcagtacagagctcctaccccagcatctcctctgtggggctctcacactctgggctactatcctcctgccctgaccactcaagggctaggtaccagacatctagggacagccactgctccaaatgtgacgtggagcagaccaaatgcgaccccagagcccactgaaattattcaaaccagccgatcctaatcctgctcacccttgccctgcctggttcttcctgtggaaaccacaacacaggcccttgccgctgtttttcccccacccctctgctgcccaactgatcctcgtgcttccccatgtccccctccccttggggactgtgaggaacaagctgtttttaatggcagtcatctcctgacttgttgggctcaccatcctgaacaagaagaaagcctacatttaaacagactgcccctcctgcgcctgagggtagccccttgggggactgactcccttgggcatagctcagtgacacagagagcccttccagagtccagccaggacctgttttgggcccacgccccggggtttggcatggaaaactctggtccctgagcaggcatcgctctgtctgagaagtaccttgtccagcccagccacctgtgagaggagcagggcaaagctggtgagacgaaccttctgcaggctaactctgtgctacctgggcatgaacactttgtctctctctaaaaggaaaagttggtttccaggtgaaatgcgaggcagtcataggtgaaatggagccacaaaggtctcgaactggggttctcacatacgagtttctgacctctctatctttatcctcaggacacatggcattgctaagactttacagggggctcaataaaggtcacacaaatttaattctattccacactcttgtcgcatctgcaaagaaatttcattatctagactgcatgacatccataaatcaattaggccctttggttttgtaaacataatgtgcgttttgatcctttggagagagctgtttcaattcagcaataggtttcagcatctatgcaatgtccagcaaagtgcaaatgctcagcccaacacaaaacaatgagacagggtccctggctttgggagcatcatgggtctggagggagagacagacatgtgtgtggggacaacacagtcaggctgtgccagtgcgatcgtggcaccacaaggtcctcagagctcgggagaggccgcagtgactcctagcccgtattttctgggttgtgtgactgacagcactcaatgctttctcagaacatcccttttaaaattattttcaatgtcagcagtgttttctcatgacctcctgaggatttaattaatctttgggaacagtatcattcagaaagagaaaggcagcggattaaagctggtaaatgatactcttgctcaaaatcctagtgtgactcttaactgatgccaaagtctgttctgaaagaagcattccatgagtgccttgggcagtctgggccctgctggagggagactcatctctactgcgcttgctctgctctgtgcattgcacatgtgtgtatgcacacacacacgtgcacacacacagacacacacacacccccccaaactaggaaaaaatcccaggcttctgctccatagtagtaactatgttcttacattctctatatatgtatatatatacacacacatatatatatagaaaataaaatatatacacttgtgtatattttaattataacttaattataaatttaattagattataattaaattaaaatgtatatatggaatataagaacatagttacactaatgttacatagaacgttaattaaaatttaacaaaaatatacacacatacatatatatgtatatttaataaagtagaatatagtatatgtatatttactaaagtagaatataggtatcattgtccaggtggtagattgcttcatgtctgccccaaggcaccctggaaaatcttttgcaacttcccagtttctaacctcagagcttagttttctgtctgcaaatctgtttctcttaacctgttatgatgctttcacccaaagattcaatgtgcatccatgggcttacgtttccatgtagcagacattcattgggatctcggctcatggccccaggttggaccatggggcagcagttgcttgtgtggaggttacagcggtgactggcacctggggaataaaaggctgtctgctttttaccctctagatggttgccaccctggggaccacaacatgctgctcctttgacaatctcttagaagtcggtcctatctgtaagtatccgattccattttctttttggaaaatgttctctgtacacggggaatttagcaaaccttcctcgttgatctctttcttgtcgttaacttcatattgtgatggtttgcccagctcttctcgtatttgcaataacacaaacctcattagcttgaactccacaaactcagaatttgggctaattggaaaagaactgagcttagttctaccaacacactatttgtaagaaaaaaaatccgagcaatatagaagttatgtaaaattgcaggttatgttggccctgttgaggagaataaactcttcaaaatcttagagtaaccaccttcatatgtgggtcgtgcatacacctgatatgagaattgtccacacttgaatttaattctttggtatatccctttttcacctttttttggaattactgaatgcagttaagaaaattgctgaaggtagtttagcaaatcaacacaatgaaactggatttcgccaaggaataatctgtgcttcagatgttttcctggtcactctcacctcctcccttcctcattcagagatcctaggttttctcattgagactaggatgctgtgttttcaaaaggtgaatgtgaatgagcagctctgtttctagagtttcacctttgacatgtagctctgggaactcagcaggccttgaagctgcttctgtggacagaagaaccctcgtagggcagggacactggctcagggggctccccctttctctgtccctctaggatgggaatgttctgaccgctcggctgtgagtggagctgcccaagtggggccttcagatcacatacctgtggcctgtgccagatcccacaacagctaccagggaattggcttcctccttagtctgcacaagccaagcacagttctcacctctcctaacccaagagtcacccatagtccatactcagaggagtggaccctcctctcctgggcgttggcctcccttcttggggtcagcagctggggaaggccggtgctgaaggtgcaggtgcctttgtgtgagctagacatgaaattggtgacaaggaagctagggtgcagcccaggatccacccctgaatcttacattctgagcttcatttatgctgtctgtaaagtgaagagaaaaaccccacttgtgctcataaaataacaagatttccccacacgattattcagaggataaattaatgcagggaaaatgcaccatcccaaaggtagagtgcattgctgcacagcaaggaatgcagtgctgggaactactgggaggtgggtggcatagacttacccgctctcacagggtttatgctccaccgtttatgctctgtggcacacagctgtaagaacaagtggcgggaagtggtcgtgcacagccccgggctggggagaagggatagaactggctgactcaggactgcagccacagcattggcctcatcagctgcaaaccttcatcagctcagccaagcaacttggagtcctctgactcagatgtcaggctaagaactgaatgtcctggccagtagctggctgatgtaattccctagggctatcggatttaaagggccgaggtcttctgctggatagagcccacatggcctgctgtcccctgggccaagtgtgggctgcccgctggaccatggagatgacagccagcgtgtgtcacctgccagtcacagtcccctggatggatccagctcaggccttcctgctatctggggccccctcttctttgtagaggctggaggctgtggacagagcttgatttatgatttgtttggtttgaaacactgaggttgcttttggggttgtgcagaaggagctgacatgggtgaatgccaaaaccctttcatccattggcagaatgcataggggaggtcagttttgacaattcctttttttttctttatttttgagatggagtcttgctctgtggcccaggctggagtggcacaatctcagctcactgcaacatctgcctcctgggttcaagtgattctcctgcctcagctttctgagtagctgggatcacaggcacatgccatcatgcctggctaatttttgtatttttattagagatggggtttcaccatattggccaggctggtctcagactcctgacctcagatgatatgcccgcctcagcctcccagtgtgatggaattacaggcgtaacccactgtgtccggccaacatttccatttttattgatggtgttatattactaactgttggtggtaccttaacaattaagtcagcacccttttacctactttccctctcctgctaccattttcctatcaccagatatttagcattctccaactccaagcgggactgttctgagatcctgagctgaccttattctatatatgattagaataatctaacataattcagataagttattcacccaccatcatttgacaaagaaaacaaatcagaagatggttttcttccaattgctgccttaggaaagacattttctttttattgcatttgaaatgatttgccagtgagggtattcagattggtctgcttggatggatcagttgtctggcaggttttactgagaagatggaatacaaaaagtggatagttgaagtcagttaggttgccggtggggaagtggggaaactgaggacgagggtatgggctgagttggggaggccatctcaaggtgtgaggaagggaatagcacagggcaggcagccaaagctgcatcctgaggtgccagcataactgagagaggacgtgcagctggaggggcagccaggcctgccgcaagttcctgggaagtctcagaaggaaagagtcactgacagcaggaagctggagggttgtgaggctgtcccattcctccccactgaggcagccttgcctcagggctaggtgtgcccctggtgcatgcaacttctcaagctctggccgagggtctctgtgtctgcctggttcctagatgggccgtgctatgcagtgtgtgctgttagtggatcacatatgagatgcagaatgcagaatgcagaggcatgcccacagctccatgcatccccatggaaaccagagaagcccttcagagtccacttcctttaggggtctgtaagttcccttctgcaggagttgtaggccaactgcaagcttagagagaacacagtcctccacaaagctgataaaagacataaggcgtttcaaagctttgactcagtttaatcatcaggatgaaagccctcagttggattaaggtcaagtgtgtcctgcggacacggatatccaccccagggcatgggaggccaaaggtcacagagcagtgtggacctgaaccgaggcttaggggctcatcacttcccccagaatcagtctcacctggtgcttgcataaccccagatggatgcagcagtgagccaggaagagcacaaggccttaggatttgcagagtttctccctgaggagtcactcagtaatcatgggatgtccatgcctgtagctcagatcagcggtaaggttgagaaaaacctcagatcacatcataagataggtgtaaatttgaagcttgctgtagtctgaacgtttgtgtcccccgcaaagcccatttgctgaaattctaacctaaggtgatggtattggaggtggggccttccagtggtaatgaggtcagcacagtggagccctcctgattggaactgtgactaattagtgcccctgagagtctcacgcctcattgcacaatgagcaccatggatggtgagtgaacggtgaatccatggatccctacaaatgcatatgctgaccctgacacctaccccacggtaccctgacactggtatccaccctgtgaggtgagggtggctcgcgccctctctgtggtccttcacccttcaactcttactctcctgggtgcctagggctgagaggcagcaaccatggaagccacatttatttctcccctactcagtgctggggtcctggcaagcacattgtaaatattcccttgctcatcccttgggcctatgggtactatttcatctccatcttcctgggaggagagtgaggcttggagaagtagatagggccccttggctggggagcaactggaagcaggagttgagcccagatctgtcaaaattgagggagcatgctacatctgtggctctcccagctcctgaatgaggcagcccctgcccacaaggctgctatgcatggttggaaaacagaaccctgttcatgaagaaagcaggggatggtctaagatggtgtaaagtaaagaacttcacctggtggtggggatggagtggggcaggtagaggtcagcgtggactgtgtgcagacctccccttggatgatgtttgggggaggacttgagaatggattagcaaagggaaccaggaagggaattccaggtgggtggaaagggtggtgtcactggagagaaatgcaggtgagtaacatgaggctgtcacacgatggtcccttggagttacacttagccgccagggtcaggagagaaaaccaagtggtgcagtggcttccattttccctggtgtgtctggggccagcagcacacacactgccctcagctttagaccctttgaatgagggggccttttggggattcagccattagttcagcaaatactgttggcatgctctacccaagaaggtgctcagacagggcgaggtcagctggcaggctccgtggtgaggcatccatctggggactcacaagttgattctgaactttaggcaacaaggaagacatatggctgcacgttgatgcagcctacgcaggcagtgcattcatctgccctgagttccggcaccttctgaatggagtggaggtaggtgcacccttcgctctccctaaggctgttttcacagtgctctgttattgacctctcccttcatgaggagctgacgtccaatctcttgctattgaggtttgtttcagccaattatgtttgaaccaattccgacttcctcagaataggggctgagagccttccccagccatatagcctgtcctcctgaaatactcctgacacttacagttccatttcaatctacacaaatcccaaacagaaagaataaatgttagcttataaaactgtgggaaagtaggaacaaaataaaatcttaatgaacttaaactcaaaagagtaatttaaaataccaacccgcaattccatacaatctggttcaatatgacagtcatgttctgcccatacatctgaacatgatattcactttaaccaatattgaacgagaagctaccaatgcatttaaatgcccctagacagtcttctggaaattgtaaagcatgatctttaatgctaagtgaaatgcctgcttcttttgagaagtagcaatcaaaattattgaccagcactccgcttctccaaaaagcaacagaatgtaaattggtacagacttaacacaaaaaaatgaccttattgatatactgtggtgtgttatttcagactcaagcgggatttcattgttggtggtggctcatagggtaggaagtctcttctccccaagaactcagctttgaatgccatagagggtcctgagaggcagtctttggcagtgtttctaagagaaggaggtagcaaagcaggggagctgtggcactggccaagaaagaaatgctttctgccaaggggcaggaggtgtcgtgagacctcacccatgtgtgatggcagatgaagggcacagttctctgcattagactccttggtttgaatcctagatttatccttaagactagctgtgtacccttgggcgagttagatatcctccctatcctccagaaaatagatttcataagaatacatccggtgtgggattgtcgccaggagtagatgagttaatcatgttttaagggcttaaaaacagtgcctggcagacagtaaatactgaaattgcattaggtgcttttgtgattttctactacgtcttagaaaaactttcccttgacagcttcctctgcttgcatgtcaggtttgctaatcactattctaattacaactttgaattctcataatgctgtaataccagaaaagagggtaccagaggtatagaatacaaatgtccccatctttggaaagaataatcctcttactactaatcaatgaagtagtattctggtttatgtctgcatcacaatcattcactcattcattcaataattacttgttgagtacttaatacaacctaggacttacatgatggatccttgggggtaaatggagcttccaaagacctatgtacgcactggagagagggtatagtatatgagaagttctcataatgtgatgccagtacccagctgatatagttcattgccggtagctagtttggtgcgtgtttggtgctgggaaacgaagagtaaatctctgtatcatataaatgcatggcatgatggagataatctccattatttgaaacatctgtcctgggacagtttcaagggaggaagggctaagcagtcctctgggatttatgtgccctccccacggctggcctgagcttgatgctcttttctaactctgggtatcaggtttagggttcgtgatcttttcctaccactgctcttcttttccccaagaactgacaacttgaggtttcatctttcatagaagggtgcctcattgtcagaccaccacagcaatgggctttccagccagatcctatcagcaacagacaggatttcatgctgtacaatgagtcactgccatttttcttgcattattgctcccgactctctttccatgcccagctgagggctgtgcgtctcagtggggcagataaggaggctgcaatatcctgttgtggccctgcccttggagataagagcctttctctccggttggcaggaggaaaatatcactgctgggtaatgagagaagtttaaacagatcagccccataggagggaactcataagactcctagcaaacagagctcctctttaaccttttgtctccttttatcaacaaatgaaacttgctgtaatttcctgtccttttctcaaaattacttttattaaaacctagaaggaaatgaacctgggtctccagagcagtggaaagttgtcatccaccaaccaaatgcctcccaggacgccccccaggtccctcaagcttctgctgcctcctcggtgcacatccctgaaaccaagtagacaggaggtgccctagggccttgggaagactgaaaagtttcccagtaggagagtcggccagactggcgcctcactgcaacagccacctttatttcggtatcaattatgaatccagccgcatggccaaatccctggccattaaggtggaccctgttcctgttcaccagtcaggtgataaaccaggacatgcatttgaaaaagaaagcaccatttatgacagctcagggaaaatgcagagtgtcctcctctgccactcttggtggtttaaacctcttattttctccttgaaaataaggtagaccctaacactgatgcatgcagccagagccggttgttcacagtttttacccaggatcttccagctacgggagcctgtagctgttaggaatacaatgaactttaaaaataaaggagctggtcggggtgcagtggctcacacctgtaatcccagtactttgggaggctgaggcaagaggacggcttaagcccaagagttcgagatcagcctgggcaacgtaatgagacacactgtctctacaaacaaaattttaaaaattagctgtgtgtggtggcacacgcctgtagtcccagctacttaggaagctaaggcaggaggatcacttgagcttgggaggttgaggctgcagtgagctgtgttcatgtccagcctgggcaacaaagtaagaccctgtcgctcaaaaaaaaaaaaagagagagaagcatttaggtaaatgaggagaattgttgatatgttacagcaatgctggcaaaagaacccatcaattaaatgaaaactgggtttacccctatctactgtagattagtaataaaatttcctctttcccactgtttatcatgacacgtgtagtctgagaactttgctagctcagcaagtggaaggaacttcaagcatgaagtatttcacaggccaaatcagtacaattcctgtacgttgtgcttgtgaaggacaattctgatttttccaaatattccagtaatttaaaatataatatggatacattttatgtcacattagattatgtaaatttgaaaatgcttttcatttgggaatataaacttttaattttaaaattcttgttccattttatgagagtataatctagatatagcaaaacatacaaatcaactctaaatacatatacccacccccatgtacttaccacccagatcaagagtagaacaattccagcactccagaagactcccctacccactacaagttactactcccctgggcaaccctacctggcccctaccactgtggattagttgtgccataaacttttattatcatgtatggggtcttctttataattaaacatttataaagaaaatgttttctttttcttactcttgttctttggcagtttgcagattcattcaactttaatccccacaaatggctattggtgaattttgactgttctgccatgtggtaagtttccctgctcacagatgtcagttgcctgtccgaggtgacagtgaaagaagctggcagggaagatgccagagccaaaggggtgcaatagtcacttagctcactgcttgctgccttttctgaacccttgatggaattattgctaattcttagcctcactggaaacttttatctagggaatatcattgcaacatactggcataagaaatgagaagcctaaaaaggacaattttttatttgatttatccagcattgacagaaaacaaatgcaagtacacacttctaattcagtagcttgtgttttcattcttagattcgtaaccagtcttagtgtaatgctaagttttagcaatctgagtccaaatgcttaaaagtatttgctaaggccgggcacagtggctcacacctgtaatcccagccctttgggaggccgaggtgggtggatcacctgaggtccggagttcaagaccagcctggccaacatggtaaaaccccatgtctactaaaaatacaaaaaattagctgggtgtggtagtgcatgcctgtaatcccagctactcaggaggctgaggcaggagaatcgcttgaacctgggaggcagaggttgcagtgagccgagatcatgccactgcaatccagccttggcgacaagactctgtctcaaaaaaaaaaggattcgcgaaggaaaaataatagtaaccatgtttcctaagaatttccctggaaattcttttcttcctctcttttttttttttcgaggacagtgtctcactctgtcgcccaggttggagtgcagtggtgcgatcttggctcaaaatcttttctttctttctttcttttttttgagacagtgtctcattctgtcgcccaggctggagtgcagtggtgcaatcttggctcactgcaagctccgcttcccaggttcacgccattctcgtgcctcagcctcccgagtagctgggacaacaggcgcctaccacgcccggctaattttttgtatttttagtagagacgaggtttcaccgtgttaggcaggatggtctcgatctcctgacctcatgatccaccctcctcggcctcccaaaatgctgggattacaggcgtaagccacggtgcctggccggaaattcttaataacagcatgataataccttggtgatatttagaataagaaaaagaactaaagcattaaagtgggtgatattacaccacctacacaatgtttaaagaaataatgatgatgggcagtgatacagggacactagaaactagtttctctaaagttttaaagtaagaagttgattgattgatcatagggccaggaggatttgcatgaattttgtacagtatgcaaaactgcaaaattttccaaatattcagaaggctttgcaaaattgttcagtatgtaattaagtgaataacttttcactttcctcctaagcatgaggaaagcagcttttatacaaaacaactaatgtcagctctcaaggttaccaaaatatccgtttgaccttttcctgttttttttttaaggctaaccacatttctagtcctttacttgtatacaaatcaaattattttttgtcagtctttttccccaaacttctgctatataattttaaaaccagttggtatgtgggcatttcagacttaattttgtctgaaataagtatttatgaaagacatggccgttatgaatgtgagtattcttttgtattcttgtggttgtgtttttctgtttcacccaaggtggaacacagtgaggacagtttgcaccgtgtgccagaggtccctttattcgaggggtaattttgattgaaatgtaaatccgctctgctgaggtttttggtcagtggggaaaatcctctaaggtggctggagttcggaaggaccaggcagagcatccacaggctctggcgggaacaagtggctctccctacttgcttttgttttgcaaggggcaggcgtcctcagatgccttccacaaaggaagccctagaaccacccttgagcagggcagggctgatgggctgtccggaggaggggttctcgtgcgccctgaggccgtcctcaatgcctggatagaacagtgatatcagcaaggctgtttagtgactgcggataggtacatccaggctcccttctaagtccctaacctctcgtagctctctggacccccacgacagccctgtgttgagggacacagacattgccacgctctctttacagatgaggaaactgaagcggtcagggaccagaaatattttgggtccctaatcttggaggcaaatattgacacacgataagaaggagtgtaatgaatgcggcgtcctgccctcaggtccagacaaccagtgcgtatgttaaggctgaagaaaacctgcttagtcagtgcggtggtgagaaggagttgagcctttcgggacgtggagtgcctgccgcagagctgatgccccgaggctgccgcagacgctgcagagctgatgccagcaagttggcggctgtgcgctcatctctcccggacaactcttccccggcgctcggggttcagttcagccaccagcctgtgaggggaaatttgacaaagtggaggtgatgtagggaagagacacaggacacacagggatgaggccaggccatttggaaaaggccatttggaaaatttccttgtagaaggaattaaacgtaagccctaagacacaagagaggcctgcggtgtctggaagtctgccacaagagaagggtgatggggttagttcccatcctctggagtgggcgacagtggtgggtcagggtggttgcaatacttgaggaacctcttaccttcctatgggcttgaaaggctacaaaatatgtttttaaattgcaatagagaatgtgctctttctctcctgagccggtgcgttctcgacagaacaagagtcaaagaatttggtgagatgctgtgtacctggaaaaatcagatctctccaaaacccaaggttttgtcccatgacactataaaaatggcatgaatgttgatagatgaaatctgatctttgaaagatttgtgttttaacacagaaattgctgatctttactgtttgggggcactgtgcctgcattagttggctagggctggcttaacaaagtgccatggacaagcggcttaaacaagagatgatttatctcagtcctagaggccagaggtctgagataaagccatcagcaggctggtttcttctgaggcttctctcctgggcttgcagatggctgtctctccctgtcctcacatggtcttccttctgtttacctgtgtccaaattttctcttcttataaggacaccagtcacattggattagggcctgttaaccaaaaagtatctgagacaggtctcaatcaattcagatgttttattttgctaagcttagggacattcctggaagaataaacatggaatcacagaaacagggtgtgctttgtgcctttccccaaagatgattttgaggccggcagtatttaaaggggagggcaagctggaggggaaagagggagggtatggtcacattactgaatccacgtgttgtgagagaaaaggagcaggtagaggaatagtcaatgatatatttgtctcacgcccagtaaatcagctctttatataagataaggtgagcatagagtagctacctgtagagatatttaaccttttatctgtagctttctgcttaggaacaaaaggaagggtatcttcttgcatgaaagcgtccagcttattttttttcctttggcatagtaaattgaggcaccaagtttttattttccgttcacatttcttcccctccccttttaaaaaaagtcttcagaaaatgcattttagaagaaaatgcgtctctagtcttggggttttgtctggtctcttgtgactaagacagtttatttctagacaggtcccacgtggttaggaaagctcatttttagcaggttgtaaagtctcatgacccatgaaggaaaaaaataggtggaggaagagagagagaaacaaacaaacaaacaaacaaaaataaagggagaacaatcctggaaaactgacataaaccatattactctgaagtccctatgtcagtaggcaggtatgaaagtgatttacgtatataaataggttcctgttattttcttccaaagttgacgttgtctagcttcagtttacagggctttaagaaaagcatagcttaatatttagtgatttcaaatcacgattaaaaaggaaaagaaagaaggaaaaaaaactgacaacattattttccagaattgtagccaggaaaaattttagaattcagcccaaattgtagaaaataataaaaacagacaaacattaggcaaggctagactctaattacagatgtactatagtttattttgaaacataatttttctctttccagttccccaattgtattaaatacaagattataatagggccaatttatttgtaaaataagttttagttctattatgattggcttgattatttggataaagtgcagcaagaataatcatttgccatataggtttgctctctcgctctttttgttgttgttgtttttaaattggttttgttggaatcttttcataaagaatctaagatttagagcttttgttgttgttgttgttgttgttgagacagagccttgctctgttgtccaggctggagtgcagtggcatgatctcggctcagtggcatgatctcagctcactgcaacctccacctcccaggttcaagcgagtctcctgcctcagcctcctgagcagctgggactacaggagcgtgccaccacgcctgcctaattttttgtatttttagtagagatggagtttcaccatgttagccaggatgatctcgatctcctgacctcatgatccacccacctcagcctcccaaagtgctgaaattacaggcatgggccactgtgcccggctgatttagacctttttaaaagcctcagtcccagtcaaggatttttctgtgcctatagatacctgtatgaattggttgaatttttctattttcaaggtcccaagagaacttgaggttcctagccctgttagaaagtgacattttttacttaccataggtcaggaccctgtaaaggacaaggtatggggccagtttttctaagaggcttttactagctctgtaggtcacccttattttctcaaggcaatctgaaaatgtcattccaatcaaagccttggtaaaataaccaatgacagaacaggatcacacagaggtcattgtaaaatcagtcattcatttagccaaagcgataactcaaagatttcacaacctttattctttgagagaagagacttacttttctaaacaataaactctaataaagacagtatgaggccaattaaatctctctcaaattttataaacaaatctattaaattttaatcatcttgaccaaaatatataatttccataaatcattttataaccttttataattttttaattaaagaatgggttaatgtcccaagaaaaccttgttaatctggcatagggacacagatgctggtcttgcatcagtgtacctttgatattagtgtttaatttatagagaaactaagctaattttatctgtcaatattagctcttccaatctatgtgtccacctcttctgtgatactctgatagtccctgggcctagaggggttgaatagttttaatttctggccctgtgtctcttgaacacagtttattttgattgtcatcttctcctgggtctgaagatgaggcttttaactgctgtcagtgtttaagatttagctggacttggtatcttttttagacccaggagtcaaagtcctgtaatagtacaatgactttagaagcaatacagaaagttatatggatataataaccttaattttttaaatctcagttttcgtaggactttaattagttagacataggaagagtgcatcctgtgttataagttttctatttcatagaagaatttagagaataatataggaagaaagcatttgctttaggctgcgtgtggtggctcatgcctgtaatcccagcactttgggaggccgaggtgggaggattgcttgaggtcaggacttcgagaccagcctggccaacatggtgagaccttatctctactacaaatacaaaaattagccaggtgtggtggcacgtgtctgtaatcccagctatcctggaggctgaggcacaagaattgctggaacccgggaggcagaggctgcagtgagctgagatggtgccactgcactccagcctgggtgacagagcaagactccatctcaaaaacaaacaaacaaacaagcaaacaaagaaaaccattcagtttagatctttaagttaagatatattttttaattaggccacaacatcagtcagaaccagaggggaaaaagttaaaggagctgataaaaagttgaaagagttactatctcgggccctcttgaaggggagagaaagctgaaaacagcgagatgaaattaaagttgaaattttggtttatgaaaattaaaatgtcttgtaattttattaagaataaaccagtaccttaagaaaatttagttgttctaacaatttttttagtttattagtgtatttttaatatcaaagcccaatttctagaaagactattataaataattttcttttaattatggccaacttgatcacataaatattttttcataaattctctttttataaaccttattatgacttacacaaaccatttactgaatacttggagtttctgttttatcccaaacatcctcttttttaaataaccagtgattttattttaggacaaaaaatatatcacacaacatttttgtcatgtaaaattgttttccttttaatctttcttaccaaaaataccacttaatatttataactttttttgcatctcttttatttactgtttccttttaccttgttttagaaacgacctttaagtaatctttgaattagacaaaaattatttctttttaataagaaaacattgtttttcagaaaaacattttcctatatttttttttaaattggaaatgacccagacatttaagcaatatctattattttgtttaatgttactttagattctaaattatatgtcgttttttaacaagcatttattctattatatttatctaattaattttttaatagcttacttataaaaactgatggtcatcatttaaagttatttccctgctaaccaattttatagcctgcgaatttcaggtgtttacctatgtaaaaaacttaaggttaaataaatgtatttgttttttctttttgccaaataattcagtattaactgtttgctattaaaccaacaatattaaatgccttacttaccaaaagttacacaaagataattctcttttgggctgcatttatggctttataaccctcattccaaatattgacaccttataatatttagcaaacataaatataaaactacttgaccaataaatctaaacaataatatgtgttgacagtacttaagactttctaattttatttggccaataattttaaagccagcttatttattaaaagttaagtcatgtgaacttgaaaagcatttggattatttactaaatttatgagtactcctttatttttaagccaatttggtaccttgtggccacaacacataacaaaatgcatgtatgtatacataaacacacctaagcacacataaacagtcatgcaaataaagatcctatagcttttacttcagaactctagccatgatatatcaatacagactcatcagtttacaaaaaaaaagattaaatagaaacagtggtttttatctcaacaccagtagaaaggtcctctaaactagaaaaatacattttcttaagcaaaaaacacatcctcgcgtgttttataaactttaccaaaaacacatcctacgatacactactaaccctaattctccctgaaaaatcaaggattacttaatttaatataatatgactttaagtgttcaaattactggggacagttttgagactaactttaccaaattaatcttaccaaagattactaaaactatatgaactgaaaagcctctgagctagtttctattagtctgataaaaacttacttttctttaggccaattaattagaactctttcatataattggtagcaaaatattatttccacatgacatatctgaacatatagacataacagacccaggcagaggcagatcttatatatttaaaatttttcatttgcctgttttcaaaaatgttctttttcctacttaaactattaaagttgtctggagggaaagagggagggtatggtaatccacgtgttgcaagagaaaaggagcaggcaggggaatagtcaattatgtattcatctcccactcagtaaaatagcactttacaacagataagatgaacttagagtagttaccagtggagatatttaaccttttagctgtagctctctacttaggaacaaaaggaaaggcaactccttgcatgacttagctttaagcttaatttttccttttggcagagtgaattggggtgtcaggtttttatttgcctttcaaagtccccaccatatgacctcattttactaaatcacctcttaaaggccttatcttcaaatacagtcagtcatattctgaggtcctgggaggtggagcttcaacatgtgaatgaggaggaagggggacataatttggtccataacagcgctcacaagaaatcactagttaaagccataagcctcatatctaaggatttaaaccaggtcagcttattttaaactccataatcttaatgatcatctacttactgatttgtttatttgatagctatgaaacttatattttcatttgatctcactatacccaaacacccacatccctgttttttcctcattttcttaccaccaaaaacttattttcttcattccacagtggatagtcttcacattgccttgctgacacagtggcctgtgctgtatctgatagtatgcaaaccaagagtgcatgcacgcaaagcaacatacgttttacaaatacaaatacaaacaaaaagatgcacatagaacccactgggatcacttcttatggatatagaagctggagaatgagacctgttttttggtgtaaatgagccaaaatcagggtcacttttgttcaagctgttattgacttggttttcactgtaaacactggaagtagtctcgaattttagcccaggatgtacagcctcagagcaaaagacaagtaggtggaacacagcatcccttcctctagacaccgttacattaaaatggcaatcattacaagtacagcaagtatacttcataatgaattcattattctgttcataagctttttagggactatattattatcccatctaagaggcaggatccactgatcatgcttggtcgaggttggcttcccctgcctgtttgcgaatggtgccttgtaacgtggagacagggagtggggagagtgagggctgagaatctctactcagaggctttttcacactgtccagatatcatgaaataaaaataaatattttgacagtctaagagaagattacagtaacgtgatctaccttaacacaatagaacacagataataaggacacttgtaagaaccagaattcacaaaaggacaaatattcctctagattcctaagagtttaaactaagcaaaaaaatcctaagtggtgaatttttaaagtgtcttttaaaatttcactaattcagtaaacaacatataaatggattttttattgctttcactggtttctttgtattctttaaaattagaagtgtttctcttttgtttaatgaaattttactaatggttagtccataatttaacataaacactttggttgtactctttaaatactgaaatagacaaaataattgaagtttctgaaactggcaatcgttataagcacagtaaatacattttataatgaaataattattctgttcataagcttcttattgttcatttgatattctgaatcttttatctgtaaatgtgagccattctgtccagagcttattgcctctttaatatcagatctccaaagaaagactcaaattccatacacacgaaaggcatatattatccacatttaaaagatggcctgtttttttttcccaaaatgttaaattttgccacaaattattttatagtgtttgtacacttctgttgcattgggaggtttttaaaaattctatttctctgaaacagttttaatcattctagtaatcgttgagacttgattctagaacttgttttaaaagtcttagtggatagttttctatttatctatttggattctttgcacttagatctgggaaccctttattatcttgaattttttatggatgttattgggaccaggaggtcatgtgagtgctcattcagtgagcactatgtagtgttgtagattttttaaaaaagaaaacgtaaggagccaggctttcaacccaacacaagggtccttttcctgatcccctaggaatgtgtctggttacagagagaggctttcctcaccaaaagtctcatgcaggtgaggtcaccatgtgaggtgactttggtgccacaaaagcatgtttctctgtgtgtgtgtgtgcccatgtatgtcctcaagtacacatacacatctgtttccataaaattctttctctttataatatccattaaatcttaacaagaaatgcaaatttagtacctaaatattgaagaggcgactaccacaggcccattagaaacatgggccaatgaataaagtataatgggaagctgcaaatactgagaattgaacaaaaagaaagatgcaaccaaacttgccacacacagctaaagcagcacctacaaaacagacatcaattgaaaagaggaaagccagaaaatcataagctaagtatcaaaattaagctagaaagcagcaacaaaataaacctccaaaaagtaaaaggaagaaagcaataagaattaagaaatgtaacaaaatacacaaaaaagacccaacagagaggatcgacaaagccagatgttggtagttggcctgcctaattacataaacgatctctggaaagataggtcaaaaataaagaaaacacagattaacttgtagtagaaaatacaatggcacaattacagatacttcagagatttccgaaaatagtaagggagcattatgagtaacatcatgccaagaattgcccataaacacatatattcaataactacaaccaaacatgataccaaaactgactcaagagtaaatagaaaacctgaaaaatcttattgttaatacaacatgtcaatagtaaaattttcttacagcagaaatacccaaattattattcttttttttttttttgagatggaatcttgctctgtcgcccaggctggagtgcagtagcgcgatcttggctcactgcaagctccgcctcccaggttcacaccattctcctgcctcagcctccccagcagctgggactacaggtgcccgccgccacgcccagctaattttttttgtatttttagtagagacggggtttcactgtgctagccaggatggtctcgatctcctgacctcgtgatcctcccgcctcggcctcccaaagtgctgggattacaggtgtgagccactgcacatggccagaaatacccaaattcttaaataatgagtatcctaaactgcaggaaacttatcagtccaatcctaagtataattcacagagagcagcaaaagaggccacactgcctcttatatcttgaagccagtctaaatttgattctaaaaccagatgagaagctgagacagaaaagctataaacaatctcacaaacttaaatgtaaaaattctatgtcaaacattagcaaataaaatccaatgagattttaaaaaatatagtataccatgtccaaactgtgtttaatctggatatggcaggatggtttaatagtagaagatttttaaagtgctagtcaccatgttaacagagaaggagaaaaaaagttatcatattagatgcagaaaaagcattagataaaagtcaacaacatttcaggacaaaatgtcttagtaaaatcggaacagcagagaacttcttaatctgataaaaggtaactaccaaaaaacatagtgaacctttacttaatggtgaaatattagaagcactccctttaaaatcagaaaaaaatgaggattcccataatctgcacttctattcaacactggactttcctaacctccataataatttaaaaaaaaaaagataaagaagtaaacatgtaaggatcagtatggaagacataaaactctcattgtcagatgatgtaacctcaataaaaagagaatcctcaaagtattattaataaaagaacccagcaagatgtctagatacactaacatttttaaggttgcatttttttacatctacattaaacagtatgtgtaatttttacaaaggtaacactctttataatagcaagaaaagatatgtttactatgaacaaacatatccaaacctgttcagatttatatggagaaaattctataattttttggaagtcattaaagaagtcctaagtaggatgatatgttcataaagaagactcgatattagacctcagcacaattctaataaatatcctggcataatatttatatgggccaagaatagccaagataattgtgaaaaaaaatatagtgaggaagttgcctccttaaatatcaacgtgtgtgtgtaaagtaaccacgactgaactcatgtagcaccagcgcgggcacagatgggtagagcacattagaagagagagccagaaacagaccccacatattccaattagggcttctaatgtttacagaattgttgcaatccaatatgacaagataagcaatctaacagaaaaatgaacaaaaaattctttatcaaggaggaaacagatatgcttaataaatacaaagttactcaccctccttagtaatcagaaatgtaaattgaaatcccagtaaaacactataggttgtttacaacagtctcttcatactaaacgttgaccaggatatggaagaggagctcgcagactgcagaactgttgtggagactgatttggagctattgaatacggccgtagatagatgctttcctccaaccttaacatagctcaccttgtgctattccattggcagatgcatggccgacgggcgctgccactaggggctccaggagtatgcacagggatggtcccatgtccacatcagtgtagtttgtctatcaataaatgggaaatgatagaatgaatggattgggatatgtgcatgcactaaaatcccaggaggtcatacaaatgagtgagcaagagccctgcgcatgaatgaatgtgaaactcataggtctattttggggtaagaaagcaaattatagaaacatgcatggaattataaaatttaagataatacatcttaagtttatggtacagtatgtttagcagtgtgcaaaataatatagattgcttagggatttggagagaaaattttgtagaactatgtaagagtaggaacacaaattcagccttgtggcctcttgtgtgggacagggagaggaagtaggtgagggacaggaatatttaacttttattaatacttataatttaagttttatttcataagcagggggtggtgatttattctttacatcttttgtatggctttaattagtgcaaaattttttaaattaaaaaacagctggaaggcccctgctgagaatgagaagggaaagtgtgatctttgtggacaaagggcagagttctactgatagccataaatattcacatccctcttggtcccctctttttaagtctaggcacagagctttctctaatgcagagagacccaaaggacctccccccacaaccagtggctccccataaaatgcctatgatgcaagaaaattcctatacacacacaaaattaggtgcaattttcttccacaagtcaaagaaagaatatacactagacagcttattattcctactgactttgtctgtctttaaccttaaaacaaaaataaaggctcaatgaccatttatagataaatccagcctctctctcacctccttggtaagccacatctcagcatcctattttgtgctcactgggttctgtctttcagggactctcacgttttatttgttttcaagcctaagctactgtcagattaacatttcttctctagtttgcccttaggatactttatttgctacaaaattgctttgtgatggtgtcaccacactgccaatgaagcagagcaatggcaattaccataaagcacaggcccttcaaaggccagcccagtgagagtttgggtccgagttctgcagaatgactaccagtgtgagtgctctgtgtgcagacaggtgaaagaggacccctgtctgcagcccagggcatcctggccttctcactcattagcccttgggattttcaccccacacacacttactgatgccagcagggccagtcactgtgctgtccctggaaagagagagaggagcaaatgctaacctctgtggttttccctcttgacaccaattctccaactctgcagacaccagctgggtgtcctaaactcactcctattctgactgtaactacctagaggtagcgtcagactccacagggttaagggctcagtcccatcagccggcccccacttcaaatgccagttacagtgttgggtctccaggttacccacagttctgtccaccgtggctacaaactcaggggggttcccataacccttgccccaggttcagtaacttactagaacaactcacagaattcaaaaaagcattttacttaggtttacaggttataaagagtacaaacaaagaaatgcaatggcaaagtacaagtggggtggtaggtcacgtggcttccatgccctctctgtgtatgccaccatcccagcatcatgaagcatttaccaacccagagctctccaatcctgccacttaggagtttttaacggagtttcattcagtagggatgattgcttaaatcactggccaactcatctccagccccctaccctccctggagattggaagccatcgaggagaccccagctgccagctatcttattaacatgcaaaatgaacccttatcactaggagatctcaagggttttaggagctgtgtgccaggaactggtaacaaagaccaaatatttattttttattctaagacgccctccccaggtacttggagcagagacagggccgtgcaggcagagtggtgttcagggctgggagcaggtgcctgagctgaggcaggtggggagaggggagaggtggtccagtctagggtacttggttatcagcccgttcatttgttctctaaaaccagggtgaaaaagagaacagacttaacgggagcctttagactggaccccacttacctgaagcacagccatcaggattcaggtaagctgtgagcctgctttctgtggactgtttctggtcttgttcccctcagagctgccctggaggtccctgggagttaggggaagaccatccatatccaaggaggctttcacagagaagacggggtgctgtgcattcctggatttgcccttgtagcccactccctgtgggttggttaagaggcttggggaggctccctgggggaggctcctgctctagaagcactgagaacctgctgggctcattgcaggagcaggggcaggtgggcacagccatgggattttaatatgggcatgcatactgcctgcagacaaggaaacgtctttaacataatgacagccataatgtctacaaaaaggctttgcatcaccttccaccaataccatgagggggcaaagtaaatgaagaaggttgagtagggttggtgagggaagagaaaataagatgaagccaaggctcagatcagcacacaaaggtgcacctaagtcatttggtcagtaggcctgctctctgtgcctggcgctggtgacagccaaggaggctcagcacccacctgcaatgtctagcagggaggggatgagtgggcagttatcaagtggcatcaggggacacaggctgctctggggccacagcacggaatgcacaattcttggcttttgcacttcacctatgtcgtctcatttgacttgggccagtgtatctggctaattaatggtaggcattgaactagaaccaaaataaatagaatttttttgataactgaaaattctgtcacaacgctggtgaggaggtaaagtggttacactagtcatgtaggctttgaagatgtattccttattattaaagatgtacatttggaaaatagagtcaacgctgggccagaaaattcctgtaatcccaccactcaaatgcaaatattgctaatatattgctgtatttcttaccagtcttgttcaatgcattgttcgctttgttttaactctgcaccacttaccaattaccaatatacaagctgcccttcccacatgtatctcatgaagttttacatcttatgaggcacataagacctattaagtagtccacagttcaagtaaaaccattgtcagaggaaactactggctaagaggtttgtcatttctttatgttaacagtaaagaattgtgcaaggaagcttctaactgggccagttctttactcgtccataaggaagtagattcacggagaagcaaataggaacttgcactaattagacaccgtatctgaattcttctactgaaagcctccagtttttctttcctgtagaagtttctgcaatgagggaaatttataattctgcaccacccaatatggcagccaccagtccgcatgtggctactgagtgcttgaaacatggctcatctgttgaagaactaaagtttaatttcctttagttttaattaacttaaatttaaatgtcaacagccacatgtggctactagctaccatatcagatggtgcagtaatagaaactaaaaaggtgggccattccctcattttcattcatgacaatcatctggttctttgacaatttttttttttgagacagggtttggctctgtcacccaagctggaatgcagtggtgcaaccttggctctctgcagcctccacctcccaggctcaagtgatcctcccacttcagccttccaagtagctgggaccacagacgtacagcacaaggcccagataattttttgtatttttttttttttggtagagacggggtttcaccatgttgccaaagctagtcttgaactcctgagctcaagcgatttgcctgccttggcctctcaaagtgctgggattacaggtgtgagccaccacgcctagcctcgacaatttcttactgagtgcttcctgcatgcactctgttgagtgctgttgtttcatttgcagtggtctctgtgaatcattgccagatgctgctattgatgttatgtttgtttaacaagctcccttactaatgagaggccatgtgtcgtaaaggagagtactgtgtatgggttgagataggctgtatgactttgggcttccatctcagggtcactcataaaacagggggtggaggtcttgcatctcctcccagcactgccattttttatgctagtggagaaaataactattagggaatgataccaagtggtgacttcagatgttcttgtaaatacaatgtaggcactcctgtgcagtggatgaagtgcagggtggggcgtgggttgtattaggtggacagcttgtcccagctgagcatggtcaggtcctgctatggccctgccacagcccctgttgactgcggaagtaggggacactgatgtgcctggtccagcccacattcgtggatctactcccagagcacgagactcccttttccaccgatctgtgcagcaggactgcagcatgttgtcataatcctcacctgatgtcttgcgcaggatcacttgtattaatagaaactcccgtctctgagcctgcatccagggttctttcttctttatggtcctgggatttgctgctttaggcatgaggggaggctcaaaagcaaatcatccatttttcataaccaatgtggagccaatgattcctggatgttaaaactgactcagcagatattcactgagtgtctgctctgtcccagatactgaactaagatctgctaagatccacggatacagagatgaataatcccaccaagagtttcattctcctttttaaaatattctaatcactccgtatatcacaaattcaccttcccatgcatgaatgaatgaatgatgaacgatttacgtgatctgaatgctaactctctactgggcactagatgaaacctcagatgttcatgctatgtaactgcagaaagcaaaactaatgggggtctattgagagtgtaacatttccaatttgtgttttgggcatcctgttctcgggacacacccttagaatatgttaccctgggaagtgccgcaaagaacacccagacccagcctttgggcagttttatttctggcttagaagacacaagaaatttacctggaaaatgaaaaggattagcgtgtgatcaacaaacctgtctaacgatttcttttttctttttctttctcttttctccagggcttatcactgactaccgggtaagtgggagattccactgtaatctcaaatgctagtggagtgctggggggtacgccacagctgtcacacatctcctcccccactctcatgatcagcacgcactggtgggcaccttctaactgggtcctaactgacaaattaggggggtcctgccaggtggcgggcagctctgctgaaccccccagtcagaggtctcaggttaggagggggaaacctggaccctggactttgctcctggggaggagaaaggagcttcggcccctcattcctctggaaggaaaaggcccttctgccctgggctgctgtgtgcctggggctgcactggtggtggcagtgggagagtgagggaggagtcagggaacagcaaaagctcccaggtggggccagtcatctcagcagcctagtctcaaatgcattggtcctctctcgtttttatttgaaacaagtgttgaatgaggcatactttgaaaatgccaggttgttctagtgttagtctggaaaggaatttgggaccaaaggcagtactgcgaagcttatcaaaagaatagaacccaagggggagggtgaaactcagggggaacagaggtgtggccactgagctggctgtcttctgccatcaagagatgacctgtggccgggtgctgtggctcactcctgtaatcccagcactttgagaggctgaggtgggtggatcatctgaggtcaggtcttcgagaccagcctggccaacatggtgaaaccccatctgtgctaaaaatacaaaaattagctgggtgtggtggcaggcacctgtaatcccagctaccccggaggctgaggcaggagaatcattggaacctgggaggcagaggttgcagtgagccgagatcatgccactgcactccagcctgggtgacagagtgaaactctgtctcaaaaaaaaaaaaatgacctgtgtccacgtgtggtgggcaccagacatcatcaaagcagaggctgccatttcccgacagaggtgtgtgtctaagtgcgtttggagcaaacattgtcagcagccggtgtgataatgacccagcaggggcttcccctcaaaggcatgggtagcttgccttcttcctgtgacagctgtgagccaggaggcaggggggcagcagtaaaccttcccaagccatcaaggctggtcctaggacagttttggcaaagtttgcctgggaccacccagctctacacccagggagaaaggccagggtgtgtgcacataagggcacactgggaagatccatggatgatgccatttaaaactttcatataatcccattgtcaatctgacttatcttttggaaagttattattgaagggaaaatatgacaataatattaaaaataacctgaggaccagctcaccctgaccttgcatcctcgcgccgctgtggcctgtgtttctgtctcctcctctggttcatggcctttctcagacttcatgttgcatgagggccatgtgctgtacaaacgacattgcagctggttctcatggcactgaaactaaaattgcaataccttctccactcctccacagccttagtaagtacagaaaatctacacagaatcccatgttatatggtataattatttccctgttatttaactacttccctgggaaagtcccttgctttcctaaatgactatgcagtgggcatctggcacatccagctttctgctgaggatgagctgcttcctgcagcatgagactgaaaatggggtaacaggcacgaacacttcatgccttttattttattattttttaattttgctctttcccagcttagatatcattagaaaaaaaggcacaacaccatctctggttcacataaaataacataggctttgctaaaaactccgtattgactaacaagtcctctgggaaccaaagtccttttagataaacttggcactgtctttcaaaggcctggggcacaatccctagcaatgctggcttatgttacattgcccaagacaaaaaccagcccagctctgcccgcatctagcagctcagggaacatgatctcctcagacagtttctaccgttcaccaagaatcacagatctgtactggcacccgcctgcaggaccacgaaggtggcagggcttgcctgaggcttccccagcctgttcttctgctccatccagggccttccagtcctcagggctcactccttcttcccaaccctaggttcttcatcctactccctccaccaccagtccctgaccctcatggggtctttctgtccccttctgtctttagtgctgagcctcactctcctcagcacctcaggccctttccgcactgctaatccagaagacttgagcccaccattcaccctgccttgataggccaagcattctttgaaaagcgtttgtccttctgttacttcaactagttatctctactagttatctctactagcttaatgaaaggcattggcctcggttaaggaaaggtcaagcatcagcaacctgtgctccagccctactttcaaagcatcctttgatcagcccctgtactccccaccctgttggtcctgctgtgagacctgggtctctttcaccccatctcaaggcagccccttgactggcactccctttccaaccaggagctatgagctgctcctgcagctactcagaggtgagtgaggcccaaagccacctccaagactcccaggccactgagggagacagaggcgcagaccacgcaggccctgatgcctgttctgaaacacacctgagacacctcgatcctccagcctgccctttgtggcccaagaggacatgccccaagtccttagctagtcctctgcctgccagctctcctcttgccgcttgtggcaggcaatgatgctgagatccctggcactatggctggcagtgcatgagtcaggagccatgtggggacagtccttgtttggctgcctgttgcttctaaaggaacccaggcagatgggaagcaccacagcagcccagtcccactggcatccatccaccaggcttgggaggctctctggggtgattggccttctgtgctgctgtgttcctagagagggctggagatggcacatcatgtgttcacagccaatgtttcatggctgatgaggggacaaacgcatgaaccttatgaaagatggaatgcagaaggtgaaagctgttctggagcagaggggcttctaaatgcgaagcacaggcattaggcctcagcataccagccccaggaagcaggagtggccatgtggggacagccccgggcagccaccgggaaagcacacacaagttggccgggtgtgagtatgggagcagcctcagggccctggtgtgcagagcccccagggcacctctcagcccagctttgctctttctatcccttgggtgcaggcacaagtgtcactgcctcttactgaaccctctccatctgccacaacccagggatgtccctggccgtatttcccggcatcttctctttgctgctattttagctacaatgcagtgacctctttccctctctgtgctcacatgcacctctcaggctcctctatgattcccaccttgagtgtgaattccaggcaaatgtccccagagcatttgctttgctgggctcagcagggaatgggaaggaatatcatagacattctcattttgttcaaagaggctggaaacccaaacctaaggcggtctggggagaagatccatcagtctggggagaagatccctggatggtgggctgcctactgggccagtgagaaagtgtggggtgaaaaggatgagcagaccctggtagttctatcccccgtcagtagatgagggcacgaggacagagtgttagtcccaggaggaggctgttcaggacgcgaggtatggcaagagagctctgtgttctttctgatggtgaacggcacactgaagatgtaagacagcaccatttgcctccagtttgcacggtcctgggtaaagtgggcatcattatgcctgtttcataggggaggagacagaggttcagaaaagtttgctgaacctattgaaagacaggaccacggacctaggtcacaagccactgagccatgcagccctgcatgctatttggatgaggaaactgcatcttctggaagatgttgatggcttatcaaaaatgggacaaaatacaggtttaaaaatgatcaattgtggaggaaaaagtaccaggaaatagatcatttgatgtccgggaagcatcaaatatgaattgacttctacataaagaatcctttcagatgacccatgaatgagggtcaaatgggttttactcctgatttatttaagtacgtccatcaacaatcttccacaaaatgtgggctggccgcgccatgccaagccaggtgctgggcttggggctgggactaaaaaggcaaatgagacagagtccctttcctctgggaacttagtctggcaggaggtgaggctgggtacacaggggtcacagctgtctactgcaggcacccaggagcatattgggggaggggacagtgcatcgaattcagtctctggagagaacatgacaacatttggagccacatttgagtgagcattcaattagattgtgtgcattttcactccgggaccacagaaattaagtttaccttggtattcttccaaatgttagactgaaatctaacattttaatttgtaggaagttgaccagtcgaggaatgattttggaacacagcgcccatgctgaaccatggcagggaagcgtcgttttactgactgttagatagtcagtcagctagtggtgggataaggggttcttcttttagatttcccaaaagacaagttagcttagttcttgagcagcccaacagcttgcaaacagtgctgaccagcagacaactgtgtgtgcaggttcggctcaggctctgctgcatgctggcttggtgacattgggcaagtcactctccatacctgcttttgctccaagaaagtggggatccgaacccttgtttacagtgctgctaggaagctcaaaggagataatgtgtcaacacaccgggcagggcctggtgtgcaactggggggaaccacactgaatgcctgagtcagaggttgggtccctgtttcccttttgacttgagaagctcctgcagaaccatggctctgggcccttgagctacttctcttgtgttcagaagcagttgccacctgttcattccacccacactttattttatttatttatttattttgagatggagtcttactctattgcccaggcttgagtgcaatagcgccatcttggctcactgcaacctccgcctcctgggtcctgcctcagcttcccaagtagatgggattacaggcatgtgccaccataccaggctaatttttgtatttttagtagagagagggtttcatcatgttggtcaggctggtctcaaactcccgacctcaggtgatccacctgccttggcctcccaaagtgctggggttacaggcgtgagccaccgcatccggccttcacccacactttaaaaaacacctgcaagccctcctactggggagcagtgcgggactcaggactccggctaagcagtcccacccggcagatggcccagctgcgctagagtgtcgcgcctggctgcactgtgtcacccaggcccagtagggagctggctcagctctcctcagtgtctcctttatagctgaaatagaatatgactgttaagatgaccacgcagtgctgctatgctcacttcccagcagtctcctcgtcccagtccttccttactcacttcaccacatctccatccctcagtgtgtgggggccggtcaactgactgggtctgggaaaaccagaggaaggacagggaaagcttctggagcaccagcatggagacacacattgtgtcttctgatgaggggtcttggggtcactccatggtgatcagtaggaccaagagggaaccagtattgctctagaaaacagtgccagaacatctggggcagaagtggcagacaagagcaggttctggctccctccttcctcgtaggcaaggacatcaatgaaaattacccccttatccccactggatggtgagctcactgggggcagggccgtgtcttccctgtttgctcaccacggaaccctaggggacagcccaaggtctggccctgctgtgcatgccgcaaacacctgttgagtgaaaacaatgaacatcactggctcccaggtcaacagtccccatctgtgttcctttctcttggagatttgcaaagaaagcctctgcccacatcaccgagggccctgccatccaagacaggccatggcaatgggagcagggtggccaccagggaatcggctgcctccaagagaaataggcgagccggtgagccgaaaaggaagccagcttttaatatcttcctcactgatggtctgtttcatgtttcatttcagcattggcagataccactgggcagaagatttcgctctttgaaaatgtggtttgtatttaggatgtatggagtcaaaggactgcaggcttatatccgcaaggtgactttgtttttattatttatcacggtaaaattgcggaggtctttcgggactttagaaataaattcaaattttttttcttttttttttttttgagacagagtttcactcttgtcccccaggctggagtgcaatggcacaatctcagctcactgcaacctctgcctcctgggttcaagcgaatctcctgccttagcctcctgagtagctaggattacaggcatgcgccatcatgcccagctaatttttgtattttaagtagagattgggtttcaccatgttggtcaggctgatcttgaactcctggcttcaggtgatccacccacctcagcctctcaaagtgctgggattacaggtgtgagccactgcacctggccttcaaatgtcttaataagcaaatacatggcaagagaaccagactgtagtttgggttgttgagatgaggttatttataagatctgttaagtcactttcgttaagattgcaggttatcaggtccaggaagatggtcacagtagaaacatcacataggttgtgctttagccacatctagccaagaatgaagttcattgagcaatggcaattatgagaacataaggactgtgtttttctcccccaaaattgccagaataagatagatattccctagtccagtggttctcagacatgcttccagaccagcagtgccggcctgcagtggggcccagcaacctctgttttaacaagcaaaccagacaccttctctatgcactaaaatttgagaaccacttatcagctccaagccccactcccctgctttttttttttttttttttttaaataacaattggctgggtgtggtggctcacgcatgtaatcccggcactttgggaggccgaggtgggcagatcatgaagtcaggagttctagaccagcctggccaacatagtgaaaccttgtctcctactaaaaaaaaaatacaaaaaattagccaggcatggtggcaggcacctgtaatcccagctactcgggaggctgaggcagaagaatcacttgaacctgggaggcagaggttgcaatgagcagagattgtgccactgcactaaagcctgagtgacaaagcaagactccgtctcaccaaaaaaaaaaaaaaaaaaaaaatgaggaaactgagtcctgaatatgagcctggatctgcctagagccacccgtttagccagctgcagaaggcctgctgctgttctgctggctctctctgatcctggtgtccttcctaagctgtggcctcatcttgatggacagaggtccccaggcttcatgggaacaagcacacttatgatattcagccttagtgatggtaacagccctccattttaagtcctgttgccacttcacaaccaggtgtgcaggggcaggtgtccccagccacctcctctgtggcacagcatatataaacacatccatctgcaagcttcatagaatgcctaggatgtgccatgaactgcctactcccaaagcttcggtgaggacagttccaggagctgccgagcactatgaggacctgtttgggggcgagaactgggaaaggagtatgtatatgaattcctgggtaggaaatccccctctacccatttgagacgaattcagcttttttggggaaagaaagccaaaaaataagggatttatctccccacaatgatgacgtctttaagctcaaggacaactagttatgatcatgctggctcctgtttaaaacacactccacttctttcttaaaggggacccaatcctgccttaggagcagagtccagcgatgctcaaagcctgtctccttgggcgggaaccggctttcgggatcgcccatgaggccgaggtctttggcgctctctggtggcatgacgaggaaccactcgtatgacacgtgtttttgtcccagccaccccctgcccgcgaggcgccgcgtttccgcaggtcctccccagcacctgcaacatgggggccctgctgtatccgcgggcttagaatgagcaaggcaccggcctacgccacggagggctccttctcctaggatcacatgctgtctgaatagcttctgagttctataactatttggaagtgaaataaggtcagtgtgatattcaatgagaggaaggccgtttctgaatgtgacagagcggacaggatgcccagctctaggtggcaaacgcggaggaggagcaacagctgtggcagccacagagctgcagctccatcaggctgccttagaatcccagctcagccaaggcctccgggtgcaccttgggcatgtcgctcaccctctcccagcctgttttcttatctccaaaatggggataatcatgatatcttctgtgttgtgggctgtcctgaggatgccgcagtggtgagcgctggcacctcaagcacagaggagcaactcgatgggcattagccattgtctcttccagaatgatcaaatacctcctcacggtgtttattctaacattataaaagacagtttgggtgggataagaatagtcccatgaacagaagaaaatgacaattggtgttctgaggacactagacctgtgctaatgtagggaatgagtttcttagcctgcctggaaacagctggtcagtgaacggtaaaagcacttgaggaaaattgccaagagcgtctaaatgaattatacatgggcagtctaataaggttttctaggtagttaagttctgaattaaatggccatgagaaaaacagattttccctttcctctttgaagcatgtccagctgtcccatgagtttgagtcactggtgcgccaggatccccgctttgaaatctgtgtggaagtcattctggggcttgtctgctttcggctaaaggtttgtctacatctattccattcttcattttctgtgaatgtgacagaggggaaagtgttgttcattacctccatgctcaaacactggcactggctctccagagatggcagagcaaagcctgcattctttggcccaccggcctgccctgccccatgctacacagccttgtttccacgcacagcggctgttcccgcttcctcaagcctgccatgagacttctaacttacatagcttattggccgcagaatctttaccatttttccttcctcaaggctccatcccacacctctgccactggccctccttggaggacagcggcctgtccatagcctcactaatctgagtgtcttctgtggatcaacagcatcagcatcatcagcattgtctgggagctccttagaaaagccagtcttgggccccaccctagagctgctggctgcgcacctttacaagatgcccacacaggagtctgtttgacactgtgttgtggcgtgctgttattttgctgcctgatgctgtgcattcaccaggtgagggcaggctggcccacacgggttggggcataagccatctctactgagaatcatgatacagttctcaaaaaggctctaagatgcactgcacacatgccccttggtaatctcccttgtgtacacagagccaggtgagaccaaatgctctgtttggtttataaggttttttttttttttttttttttttctttttggagacagagtctcccactctgttgcccaggctggagtgcagtggtgtaatctcggctcactgcaacctctgcctcccgggttcaagtgattctcctgcttcagccttttgagtagctgggattacaggtgtgcgccaccacgcccagctaatttttgtatttttagagatggggtttcaccatgttggtcaggctggtctcgaacttctgacctcgtgatccacccgcctcagcctctcaaagtgctgggattacaggcgtgagccactgcgcccggctgaggtagcttttaattcacaatcatttcaagcctttccaggaggcttccttgttcaaattaaagacagcactcaggagaaggagcaggctggggtcagtgtcattgtcaaggggctgccagtcagagtgtggcactgccactccacctactatgtccttttgcctcacctgactcttggagctctgaggcgaggaggagctgcagccgtgggaaagcctgcaggtagcagagcaggagaggagacttgagcccttggaagagcacaaagtgatgagacctgggaggtgcacagaggaccgagagggcaagacacgctctggatgtttgtgggaggagcctcagtccatccatgtccaggatgtgtctagtcaaccaaccttagtgttggcatcgtgcttattagactcatctgctgtcaagcagttgttttcattcttgtttttgttgacagttttcttctaggacttttatattctatttttttaacagttctattgagatataattcactttgttcatttaaagttaacatttgggctgggcgtggtggctcacgcctgtaatcccagcattttgggaggccgaggaggccagatcacttgaggtcaggagttcgagaacagcctgaccaacatggtgaaacctcgtctctactacaaatacaaaaattagtcaggagtggtggcacatgcttgtaatcccagctactcgggaggctgaggcaggagaatcacttgaacctgggaggcggaggttgcagtgagctgagattgtgctactgcgctccagcctgggcgacagagcaagactctgtctcaaaaaaaaaggctacgtttgagtatttttagtatatctacagaattgtgcagccatcaccacaatctaattctagaacattttcatccccctaaaagaaaccccacacccagtcatgccactttccccatcctcagggctactaatctgttttctgtctctgtaggtttgtctattctggacatttgtataaatgaaaacatacaacatattgccttttatgactgttttcttcacttagcataatgtcgtcaaggttatggcttttattttatttgcataatttgtagatgccaccaaacccatctgtgtactggtttctgtccattcttctctcatgccatatagtgagtcctctcatgaaggaagtccaaggcatttttcagctgacaaatgtttccttttgtaaaactttgcttgtgcctccagtctgcaaatccagtttctggaggaagcgcgttagtcaaacactgtggctcacttttctgcctccatatctgccatcttggcctcactctctcctggtctaatcctctctaatctgaatttcaggtcctctcatgctgaatgcttcagtgtgtcatgtggctctttactaaagcagaagtgatgttgctatggcatcacggtccctctccctccatcctcattatggccagaacttgcttggtctccatctgtgtgcactcagcctactttgttcattgtaattgtcccacctctgctaggcttcttgcctctacttcatggaagtactgccctatccagtctgtttgaaaatggcaagcacatttttcctaaataatttgcttccattttctgtgctctatactttgcagatgtttgctctcatactgagtctttttggtaaaattccattcccttggtatgataatttctttttttctctatcctcatccttgagtcctcatccagattcacccagccttggtgttcacccacggtttccaaatttcctctggcccatcactgtctacctgggcacaacaggagcagggcactcaggcccatagctagaggccaggggatttgcacagctctatggccaggtgccaacatccagcaggtgctcgtctgaggtggttccatgcagtggatagaactctctccttcccactcatcctccctgcttctccactctgaagacagggccacgaagtgcagtcctgtgaggtttgggtgactaggatgcagtgtcccacattcagttccttctatttaagactccatggcttagaagacatggagtcactgcctgcaaacagaagaaggacagaggagcaaagggagatggaggtgaagtgtcagaagaccggctgctatggaagcagggcccaggcaggacagcaagggcttcccattggcttattgataccaggcttccatctctagtgtagtgggaggggtggggcctctgcgcctaccccaggctggtgggccgtgcttgtctggagaggcaccagtggttgctcggtcctgtggttcatggacattcttctcagattctagcactagcttgaccgttatgcttcattttctaggttgctgagactcttctatgtttccgtgagaatttagagactcctcccctggtgccatcagaaaccccaattctgctgtttaagctcatatatttgtagattacatatccagggatccttattttccttaaaaaaacttagaccatggaagggtcatcttttgatggcacatcagaatatagagaaattgtctgtggggagaagatgcatgcagtcttttagggtgcattactattattttgttgaattttgtaacatcgtaaacgcaagggggatggttagtcggcttcttcctgatgtacggtagggttgccaagcactgtctttcctacatgaccagttgatttttgagtcctcagagacctgagcacagttcctctctttcaatccctccagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggtaggctgccctgggctcattttctgcctgtctccttgtcccgtggcaagagtgtcctcctggagtccagacccagctacaggcccagcccggccactcaatgctgccagagtgcatttccctcaccttaaaataaggaagagaaggccgggtgcggtggctcacgcctgtaatcccagcactttgggaggccagggtgggcagatcatgaggtcaagagattgagaccatcctggccaaagtggtgaaaccctgtctctactaaaaatacaaaaattagctgggcgtggtggcatgcacctgtaatcccagctattccagaggctgaggcaggagaatcgcatgaacctgggaggcggaggttgccgtgagccgagatcgcgccactgcgttacagcctggcgataatgcaggactcagtccaaaaaaaaaaaaaaaaaaaacaagaagaagagaaaaccatgttaattctggagaagtagaaggaatgatacattgtaataattcttttaaaacttagatttttactttttattcttacatcaatctctataatacttcaggtttcttcaaacagcatttgttgagataacttactatcataacaagctcatataagaaactggtgacctttagagaactaatgaaaacaataaaaagggaatttattatgactcacgacttgccgtccaaattcttgatggtttgaagaaaggatatgtttcgactaccgggcttcttgcagttgtgaggggtttacccctcatagttaaaccctggagacagcatgcagttaatttgtaaaaacaaagcacacattttaaataaatgcagtgttggcaacatggagggtatttaaaattatgtttgtgggaacctagacaaccttagaaagcctcttcattaggttatcttaagaatgtcatcctgttggggtatgtctacctttttctgtttattttcttttttttttttttttttttttgtctttttgtcccatttggtggaagaatctgtgatccctccttagggtctgcttctctttctctctctccctatcctttttgcaatggctcgttcattataacccgtgggggatttagaatctgtggatcatgtaatgcatttcctgattgcctacaatttttatcttctttgctgttgattttaattgtgaatatctgaaaaagtatagtgctcaacaagtcagaagttgaaaatcatgtttggtatatgtgatagacctgtccatggctcctgaaagttgaagccaaagggctaccttctgagtcaaaatgtgccctgagaaccaggtcctttccctggtgcaaccagggccttcccctactcataagctgagaaagacctggggtctgaggaagaactgctgacccagagcaactccaaagtggtatctcaagcatctctggaaggtagtggggagaggcttatatgttgaagttattccattgctctcagcataagactatgtgaggggagggaaagtaccgctgtaagctctgtacgaaacaaatccctatcaggcaaacgctcccgactcgcatttctgcaaccccacgtttgcatctatctcataagcatgtatcatatcaggatcttattgacatacgcccagaagaacatatgtggagagtgtagctctgaaaatttatcagcaaaggtgtgtttccgataggagtctcagttcctctggagtcattatatttgctgtagattcaaaaggtaaaaatgaaattcaatttttaaaaagatatgtgatacaatagtaagtcctaatgcatgtatgttgttttggacagattagaacaataaaaatcttaatatcttgattttacttgtacttatttgagtttattacacatattcatgtggtcatagctctgagagaaagtaggaactattcttattttacagagggtagaaaattaggcagagattctagttgacactaatacagttttcatcagagaagccagattggcaataaaaattcctttatttaagttcaaactctttggcattgcacaattgtctctgtttcattggagaaattatacgttcgttctttatattcaaataagaagtacatgcaattcttattctttatttttttaatttttatttttttatttatttttttttttattgatcattcttgggtgtttctcacagagggggatttggcagggtcataggacaatagtggagggagggtcagcagataaacaagtgaacaaaggtctctggttttcctatgcagaggaccctgcggccttccgcagtgtttgtgtccctgggtacttgagattagggagtggtgatgactcttaacgagcatgctgccttcaagcatctgtttaacaaagcacatcttgcaccacccttaatccatttaaccctgagtggacacagcacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggcaggcggctgggaggtggaggttgtagcgagccgagatcactccactgcactccagcctgggcaccattgagcactgagtgaaccagactccgtctgcaatcccggcacctcgggaggccgaggctggcggatcactcgcagtttggagctggagaccagcccggccaacacagcgaaaccccgtctccaccaaaaaaatacgaaaaccagtcaggcgtggtggtgcgcgctgcaatcgcaggcactcggcaggctgaggcaggagaatcaggcagggaggctgcagtgagccgagatggcagcagtacagtccagcttcggctgggcatcagtgggagaccgtggaaagagagggagagggagaccgtggggagagggagaggggggagagggagagggaaagggagagggagagggagagggagagggacttctttattttttttaatgtagccatatgctcatgctattttttttccctgtaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatactaattgtgtcagatgatcatcttgttctatgttgtatcaaatttattcttgtgatacagacattccctccaaagtagacaaagatacagcatccttggatgtttttaaacggcattcatttattcagcaaatgttcactgagtgcctagtatatgtcaggcactgttctggatacattaacaatacacaggttttacttgaagatgacttcaacttctgtggaaataaaattagaaccaagagtcaacctggagcaatgagatcgaggtctctgctgtgatgggaaggattctctggctttctgggccttgattttctggtccgacaagtctatctgtcctgtagtatcatgattgataagcaactgaagagtacttctgtaaacattaattccaacaaggatatggtatttactcaatctcactttaagttcactatctgtattgggaaccattttgcttttagaaacatgtgttttaatcctaagattagttattgtcctttgaagactacagaactatcaaaggcactgtcagaaagggtccttgggttattaccaagtatatttgaatttcaaagacctcagatatctatgtgaactaagtgaatgatacgatctgttactcaaaaatctggaaatatgtcagatgccaagtagttccccatctaatttagtcaggtcatttgttctctactcaacagcaaacaagacctgtcctccatcatgatgtggggacagaggctgtgtttttggggcccaccaggggccacccttgataggaccagtggagtgtggagtactcaggttgagttgaggctgggatgtctaaattttacaagattatttttcagcccgtgagttaagattgctgcaagggctccagtgtgagccaccaacatcattgataccagctctctgctttagtgggctcatccagcctcatccacaaatatacttcagaaagatggctgagacctgatgggagggaggagactgggtggcaggggccaacggggatgctgtacagaagcagggcaggaggccagcaagtgactgaagatttcctccctccgaactggctggatccttttgatggagagtctaagacatcagcttagacacagacccaacagagagaaaagcttgtctgatttctcgctcatttctaggtaactcatagcagttcaccccacctcctgacttctccaggttcctccataaagtggttctcagatctgaatcccccagccctagaaacaggaagaataacttcctcccagtttatttaacaagaacacacccatagcacttgctgtatgccaggcactgttacacgtgttttaaagtattaatttaatacttattttaaaattctacgatgcgggctcaattattatgctcattttacaagtgagaaaactgaggcattgcaaggtttagtgatttatcccaaggtcatataatcagtgaccaagctgggattggagcccagtcagcctggctctagaatccatgctcttgcccagtaaactatgctgcaaaagatgccatctgctacccaggattaaccatttctgaaggtaactggcagtgaagacatttattctcttctgggtaaagccctatctttgcctaccaaggtaaagtcttggaccctagaccatccctagggggcccctagaccccacatccaatgtggggaagtttttaaagttttggattattcagactaatctgtggtcaatacagagcatctttatttaaatacatattcaagttagtgtcaaaaagagtgcacaaagtgctgctggcactggaattagatgtttccttactgacctctggtatctcctgataacaggcccctcctgcttagtgttgggaaagtcccagattgatctagacacaactaacagctgatatgaaagatttgtcctggaatcacatgtctcctctctaaaatccagcaaacagcaatactccctaaacctggag

SEQ ID NO: 17557 - DNA, 116966 bp, Human
ggcctggtagaactgatcaactacttttggggggaaggagtcattgtattttctctccttttactatcctccaaaataaatgtcaggaagaggaaagagtaatacatcaagtcagaagaggaatcagagtaaaacacaaatgaaggtttttcagttttcttgatagaagctgcaaatcattttcacggttaaatgatgagccaaaaagataaggtcaataaacttgactacattggattatacttttaagaatcaaaagtataattaaatttaaagacatgcaaagtgggaaaaacatttgctacaaatgtgaatgaacttacttgcctactgcgtaaaaagctcgtcatgggagaagtggaagcaagtcggtgttcagtaacagagggttgggaggccagcgggccaccagggatgggtgctcacccagggctcagcctggcttgttttccatcataaacagatgagcagattgactcagagaatccaggtaactggccccaaacccttagctgatgagtatcagggttgtgattcattcatggacattttttactgggaaccccttgtgccctcaggatctagtctagctgacctgttaaaggatagcccaaaagaagaaatataaaggtctaattcgcttatgaaaaatgttcaacctcagcattatagacctgcatattaaaaccacagggtggggccactgcttacctctggaattagccagaaaaaaattccagaaaaataaacagtcactggctggcttgggtgttatgaaacaggcggttgcctccactccgggtagaagggtgagtgtgtgaagaagagtttgactgtgtgtatctagaatcttaaaaaagtgcacgtggcctctggcctagtccttctacttctagggatcctaagcaaataatcagaaatgtggacaaagttttgtgctcgaaggtgtttatttgatcattatttatgctgtctgaaagttgaaaacaactacagagtgtctactagagtagtctagaatatgaaaaaaatagtatttactgaagttttaaaatagttgaagacagggacaggaaaacacaattatttacacaatctcacttcaacagtgtctagttgtgtacaacaaaggtgcaaagaccacgggaatgctattatcccactgttgtatgatttaggctaattttctatctactctaggttagatatttatataaaaattttctttgcatggattgttgtaaaattcagaaaagaggaaaaatatttcagatgccaaagagcagactgggtgggaaatgttggccatggaattgcagaaactagatgggggatggctgaacttgaggggctggggctgggaggtaccaccctctcagatagccaggggagcacagctccctcctcagcgcctgttgcggaggttcttggggaccttgccctttcctcccagacactgtgtgctccaaactgtctttcccctctttcttagtggaaagcttacatttccaacaacctgtattttcattagtaggatattggtgaaatgaattacactacacttctacttggtggggtacactagagtgccgatggagatgattgttggcctgaaaaatttcaaaaacgatattaaaacacaatatgtggaagataattatgattcagtgtttatcaggatcatttgtaatccccatgtgactcaaatagagtatgcatgttctctacaaataattcaaacattgcacagatgcacatggtagtttttgtttttgttattctgataaaaagagaggttccgttttaattttttgttcattttttagcatacaaaaatataaatttttatacttagcaagttttacatctgcgattaaaaaatgaaaagaaagctatttcttttgaaaggggaaaaagagagaagctggtgaaaatgtctcccttccttagggctttgttcgttttattttgttttctccagatattctggaggaaggtgtgaacgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggtcagtgtgcacgcagcagagaagtgagcatccatcccatttcatgcgtgagcaaggagggctctgggcagagaaactgcttgctgggaagcattcaggcagaaattaagagtcacattcccaaggcctgctgcttgggcaccttgttgaaatcaatgtgccttttgagtttcttgggcagtttgggcactgcagagtggtgggaaggagtgtggactctgtagttcgagacccagaacagccgggacccactgggtgatgagggttgtgagggtaactcaccttcccatgcctcagtggccgcctctgtggcgagagccccgcttggcagagggagctgtgtgtgcatgttggctgtcgccagcacctcgcatgttggatgtttcacgtgcttcagtttgcaatctggaaggtctcttttgcatgaataggagggaatttgctgaagtcaactatgatatttgtgacaatgtattaatattagtagttctggggcacatcttatacttttggcacagttcaaacctttctaattacagtagtggtacatatgcatcataaagatgtcaaagatttttataaatctataagagaaaacagacatctctctaccccaagttagtcactgataatatttctttccccacatttgaatgtatctttcattggcttctggtcccatgcaggtgtgtttctagaattatgggcttaggatcataatattgctgttttacattttgcctgaaagtgttgttctcacactaatgtctaaaaaaatgccactgagctccttaacattttgtagagggaaccatttataaaacactctctagatgtttctgtcccaggtaatagaacgcccagcacttgattacctgtagttgttacagaaaatgcatgtgttccatggaatgttaattatttctattcactgcctaaatggagcagttggcaataattctctttgaattgctattcagggaaagctatttaagcccaaacacaggagtaacttttaactcctttgccaaacagcttgcaccttttcatgattagcttcccttatgcagtctgttttcaacaactatcattgaaaatggaaaaagtaagtaagtggaaaggaagtaaggaattgaggaagaaaggaaatgctggggaagctgggtgttgaaaagagtgggatgcttcttgtgaactcacagcctttctgctgcggtcctgtttttttaggacaaggtggagcagacacctcgcagtcaacaagacccggcaggaccaggactccccgcacagtctgaccgacttgcgaatcaccagggtaaggaatgagcaaaacacaagaacactcccagttctagctttgcagcagtgcccagatctgatattctaaaatgttgctcttgacactaatagattacaattctaacattggttcttcttttctcattaaggacagtgaattcccaaatagagaaagatccttggttctgatatcttcatgtatttcctttcaattagcaaacttcagtgagcaaaacttcacgatcagtttcatacgagttatctaggtttcagccgaaaggcaacttgatgtcacctattgaagggtactccaaggtgaatcctcttgattttggcatttttatgtttccaattaagacggttttgggtgtatgtactcttggtctttctctacctttctgtgattctgttccttctattaatatttaatttctgatgaggtcattgtgggaaaggaatgaaagggaactacctttagaaaattagactacttaggaaattagattgaataaatggaagctttgccgtaggatgaggagcctgaggattaaatagaatgaaatgtgcgtgtggcacgttgtttggcttattggagagtttaagtacagtaaatcacaggtcctagagctggtgggaatgtgaatattcagattttcttaaattacttaatgagaaaggttgactataaaaataaaagctgggatctgaccatgaagtcaaagcaatgttttctcaattgttagaagattcataaaagctgtcaaggttttctgtggcaagcataattttgggatcatcttttagaaaactttgaagtgacatgatgcggggaaagggtaccaatttgttagtattgacttcaaagcttaagaaaattttaacgtgttacgttgtatgctcacaaatgatctcatttaaatggaaataatgtaagccttggtgttaatgcttatataaaaacttaggttaatacttgaattaggaaaccagaaaaaattacactgaaagaactctttaaggcttaccttttatcctttgtctttaaattgtacactcaaatattctacagataccaaagtagttcaattaagggacatttgcagcacagaacgtggagcacattctgtgtagaagagagctggttctcttccctgatgtggagttacaccgtatgcagttgaaactgagtcttggatgtatccccacacctgaaacagggcttaaaggaatggatgaacacgtcactatgttgaaccctacctctgctccgtgaccagagggttgatacctttaagcacacccttgacattggccacctctcaatcattttacatacacatagcatgtaaaatgggaaagccaaaaggactcagccttgctcagacccaggcatgtccacagagcattgaatagtgctgtctcctcagggctgtggctcccaaagcggcatgggtgctgctggcctaggtcctagggaatacaaagggctgcgctttcccttctccggcagtgactggggaagcagggccagagccaggcccaccgtatccagccgagagctgtggtggggctcccctcttttcaaaagatgctggaaaagggccgttgcctgggaggaattgtagtgcatgtgaactcatggccaggcagccagacagagtggatgcagccctgcagccagagctaacccaagcagcctcccagtgcagtgacgcagactgcaaccttgcagtcttccatgaggcagcagctccagactgtcccgacttgaccactcagtggggagggggaggcaggaaaagaaaaacaaaacaatccacaaaccagcattccaaaagcacatgaagcagtcccatactaagaaatatggtatagctaacaaaaccaagagattaccaatttagcctatatgcaacaaaaaaaagtgtgaccatggctttgaaatatgtgtttataatgctcagacagatgcatgaaagaataatgtctgtaagacaaggcaagaaactatgaaacacaacaagacaaaatgaggcaagacttgggcaccctgggcaatgcctgaaggcaatgcagtgtactcccaagtgcaggatgcagggggaaggataaccatccatctacaatgttatgccaacatatcactgactagggaaggccaaataaagctttctcaggcaaagattgagaaaaaaatgtgtcactggtagtcttcaccaaacgaatgattattattttatttttattttttaagagaccaagttttgctctctcacccaggctggagagcagctcgtagctcactgcagccttgaactcctagactcaagtgatcctccagcctcagcctcccgagtacctgggactacaggtgtgcgccactactcccagctagttttaaaaattttgtagagataggtccttgctaggcttcccaggcttgtctcgaactccccaagctatcctcccatgtcgaccactggaagtgcttggtttacatgtgtgagctgcagtgcctggcctagaagaatgatgaaaagtacttcttgaggaagacggaatgtggatactagggaaacagggcacatatgggaaaataatatgtgatgaataatcaattgtgtatttaaaaatattaggtgcgtctaaagtattgactgtaattactaaaagaatgtgcatataatctatagttcccaacctagcagaaaaagatataagggaatatatatgaaaaacacaacaacaatcaaacaacatcaagtagaaaacggaagaaaaaacaagatgtgaagagaaaaaagatattaaacaaaatacaaaataagatagtaggagtaattccaagtcaattcgtgatagtgttaacaaactcaagttaatagacacacatagctccctctacccaacagacagagactcttgattcttttctaaaacctgtgtaactttttgaaaagttgacggtatatagaaagttgcactgaattttaagcaatctatttcatgcttgttctttgacccagtgtgaataaatcagacgtcaacataaaaagttgaaaacaaatcacataaacatgcatgaggaaactttaaaacacacccactcttattttacttatgagttagagaggaaattgcaatggaaatatcgatcatttagaactgaatgaaagtgaacatagtacaggtggaaagtcatacaatgctgcaaaggtggtaaggctaactttctaagcttcaaaaaaagaaaaattgaaattacagaaatgaaatagaataaggaatgtagaaggaattaattataaaaattaaagtcagaaattgttgaaacagagtaccaataggaacaaaatcaaacaccagtctttggtaaaaacaaccataacagcaaacctgtagcacagacactcaggagggcaaaaggtgcccaagaaaatcatggtaagagcacgttagcaagttttaaaaacagcatcaagaaaactgtgaacgaaaaaatggaaatctgggggaagatagatgatttattgcaaaaatgtaaaaacaaaatagactcttgaagaaatataaaatcgtaatagagaaacagctctggaagaaattgtaatcaatactataccttcaaaaatactcaagtggtttgcagatgagtgatattaaactttcaagaaagaaacaatttctcttttttttttgagatggagtctcgctctgtcatccaggctggagtgcagtggtgagatctcggctcactgcaatctctgccacctgggttcgtgccattctcctgcctcagcctcccgagtagctgggactacaggtgcccgccaccacgcccggctaattttttttggtattttttagtagagacagggtttcactatgttaggtaggatggtctcgatctcctgacctcgtgatctgcccgcctcggcctcccaaagtgttgggattacaggcatgagccaccgcgcctggccccaacaatttctctttttaaacatgctaagagtgtgtacactcttaaacacagaggacaacagcttacacagaggacgagatctccaattcataccatgtttgtgtatctttgaaacagtacaagaaatcaaaattataataccgttttacatgttaacatagaacaaaaggtctaagtaaaacactaatgaaccaaattcagtaccttattttaagtgaaatgtaaatgaaacaaatgttatgaccaagttggttttattataatagtgcaggggtggtttactatcataaaacagtgaacacactgaatatgtcagaattaaagggaaaaaaataatcatttcacctggcagaagagtatttaatacaactcttcactcattataatacataacaaataataacaaaatttgtactcaactagtactgaaaagaaacctccttaacttgttaaaattcatttgttaaaaacctacagcattgcatcatacataatggaaaactgttagagtcatgttcatgaacatctagaattagacagcagtgcctgctgtcactggaggtcttagtgtaataaaagaagcaaatgaagaaactaaaatgtaaacattagaaaggaagactgaaatatgtgtctttttgcaaataattattcaaatagaaaatttacacagatatgttagcacttttaaaatgagcaagaattctctaagcagatataatgtgagatcaacatgtaaaatggaatagtactcctgtatgccaagaaaaaacaattgggaaatgtaatataaaaagaaatcccacttataatattaacaaaaattataagctatctaggagtatattcaggaagattaccaggcattataggatgtttcagagcatgaaaacaacctgagtaagtggagagctatattatgatcatggatcaggagacagaatatagtgcagatgtcacattttctcaagtttatctttaaatttaatacagttgcagccaaattcttaacagttttgtcacatgtgacttgaaaaatgtttcctaactttaataagaaagagtgaaactcaagaatttgaagacaaatttgaaaaacaacaaggcgtttggaggattgatttgcactatcagatagcaatccctcttatgtggtatcacaactaagaaaggatgttgttagttcaaggccagacaaatagaccaaaggaccagaatagatatcccataaggagacccacacatttatggaaacatacagcacagtgaaatcacggcagaacagagattacaggaaccatgactgttcacatggggtggcaaggaatggaaccctgctgcgtattctacacaataattggtttcaggccaattaaataattaaaagtgaaagaacaaaatgccttttatttgtttgaatgacaagaattaatgaatagtgagaatctttattctcttaggctaagaaagacttttgtgaataagacttagcacaaccataaagggaaaatggtaaatttgactgtattaccattacaaatttctatgtagacgttacagatgatatttaacatgctgaaaggcgcacttcagcctgggagaataatttgtaacttcttgcatgtacatacaaaaatgcatgtaacatgcagagtattagtatcctgtttatgtaaaaaaaatcctataaataaaataagataaacaattacatagaaaaactggcaaagaacatgagcaggcagtttacaaaaaaggaaagcatgatgtgtttgtgtctgattctggatactcatttcacaagaaaaatagggaaaccaactgagctggaaatcaaggaagcctgtgctctgagggctgttagatggaacagaaagacacagatccttcttttaagtgggtccaagtgcagagtgttcatcctccctcttggcgtgttcacagccctgtgagtctgtgcagaatggacctggggcttgcagctccctggcactgggtacaaaggctccttccctccctggggtggggtgggggtggttcagcccacagcacagcctacaggagtcagtgccttccctttcccatctctgtgcctgacaccaagttcaactttggggattctttttaacgagatgctttgggacctatgaccaaatctaacaaacatacagtgcggttctttcctgcttccttaattttcgaggcataatcagatgctgccatcataggctgtagctttacatggtatgtttgatccagagtggcctggatccttgcatggaacctgatgtttagaataaaagattagctgtgactttccttgacctgttactgctatctggcaaagaggatttattgctcctgttttattaccttgttcctaactaatgtaagcagcttatttttgtgtgacagttgctaaaaatgcatcccacatttcttagcagcacacagcagagagggatgtacttttctttgaaagggggtggttttgcaatagctggaattacttttgacgattttgaaaaaacctttctttattaaaaatatataaaacaaaattaaccattttagtcgtttgtataagtgtacattaagtggcattggtcatgtgaacagtgttgtgcaaccatcaccatttatctgtttccaaaactcttatcaccccaaacagaaactctgtacccattaagcaataattctccccagtccctggtaacctctaatctacttcctgtcacttgatttgcctgttcttagtacctcatgtaagtgggaccatacactatttgtccttttgtaactggcttcgctcagcatgtcttcagggttcacccatgttgtagcatgtgccagaatttccttccttttgaaggccaaataatattccattgtgtggatggaccacattttatttttccatcatctgttgagggagggacacttgggttgcctccaccttgtggctgttgggaatagtgctgctgtgaacattgacatacaagggtctgagttcctgctttcaaatccttggggtatgtatctagaagtggaattgctggattgtagggtaatgctatatttagttttttccttaacaatatttttgagatgtgaagttttatttttagaagtttggcctctcagttttaggcaaattttgtctgattgttgttactgctcataacccaagcagagattcctggccatgcctctcaccaggaacccaattgagtaaagatgcccaaagggttgaaaaagagatgttgaagtctgtgtacaaaagcagatagagttgactctgtagagagctcccaaaggctcatgagcttagtgggccgtgtggtgcagtggtaacagcctgagaggctgccagtgagtgctggtttcatttgaaactctgctgtcttgtgtactgagcctcagtttccttgtctataacatgggacaacagtgccttctttgtgaagttgttgtgagaactggaaagaggcgtctgtaaagcacaggatatcatgtctgccatggtgtgccctctttaagaagtaactcttgctggtgagtgcgaagaagtgggtctaattctggaaggcggtttgctactgtctaacaaaagccttgcaaaggtcatacatttaaacccatcaattccaggaatttatttcaatgacgtgtgcatgtgtgtgcatgtatatccatttcaattcaatcaatagcatattcccctagaataaaggaaatagggaaagacaagactgatcagataaacattacatacactgatgatagactattattctgtcttaaaatatgttaaatatctagtaatttgagaagatgctcagatttactgagtgaaaaaaacagggaaacaggttacggtactgtatggtcccaattttgtagaaagagaaaataagagcacactatatgttttatataatgatgtttaatttgggtggtgggattatgggtgatttttattcaccttgtaatattgtgcatttaaaaattttgaacaaatgtaacaatttttcataatgaaaataaaaatataattactattatttttcattttatttaaaaatacaatgacagaactttgaatgtttattatctaaacctatagcagacaggaaggaacaaaagaccctggaaattcctgtaagttcacctcagtaagagttggttttggcagcggtatagtattggaagagagaggccagcaaaaggagccattagaactcacggagtccagcagggtaagtccatttacctaggagcaaatagcattacacctcattagcccagtggacatcaatcatgctcagagagaggactgaagtcagtaaaggttgcgttatattctttgccccctgcttaagaaagaaagcagccaagaggatgacgtacgacatgtacaagagggaaaatgaaaataggtcctcttgctggaaggtgtgttactctcactccctagaaaacttactgatccaggataatgccttcctcaaaggttttgcagttgtcaagagatagggtgttttgctatcagtaatgtgtggttttgatgttgatacatcagtctggagcaatttgtggcaccactagttggaaaatgaatagatgatgagtttgaaatttgaggaagttgacttatttcactctgagtatttttcttgatttatttcccaagaatatttgtagatctttgaggacgaggcagtgtgtaggcagtggggagaagtcatggtctgagcaggtggtgggggacacatccagtggatcataccctgggaggatgcagagttgtgtcccaggcacggggagggagagagcctaaagctctcaggatctgggggcttcttaatagcagagaggttaggagctgagagagggaaggaagacattcattgtcaagtttttagagattgacagtctatctgctatcatggcattcctcttggggtgagaaatgtgtttttgttattggcttatttgcagtttctcaatgtacctataatgtagttattcttacaatggaaaaaaagtaatataaattaaatatttgaaatgaatgattgtgccattacagtgtactcaccaaactgcagaattttcctactaacaggtgctctgagacccctgagttcagtgcttgggggagtctgaggtctcatccccaggaagacaggcttcagtaatcagtgccagcctgtgggtaggtgagggatgagtggctgcacacaccacagattcttcatcctgtgagatctcacctagcctagtttgggtggagacaggatctgagaatttaagttattggccagagtcattcaaggtcattcactctattgagagatccactctatgagagtttggcagagagcccaaaactcatttttagcatgtccttagtcccctcaaataccccgtcacaaatcgaccctagccccctactcttgtattggtatcagtggcctcgtgatggattgcagagtttctgtttttggtggtgtgtgtttgtttttgagacagagtctcgctctgacacccaggctagagtgcagtggcactatcttggatcactgcaacctccacctcccaggttcaagcaattcttgtgcctcagcctcccaagtagctgagattacagacatgtgccatgacacctggctaatttttgtattttgggtagaaacggggtttcgccatgttggccaggctggtcttgaattccttactttgggtgatctgtccgtgctgggattacaggcatgagccaggattgcagagtttctgaccacagacgaagtggtcccacccacccacttccctctattctccataacagaagcattgcagagtctctgcccagctttttttgtcttctgcttggccagagacactttgttgctccagctggcttctcttctttgctgactgcaactgcttgggtctccctttctccttgctggtgtggttgctttagccttgtgggcagggcaggctatggtcctgcctgaaagtggagactgctcttccagcctctgtgccttctgtgtctgtctcctctgcatcgtgtgtacctcgggcgccccaatcccatgcctgcaaagcacacacattcatcatgcctttgttccgtctggagaacagggctgtgtgtgtgattgtcgtagtaaagcctcctgagctggaatcaaaacattttccttgattgctggagtcataacccaggaagtgtaagtagttcattctctcagttggagacatcctacacaaacacttaactcctgacttgaggaatgtctttcaggctctggagttcaggggtcctctccaacccattacggctgttttctgactttagtttctttagcttcttttcttggttttctttaagccagaaatactggttataggcatgcagctttaatttgtagcaatgtatttggtgcaatgctttcctttctagtaacaggggaagtgtagaaaaaagattggagaatggactatttcagaagcaccaatttcttagtggagagactgtcaagaggaaaagaccaaaattagaaaagaatgccaattattagagaaggtaaaatagatcaagaaaaaattttgttttttttcctccaagaagccattcttagcaacattaggtgccgagggacatagcctggctttgggctggctgtttttctgtcttttagtctcttccagcaatgctctttgactgggggtaagttaggaatcactttgcactttagattcttcgtttgcatgtacccatcatgcataattattggcaaaaataatgatgctgatgatgactttgaggcctgtgctagaacctccctgcatgtcttatcttcctcatcagagctacagatgggaaaactgaggctgagaggtttgataacttgcccagaagtcacagacaggtgttaactcagtggtgggatgggaatcaaagccaaagtccatctcaggttttaatttagaggagccaccctgcacacacctatatgtataagctgcctgttgcgagcattattttatatattgtatttttccctttctccctagatcatagatttgttgagggcagtacacatgtctttcttactgtgacatatatactgcctggtatataccacaaggttctactatactgcctggtctgaagtcatacttcatagatatttaatgaattcctgaactcacatgcaattaatagacttgtggactccagaaaggtcctgagcccctgcctctccccttcttgtgggaagtcctggttactctaggcaagcaaaggtagaaactggtccctagcgccctgtcttcctgctgtgccttgccattcatgagatatcggcagcagtttggatgagggcatgattgatgagagaacaggaactcaagcaggaagacagcatattgtgtcatgattcctctaatgtcctcttatctagttcatcttttactatgttatccacaaaaaatcttgaagattttattcattatatatatatgtgtgcgtgtgtgtgtgtgtgtgtgtacacagttgtcccttgatatctgcaggaacctcctgcaaatgccaaaatccaaggatgctcaaggccctgatgtaaaatggcatagtatttgcgtataacctacacattttctcccctatactttaaatcatctctagattacttataatacttaatgcaatgtaaatgctgtggaaatagttgttacactgaattatttggagaataatgacaagagaaaagtctgtacatgtgcaagtacactctgtttttcttaatattttcaatcttcaattggttaaatctgtggatatggggggctaactgtatctgtgcagaagtaacttttgttagtatcattttctcatggtgaaactgtgctatttccaggggtaactttctttttctgaaacgctcagcatagtcctgaaaagtagtgaatgttggtctccggttgcacactgatgccaaagttgatgataattgtgatttctgtgactgcccccaccccagacactaaataccttctattcgggttgagatgcagaaaagctaggagaaaaatcatctataatccttttcccacaaaataactaatgcccatattttatttctgccttatggaaatggagtcatgccacaccaaataatagcatttgtacatgtcattaatgattattctgcaacctacagttaaattatgatagtatagtttattagatatgtcatgatttcttaccttcatctctgtttcttacatgtttaagtgacttctccagctatagtagtaggttcctaacctattaagaacttatgcttcgtattttaacccattgaatctacctatcatatgaggtaggcacaattattatctccatatttatagggaaactgaggaaactgaagccagaagtaggggagttgcccagatcacagcccttgagagtggcagagctgggatttgaacccagactggtgggctctggcctctaagcatttcatccctctactattctgcttctagattagccctccttccttatccaagtccaccagtattttctttctttttgattcctcgatcgttcagtggctcaaaccaagatttcaactgtagggattgagttttccttggccttgaaagcagtagatcgaatccctacagttgcccccgctgcctgggacagtggtttccctttaattgtgcttattccttcctttccactttgaagatcatttgtcttaataaggaagataggaacaaaaaaggcattgaggagcctgtgttctctttgttttgccccagtgtgttaggcaagcagcagacctctccctcctggtccttatttggagcagaactgaaaaagccattgtcatcctttgtaatttttcaaatctcagctattctgggccttcgccttccccatgctctgacagttcacgccactcttttgtctggtcccctttggcagataattggactccattaatgtttcatgtttcctttagctgtcaggatgcttgcagctcaatagagggctttatcccagcaactctttctgttcccctggtgtgtttgcttttcatcccgttgctccgcagtttccctgtgtctttcattcattcgttcattcgttcattcatttgtgaaacaagtatcggttgctcgtgtaggcgataggaggcctggggcccaggcccaggggatgcagtggtgagcagtgagtcatttctgatttaatgatccacaacatatggaccatttccgtccaaggaagtgcaaatcctttttcgaagtagcagagtacaacttagaaagaaataattctttcatttcattaagatcagtgatgaaagaatacttttaaatttcccctaggtagaaatgagaatattctgtctcctaaaatccaatgtctgtattatatttttccactatattgtactttgcctaaattaacctttttttcttttttttctgtttttttgtttgtttgtttgtttgtttgtttgagacagagtttcgctcttgttgcccaggctggagtgcagtggcacgatcttgactcatcgcaacctccacctcccgggttcaagcgattctcctgcctcagcctcctgagcagctgggactacaaacatgcaccaccacgcccagctaattttgtacttttagtagagatggggtatctccatgttggtcaggctggtctcagactcctgacctcaggtgatcctcccgtcttggcctcccaaagtgctgggattacaggcgtgagccaccgcgcccagccttttctttttttttttttcctttttaaccacaattaaccagtactaatcagccagagtctagtcattccagataagtagaatgcttccttattttggcatgagttatctttcttatacaattttaaactctatccccaaaggaagatgtcaaactagagaatttcagttagattacaagtaaaaaataaaaaaaaaaaccctctgtcatttgctacagaatgtactagtattgccttcagaagcaatttagcaaggtttccaatatcacttttgttaacatggctaatattatattccccactatgaattaatcccatctttaaggaggtcctcaaaaatgttagtttcttacccatgggtagacactgtgtgcacatttgcagtcaatccttacagtgatcctctgaggagcagacatttcagtggtgtttaatgcttggtgttcgagggcgccccgagactcagcaagtgttggagccaggagcctgccttgtggtccccccatccccagctatttcccttacaacctgcatggactggccacttaaccccttcaactttggattcagcctgaccaagaaagtctttcacgatagtcctgagttgttcaaagggtgagggggcaatgacaagaggaagttagtgcccagccattaaccttcccatctttgtggatatatttttaaatgcactgaaaaataattgcagcaggcttctaatctacttgcataccaaatggctgaaagtacctttgcataactagtgtgcttcctcttggggactcagcaccctgaatggggactccctgcagcaccccagctactgatgggggggatcagctagatttctgcatcatggcaaaatggtttccccaccttggagcggacggggcactcccagtgactctagactgtcattactgaggctaatccactgtgggtatttgaagcagggagtggtttcggagagagatgaaggcaaattgtctggttggactcttcctggcctccaccctccagcaggagcaggctctgtgcatggccagctctccttggttgggagtacttcctgtcacagactcacagtatgcccctgataacctccacccctacttctggtgcactctgcagtgacctggaatccatctttccctgttcatgtgcttgccgacagttcggtttctcccaggtctcactcaacatctgctccacctctgcccccgctcacccacccgacccccacccttgtcactcactgcctgcctctgcaccttctggccattctgtgtggttgtcagattttttttttttaaacagtctgggaacaccattgtcttctctgagagtgggattcagtggcctaggagtgagtcctcactctactctttggcgtcttctcacgtccttcctgtacacacatcacctgggccagctgcatagacagcttacctttctggaaccgctgtttatttttgccctccccggcctttgtctatgggctgcccctagccaggaatgatttaacctcttttgagtgtttaagtttctctcattctttggtcctgacaaagatgacactaccttctccctggatgtttctctttctccctctgcccattaaaagcagctgcttcctctttggtatcccctgtggctttttacttctcccccagacctgtcatacttcactttattaaattatcaaatacatgtctgtctttgcagtttatgttccttaagcccagggatcatgttgttttttgttttttaaatctgggaaaactgaaagatgttggatttgtagttaaaccagaggaggaatcaagttttactcatagctgtgtggtgctgagtgtgtgttttagccttgctgaccttggttttctcatttgtgaaatgtggctgatagcatttagctcatggtttggcataaggctacttagatgccatatgtgaacatttggcatagtgctagattcttgtactgttcctccctcccctccacggtttctcaatctgaaccactctttttcaccagcatacactgcattgagcagaacagacgaggaatacttgtgaaatacaatactgaatttggctttgttgagtgctaagtgtctatgcttcttggagatgtgagcagtaagtacacgatgtgtcagacacacttattttcaccttccatttggaaatagaactcttcccagggcagcgcccagcatcccaccaagcaccaacttctcatattccattgtggtctctgctggcaggacaaggtactgagggggagactgaccttacatcatgggcagctgctgtgccttagaaggacagcagatttgttgttttgtagacaccatgcggaagcagagaagaaggtagtgacatgcaaaatggtgtcttccctacggcaggatccgcagatgcatggagctgcatccagggttgagtggagacatgaaaggcttgggcttatgtgggaagcgtgcatgcaagaggtggcgggggtttctcagagcagaaaagcccagggcagacgttgaattcgctgcacttcctggacagaaacactattgggatgggcaaggcaggattcaaggcagaggtgtgaaggctcgccatagaggagggcttgttgagtgtcactcctggagcctacggagtcgcagggaggcctggcatggtcaggtagacttggtaaggcctgactgctggggaatgtatcctgccaatagattcctgggcctggaacagctcttctttggacacatgccatccatttttggaataagacaatctggcatttatgtacctggtgggttaccctctgggcctttttccaagaaactaaaagtttggagatacagcagcctccagagagtttgggagctctgcctggctggctggctttcgggaaaattctaccgcttgattgacggaaactgatgaatctatttcccacctactcaactaacgtgtactgagcacctgctgtgtgccagactcagggtaaggtcatgaggcaagggcagctccggccttctagaaactcaagttcactgacaaaggaaggtatctaaataaaaaaataaaacttacatttagtgaggaaaaaactaaagaaaattattaaaacgtaaggaggcagtatgtgcaactttggagttaggcagactctccactctgtgtcttggtagccaagtttttgggtgcctcagtttcttctcctgaaatatataaaaatgcctgcttggctggtttggtaggaagatgaggaaaagcttgaactatgagaattgcctggcatagtatctggtaccttgcaggtgctcaaaaaatggtggcttttgtttgtcatgctgattaataatgtaatgttctatagagagaaacaataaaaatcaaaacatgagtcttttcctctctcatgactccccactgtgaaatctctctccctgtgcttgttccatactttgttcatcaaaacctggagcatcccctctccctggagcattgttcagaaggcacctcaaaaataattatcttaaaaatagtaagcattcattttggaactgtcttagtctgtttgagttgctgtaagaaaatgccatcaattgggtggcttacaaacaacataaatttatttctcccagctttggaggctggggagtccaagatcaaggtgctcccagatctggcaactgatgatgactctccctctgcatcacagatggcgtcttcttgccgtgtcctcacatggtggaatggggaagggtctctccagggctttataagggcacgaattccatcatttgggttctaccccaatgacccaatcacctcccaaaggccccacctcctaataccttcactgtagaggttaggatttcaacacatgaattttgggagaacacagatattcagaccctaacaggaactctgttcgttttctgagcccacccccggagactgggaatcagaatgccaggtgcatctcaggaactggttttcccacccctgaagttcctaggtggccccatgcatctggcggtttgagggttacagctctagatcatctgccccttaaggcccatctggagtgtcctgtttttctggttacactgcatttccatccacattctggaaaaccagctcctctctcctgggcatttcagtttttggagaactgccatttcttggaatcgcctggtactgttctcctagaatgacttttctcatcctgatgccttagaattcaggctctttttagagctgaatgccctctacttgactgtcttgtctgtaaacagagatctcattttaaaactcttctctctgccaagcagtgtgcataaccatcctaggagaatttctggcctctgggatacttttataaactgggagcgtcatgaactctgccaagaaactcttcatctgaggacgcacactgtactcgactctgcacttcccttgacttcccactcatccttcacctctcttgcagaacgctggggcttgggatccctccttcgggctccagtaccccttgcccttgggtgcccactctttcctacgggatatgtccaccccctcgtctctcctttagttgccacttaactgaagcaggttttagcttctttgtggagggaattatttttccagaagtagtaaaaacagtttcctgtcctttcttgctatgttatatttagccttgtaaatccttttccaaagatcgttgcttaagacgtcactgcatcgaggtggcagggatttgtctctgttttgttaacatctgtatttccaatacctgaagtgatgtagttagtgttcagcaaatatttgttgaatgaagaaaaatatcgggtaaatgaatggattttaaatttatggagttaaatccacagaatcatagagtgttaacattggatgtgatggtaaagattccccggtgtctaatttacctttaaaaaatggactttctgagagagcacagtgctagtgagtgacagaaatttggaccataacctggattttccctcttcagttccagtgttctcgggctaatatttttagggttcatggaaaatgagaaccttccagaatgacaagttatttatatagtttcttgtacttctgcttctccgtgacttgtgatgtaatagaagagttaggaattgaaataaaaagcctgagaggaaacagatcaaatggctaaggaagacttgggaaagatacagttaatcctttgctctttttgagtaatattttgtgggtatgtttctctgtcactcccgaagtgtcttttgagtagtacagatagaaattgcttagctgaatctgtgcatattaaatgcagttttagcttaggtttttggttcttgctgggcaggctgtaatgttttggtagtggaaaatttgttttcctgtgttgtataggctctatggtgcagagtccaggcagtcataaagggcctgacgggatcttagtaatgcccaggtgcttccttgcagcagtgtagcaggatgaaaccaaggaaaaggaaactttacatgcttttctaggggatgctcactgaacattggatgccaggtctttgatgaaatcgctaagatgaattgctttccttattttttttaaatataattattgtacaactccctaaaccacaattaaaaaaaaaatctcactggaatcaaagtacagagtgattaattattaccttaccttttttttttttttttttttttggtgatgattgagttgcagttgtctggccgccaggctatctgcatttgattctgaagtttgtcctagactttagcctttgctaccagttgtcctggggaaatgggtgaggggctgttggcccagctgtgtgtaaagggagatagactttctacatttttataagtttaatttaatgagcctccactggcggcggcactttgcatgtgtcattaaagataaacagttttttaaaatcccacctgccatgttctgcaggattggtggggaagcatacacatttatactgaaaattcttatttttctaggaagaggaatctatgtttagtgtaacttaggaaatgactagccttgtcctggtcctttaacaagccaatctgcttggcatcacctggagggtaacctgggaacaattcaatttaaaaactgcgtttgttttttaattattatttttaattgtggtaaaatatacctaacacaatttaccacccttaccattattttttattttttgttttttatttattttttttgagatggagtctcgctctgtcacccaggctggaatgcagtggcatgatctcagctcactgcaatgtccacctcccgggttcaagcgattctcctgcctcaggctcttgaatagctgggattacaggtgcacaccaccacacctggctaatttttgtatttttaatagagacagggtttcgccatgttgatcaggctggtctcgaactcctgacctcaggtgatccacccgccacggcctcccaaagtgctgggattacaggcgtgagccactgctcccagcccatccttaccatttttaaatgcacatttcaatggcattaagaacgttcacatggttgcacaaccttcaccaccatccatccatagaactctattcatctggcaaaaatgaaactctgtacccatcaaataaataacaccccatttccttccctagcccctggccaccaccattccactatctctaggaatttgactactccagggaccccatgagcagaatcagatagtgtttatccttttgtgactggcttattatgtcctcaaggttcttctgagttctagtgcgtttcagaggcaccttccttttttgtggctgaataatattccattgtgtgtatatgtgccacattttcttcatctgttcatctgttgaggggcacttgtgctgtttccgcctttgggttgtgaatagtgctgttgtgaacaagggtgtacgattatctgttgaagtccctactttcaattttggggggtatatacctgcttttactttttaaaaatagaacaaagaaagaaaaacaaatttgtatttcttctaagctttgaagatatttaattattgaatatgaataagcccaaatttccccattgcaacatttcagtgtgagcgttgagatttaacagatttatgtttccctcccctttgaattggaccagaaaatatatgctgacagttactaattaataaaaaccattttctgtcatgaaatctcattccttaggccacctttcctctctgattcaaatatattttccaaagtgtaaatactcatttctgatttaaaacttttcaaaccactgctataaagtgacaagccaaaaagtacagaaacaaagtagtatatatattggtttttaacttgtcaaatacttaactggaaatactaaaggcctgaaagataaaaagcaaaaatgagggtcatccctttgttcgggtgatgttgagccgacatgatcattgattttcaaatacggttaccaatccttttcacacacttacccaaaaacaccaaatagcagatctcatggctctgaccctgcctgagggcacgttaatgacttttcccacctaaatcccagagcctggggaaaacatcagcagaggtgtaggccaaaatgagcagagcctagcaatctacccaaacagatgccaaggcaggctgccacctgccaaactctcttcctcactggagtgactcaccacactctggacaaaggggtcaggggctcctaaaattgctgtgtttagccaactgctccaggcgttctgaggtgagctacgatcccttctcaagagtctctggattcccttatgcccttcaggtcccttcccaatatcttggttcccaaggtggccagtgctggggggcaacagaaacattgggttgagtgggtagcagggctgcctccagccaaggaaagcaaagccccctaccatctcctgctctgtttcttctaaggatcacctgacacactcaggattcatcaacccggggctcagagactcctctgctcagcactgacacacccagagtcagaaattctattaggttggcagccctggctggtgaaattaaactcctaccaggcgcagaagcaggaaggctagggcaaaatgacttaaaaggggaagttacacctcacatggaaggcaagggtgcagcccccgtgaaacgtgaaaaatgcaaatggaaacttgaagaaagcatgtcaaatgtttactttcgcattttgaaggagccccataaactcaaatacactcagatgcccaggcagtcttttcagtgcttcatggcaggctccgtgtgcacacagaggaaagaggctcataaaccagattattctggcaacagaatcatttcctggttgttgcgttgtaagaatcctctctccttccacaagggagatatgattttagcagctcatttgtaaaatacaggtttttctctatccactgttaacagtcacattttcaaggaaacaaagaagaaaaggtctggagagccttaaggtcgggcggcatcctgggagccataaacaccattgcccctcgagttgggactaagaggagaccggaagactggagcagcttgcctaaagtccaaaagggccagggatgcagctcagggctgtctgcatatccgatggtagtctttggggtagagccggaggcttctccgtggaggggctccccttcttgtctcccagccttctgcaccctgccaggcagctcatgagctgtgcctgctctgtgcctcatcttcgtggttgtagactgagatttggctctcagtcgcttcttagttgctttgaatctaaatagcagccatagatacttaaacactcaaagggcggggtagtgctttatttagaaagaatgtgtatatttaaatgtagctttaaggagagcagaggacagattttatgaaagcagagaatcagtagtctccatattttgtgttatctgtagaattgttgagtagggccctggatctgtaagtcatattgggatcttcttggaggagggtctggatggagtttcaaggtagcagaagacaatgcccctgccctcagggaattggatataggattaaatatgcatgcagccttcctggatacactagcctgcatttgtcttaggagaagaaaaaaaacattctaagaaaaataattaagaaaccacctgtaaatagtaatcaggaacaagtgagtgtagcctcagcagactgagaggatccttgtgattttagctttgtctaactatgttatgcccaggatatatgtttatttttgtcccattttatgtcatcacgaactttgaatatgctttggatggtgattctgcccatgtggcctgtgggtcctgggagtcggagtggagacttctgagtctccataggcaccagcactgattggagccctgccactgcccattagcataggccacgactcttttgcagatgtgtctgtacataatgaaaaaccaaaaaacgtatattcttacaaattgttaaattcatcagtttgttgatatgtgttttctcaattactagagactgaaaatggtggttccccttgtcttttgtgagctgggtagagaggagaggatgccattttcaacaaaggttgggagaaggaagtttctcttataaacactgaaagccaagagttatgactgtgtagctctttctaggtacaaggatatttatatgcatttgctggacagactaattctagggattttattttctgcctcaaatcctgcctgtgtgtaggaacccgtgaaataaagcattgattccatttgtatttttatttggagttgtggttaggtggtttgcttttgtgtttgctgaatatctttaaataccataaatatgatagagaagaatactctaaccatataatacctggttttcttattctacttacttatgtccaaactctatatatgggaaattaagtgcatgtgactagaatacatgagaatagaagataaattgttgttcagaaagctgtttcagtagaaggttaagttatatttgcacaaagttttaattggttagaagttaacagaaattgcttgccaagtgaacatggtctagtggaaaacacttttgcagcctgaccttcacttcttttctagatagaaatgtgtaaggactttggcttttgcacatgtgttagagacttttcatgtaaagtgccatttatctgtttcttagggactgaatctgctttgacttaatgatatacccccaccccagctgtttatgacttaacagggtatatcttccatatgaaaatgggggaagggggtagtggagaaagctctgaaggcatcgcacactgatggaagcttgtgtaggtctgtgaagaagggatcgtaatggacacgtcctaaacacatggtgcaaataacatgtccttatgttgccaaatcatttagtaaagtgaatccagtgtcatctttaatccctaaacaatgtaaagaagacactagatggtgctgtaaactaagaaatgtattggtgaaggtggtgagatggtgctagaagttaaatcctctgtccccggagtttctctgtcctctttgccttttcctagtcagcacacctagcctgctgcatggaagacatttactcgtgatgatttataagcccgatgcaaatgtgtttcgctgagtttatatctattttaaaactaagccagcctcagtttgctaatgacagtgaaactagatgagatgtgaatttgagatcagacaagctactcaaatatttggggcaaagttaatacccagttttggactgggttatttaaagaaggaaaataactattaataacatgattgacagccatgttgtttgacctatatttgtgcagaaaatacattcttataaatccgtctgaagtgaaattttatatataaaattatttttttcttcacctttcactattcctcccagtgggtcagccccatggaaaatattttggcgtcaagttaacattaaatagacaatctgaatattcactgcgagaagcatttgtttacttgtttctcccacttctgttacgtggcagaaggcctttcacaaatgggtgattattgatccacttggattcatgggaccagacaagaattttgcagttgaccacacccacagaggtggcacacagagtccttactgaggtagaccagctgacagaataaatgccatagggatgcttgtaagaactcagtgtgatttcagtcgtatcttaatgtagtaattaaaaaaaaaatggtgtagaatatgaaaaattgtcttcttttgaatcaaacctttaaaacccctgtttggaagatttaactgtcgctcttcgttagaatttagtgaagcttacaagtcagagaaccataattgattttattatctaaacagataaaatgctaatgaaccccacaggacattttacagttgtttctaaagtatggcatttaaaatttctaaaaagttttatttttgctgtaatggctctggaaagtatgaaggtttgaaacatccagatagagtggttggattcagtttatgaagattataacctattgagttaccagattgacctggctttgttgaaaatattcatgattgaatgtattaaagtagaaaatagttgtacaaataatccacctcagaggagagtaaaagcattttgaggatatgtgttgtgtttatattttggcatctattaccttatatttactttgaataatgacagaattactttgcatttgacctaattgcagagctatgacccaggaatgatctggttgactgacagaaggcttagcaggaaaaggacaggagaccccgggggctgcttgcctggggagcacagccaaggggctgttaggaatgcatagagagaaataactgcacatgaaaattccccagagggaatgaaaacatgttattttcctagaagagaacagtctcagagtaggaactgtaccactgtttttatttccaaagcaggattaaaagcctggcattgaattggcagagtggccccacagcacacgtgtatgtgtgtgcaagtgtgtgcatgtgtgtggacatgttcgcacgtgtgcacgtgtgtggcattgagaccaacctgcatcacccaagactgactatacttaacagtgaactttgtgttttggccagtattgacttttagatggcccactgagatagaaatattgagctgttaatacggtaagttaagagtggcgctcgtgctaattgttttgcagagcttcaattaagcagctattccctgtcagctaaataggagtgtaggagatgagtgggtgcgtgatgcatacgttctagaactttcctgaagccccagattcgtggtctccactataacttttcctcaagatggatgcagcagtctcaataaatacagaactgaggtcttgtctttggcaggcagagttctctggactgcaattttcgctccagcagttggcagtgaggctctcctctccctgaggccacaagccttctgggcctcgggtagctcaggcaggtacatgcctgcccctccaggggtcctgattttttgccaaccaactcttccccaccccaccttaccccagctatgagcaagagttcgcctgctgactctgagtgttcttccttgtgattaattattgattatgcagtaattattaattattgattcagcactttgtccttttaatatctggccaggattaatatttgaccactcacaacctgaaccatggcaacatctctcttcttccctccttccacacagatcctgggcacacagggccctgcttgctgcgtctcagctgctgatttcacccagtccgcatcttcggatccatctgacccctgtttttctaaggcaaccttcctcttccagcctgatgctccccagcccctgccctctcccctggccctggtttgaatgtggcctctgttcttccagcaagggctgtgctggccaggcctcagtgatctcatcgctgccatttcagcagcctcccttctgtcctcacccctcccttctatctgtctgtcttcaccaggatcttgagcgtgatctggctaaaccctgctcctactgtcccacccactccagaagcccaagcactacccccgggggtgaccctgcccactccataccccctctgcactaccgtggttgcccaggacttccctccctcattgttgttgttttgtttccttatgtcttgtcttgttatgccctttagccttgagagatgaggggaggcctttaaaacaaaggccttcctaaccagagggcagagtgcccctctgaagcttctgtgaggagcacacacctggtaggagagaatgagggatgcaaagcttattttcaataccgcttatgtgaccttgggcaggtgatttaattcttccaggcctatttcctcagctgttaagccaggttaataacgatcactttttgttattttgtaagaaatagatgaaatagggctaataaataacatcttcctgtttactgtgtgccaagctgtgttataaagcagataataactaacctagtccttacaaccccccccccccccggtggggtggacactattgctaagctcatgttagagttgaggactcttaagaaataggaagcccacgtcctgggccctgggcccagagctactaggagcagggcagggtgagcaagtttgcaagtgccggtctctgctttccttcctaccaatgtagcctttggtaggaagagggtcttgctgtctgtgaccctgtgtgttaagtgggtgtaacttgcagctattctgggagcagaagagaggacgaattatgtgagcttccatcattatttgccatgatgtcaaaaagcgaaaaatctaaaaatgcagaagaaaggagtcaatattattagaatgtattgggttacacgtacaaaactcactcaaattagcttaagcacaacaacaacaaaattattgtatggatgcaagaatgttttaccaatcttccctgagcaggagtgcagccaggccttaggaagcaccggaagctgcacagccctagctcctggctccctttccccgtcccaccccaacccctccccatctccatgtgctgggttgtagccctaggtctctgtttctctggagaaacagacccattaaataggctgtatacagagagagacacatgtgttttaggaattggctcatgacactgtggaggctagcaagtccaaaatctgcagggcaggctggcaggctggacatccagggaagggttgcagctcaggtctggaggcagaattccatctttccccttggaggccggtctttttcttctattcaggtcttcaggtgatgggctgaggccctctcacatgagagagaacaatctgctttactcaaagtctgtggtttaaatgttaattacatctaaaaaatactttcacagcatctagtctagtgtttagctaaaacctggcaccatggcccagccaagttggcacataaaaccgaccatcactgtctctgcgtgctcattcctccctttctacagtgcgttttccgccgctctctctctcacttactctctgtgccattgtggcttctctctctgcatctgccccatgccttcctctgtgaagatgggcttccttctgcactctggccaatcgagaggatgggtgggcacccgaagccctcaggcatgtgttgtagtagcagccacacacaaacccctgccacagtgtcagcccctacttaacctttctgggctggaaccagtgtcagtgttgggtgctgctctgtttctgtctcttgtttcacttctggaatcccagggaagggagagtcctgatcctgggagacacctgtgattcagtcagctgagtccaggccagtggggtcgtgctatgcagctgtggctgtgtgcggcctaccggagggggtggggaggagagaagggggtgctgaagggagctgagcagatgctccgaatggcttctccctggagacaggtagaaatgcagcccagctctaatgattgaattgtctctggaatgtcaatcatgatgaatacatgtaatatgcatgcttccatacagtcatacttgtcttggtgtttcccctctaccccttccataatatttgaaaaataggattgaggtttggaacctgatcaccaagatgtacatttgggtttgattgctctccattgttaaagtttcttttttgctcttgcctttttctgtgcagaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccaaggcagagggtgcagcgctcccagcctgtgcacatcctcgctgtcaggtaggtccaggcctcatgggcagagccttctccaaggatgagagctgtcggcagggacactgctctctgtgagttaaatggtgttggggggaatagtgttggtcttgcaaagtcaagaggcagatacattgctttgatgggataacggatacactgagtgtgtgcagtgtgccgcccttgggttgaactttgtagccagttcaattccagtagtaccttttattgagtgcctgctatgtgcaaggcactgtgctaggtagagggatatgcaggaaaaccaccagaggaaaaatctctggaaagattggaagaacagccatggagctgattgcatgccccaagtcctcactacccagagtagggacgggaggctagcagctacagcaccccctggagcttgtcgtgcaaccccagacctccctcagagttgtattttgccacattcctctgctaattcaggggtaggcacatctctgtggaaacagggaggctggagggaggaacgtgctggggacgttgagggaggttcctgggaggtaggatttctgaacggatgtcaaagggtgataggagctcagatagatggaggcagaggttttgtgagcagaagagatgatgcagatgggggccggtgctgaagcactttgtgtgcctttttcaggagccacgtgagaaagagttctggacaggcgtgtgaaggggctgggtttgggttttgacaccagcattctggttgccaggggtcgtgggggcagtggtagagggcagcagggttggcagagcatggccggtttggaagtggtctcaggagcccccggatgggagatgattgtgcgctgcctgaggatgaagaaggaggggggatttgagcacgttgctgaggaggagcagctgcgttttgccagcacttgaattttgccagggctgtgaggagacagagagtgtgtggagggtgacttggattttgtctcgagtgcctgggaggagggtgtctagagaatggtcatgtcgaaggtgaaggtgctgagagtaccttagacattctgaatgaagatctttgtagaatcaagctgagagccaggggcagccctcaaggatccgcctgtctgccctgtcgcagtcgggatggcgtggggctccgtgggaccctgcgtgcctctctgggcctttgcggaggatgtacagccatctctgctgggactgccccttgccctcactggcctctgtcaggatggggttctggtgccttctgtctcagcaccccatcttccggggagctctgttcatttcctgggctcttcttgcttctagaaacttctgagagttttctttgtggtctgacatcttgggtcttccgcagcccagataatcaccttgccccaggtggcagctgtttcttacggaggggagagggtgcagcggccctggcgcccgtggtcagctgcctccccagcttcccaccccggcttcccctccgacttctcactttttgtcatattcattgatgctgaatgatgcctgtcccagggtttgttcaactttgctctttgaagcgtgaccccttgtacttagctcctgaggagttaagtctggtgggagagctgtttttctcttgggagcatctcttgggagcatcacagtagccttggggagtgcctgggaatatggaggtgcagttgcatggcgaaggtgcccgagggtgggctggaaagccagaaggcctgcctccctgctggagtagttgcccaggacccttgaacctcgagttctggctgaactcgcccatatgtgccccgggactacctgcgctaagtccctgggatggaggggcaggcttgctctgtgggacagcaaagccctctccctacagggtcacaggtgctgttccttgggcccaatgtcttctctctggtgtcctctcagataagtagttttgtttcttactttcaggtggattaaaaaaaaatgtggagatcaatctggaatcaccaaagattattttgtgaagtgaggccatttgctgagtgcttactgtgtgcagatgctgatgagctcctccttgttatcagtgccctcggagggaggcagtgtgggttaccctcgcttcccagctgaggaaaccgtggcacagcggggcggtaactgggctcaccacatcaggtgggaagtggccatggagcaggctgctgggtaccagaggtcacggagcatggtccacgctgcagaggaacttaccgggggctgccatgcaacccgaagggagctggggggcaggcagggtatgggcagaggagacactcgggaagggcaagaaggctttgcacataggaaagccgatgggtgagccgattctgtacagagaaggaacccaggcttttgagagtgcaagggccacgcatgtgttctagacaaacacaagtgagccaaggcacagagaagaaggacctcgcccctcagctctgcagttcctgccaccatccctgacatccctaaatctcagcacccctctccatagtcactgtcccttctattgtgagcctctttcgtggggattttttgtctttgtgtgatatcccttagtcttgccttaggcgatgtctctgagctgctttaaagtcaacacaggactttttaaaatgctcaaaacaacccaataaatagagaagcttttgtggacgctaaaacgtcagattatctttttggggtgaagtcactggctagaagccgtggatgggaaagtggcactggccacccgttttatccatctcctcctgtatgacaatggccagacgtttcagttggacgccttgccaaggctgaagctgttatgggaagagtgggatttgttcacagtaaaaataaactttatggcatgtcatcaaaccattataggaacggctttcctgtatttcgcagcactgattcccttcatgccatgtgagttctcgtaattttaaatccatgcatcatttgctggtctatgtgggatagttagctggatcttcctttaaaaaatagggaaagttggtaaaagagaaaaagtaatacagtcacaaaatgtgtttctgtagtggcaaatctcctgggaaagctaacggattgttgattttgtgaaatcgtaaaaattgtcaaaaaaattacttgaagacacagcctatgatgggggtttttgaggtatgtttaaacatggggagggattggaaatgccgagtgaagataatgtgaggtttgctcccctctccttgaaggtaggaggctgcagacagggccgcgtggcctcaggaagggtggaggaggctgtgtgtccaggagtgccctggaggtgtgggccagaagttactctacagaggggaggtgccagacacttgacattcgctttgactttgaacttgatttctctgctgttcacagttgcttctgattcgtcatactgtgtgtgtgttgcatagttgtgtgacaagtgggttgtgcatttttcggaggagggaacagatgcccctggagatgtgccaggaaagtagaggtggtgtgtggattcagcgtgtgtttccaaggtgtgtttctaatgtggacacaggctttgcgaggacagatacatgaagctataatttccagttaattcagtgtcaacaacctttttatataagtaagcatccattgcataattcagatgagaacacacagccttttcttgtattttcatttgattagattaatgctcatttcaaggacattgaaaaacacttggttctcatgaaaatgctcatattcagaaaactttcacacatcaggtattcactgatcaaacggatgaggtatttggagctgatgccatgtcaggcactgaatgctgcctgagatgagcacacacccaggacaacaaaacttcggcaccccgccccccgcccccgatgcctaatgaagaagagaattgatacccaataccctttgggtctgagaatgacaacttgtaatttttttaaagttttcgttttagtaaaatacatgtaacataaaatttaccatattaactgtttttttcagggtacagttcggtagtattaatgcacactcacaatggttgtacaatctccagaactttctcatcttatgaaactgaaactctgtccccagtaaacagcgattccccattgccctccccttagtccctggcagccacccttctattttctatgggtttgaatacactacctacctcactgggtgaaatcacacagtgtctctggttttgtgactggtgtgtttgactctgcataatgtcttcagggttcatctgtgttgtagcctgtgtcagaatgtgcttcctttttcatggctgagtagtgttccatggtatggatatgccacatattgttcatccattcatccatctgcagacccttgggatgcctctactttttggcttttgtgaaggatgccactgtgaacgtgggcatgccagtgactcctagaagccctgtgtcctgctttctgggtgtatcaccacagtggtaaggctgggtcatgtggggaatggcagcttttaacaggcacttatccctgccttccaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggtgagtgtgcccctggctggagcccaggctgagggatatgccagattattgggatctgcacagatgtgccagattattactttgggaagaagggcgggaagtcctgggatcttctctctcagttcttttcttgttgtcacagtacttgttgtcctatgaggccgatacagtttggatgttgtcccctccaaatcccatgtggaattgtaatccccagttttggaggcagggcctggtgggaggtgattggatcttaggggtagattcctcatggcttggtgctgtcctcacaatagtaagttctcacgagatctggttgtttaaaagtgcgtgtcatctcctccccttgctcccactcctgctgtgcgagacgccagttcctgctttgccttctggcatgattgtaagctcctaagtcctcatcagaagccgagcacatgcccgcaccatgattcttgtacaggctgcagaaccatgaaccaattaaacctcttttcattattgatcaaaactctgttttatctttatattttagaaaaagtctcataaaaaatggcaaataataacaatgatttgatgtttaaagatgaatcttagttctttgaaaaagtttcaccactggctcaataataggtgtgaaaatgctgggctcacccgggcacctggatgtcagtacacaggagttgaagagtttctgtcttgtagtcctgactttgaatatgatctgccgaaagcagaagagtttccattggacccacagggcaataacctcctttttgaacttgtagtttctacttaaagtagatccatgaagtagataggacacaaccattgtccccatatgaggaaactgaggcacagagcatttcagtaatgtgtccaaggtcaaacagccaacaagtcagcttagcagagaaactggcagagaaaggggttgaaagttcctccccaccggttggcagggctgtgagccaggatgggctgcagcctctggaggaagacccctaggggtggaggtgatcattagaacaactgcgccatctgatgtttatggagtgagggatttctgtgtgccaggccttgtcgtaagtggtggatatgtttattttttgtttatttatatgttcatttactcctcatgccatcccgtatgaattaagtacgcatgttccctctgttccacagttgagggaagggaggcccctgtaagcagctgagctgagtgtggctgagacctgatggtgcggctgagtgtgacccagcctcagaatcggagcctgtgattgcagccactgtgctgattggcttcccgggactttgactttccttctgctaaatgcatattgtttagaagtcattttgcccttctacttgaatcatctcttctccctacttgctctcacttccctacctttgctgttctcaagcaagacaggccagccatccctttctctgcaaatctgcctgtcctgtgccatgcaaggtctgtcctcttgagagagagacctttttccaatacccgctggctcccaagtgtgggtcccgttctgacctcaggcccccggagcaggctgcattatggcactatcaaaacttagaaggtgaggtaagtgtccctcatctgggagccagcactggctgggcttgtgcactttgtcacatgtctaaagtgcatctgggatgtctacctcgctggtgaccttctgcttcaaataaggatccagacaagctgtctgtgggttttgtcactgaggttgtttacagagctacccattctaaaataagaccatgaaaatattatctggctctctcagcctttggcaagaaaattggcctccacccccagggattgtccaaatttgtaagcagaacaaggaaaccggggaattttgcctgctggtgtttttcttgggatcagagcttgttccccatgagaacgtggcattggtgtctgtgtcactcgtgtcctcaagcccacagaaacgaccaggaaggatgtttctcactcagaactagaactacttgtagaaagtccttgttctttgttctttttttttttttcccgacttgcttgaagggatatttctttatctgtacttggtgttgacttctgatctcatgaaaagtgtgttttctcagtgcagtcggtagcaagtgctggacaacctccagccacttcccagggctttggatctaggatcacggtgggggatggtgctgggcaaagagctttggctccattccttgccccttgcttgaggaaaagagaaatctgatgttcttcttcccttcattcaagtcagaggaagtaatgctgagaccaaggtctagtcaaggattctgaagtagtagaaaaattgacaaagtggacccgatacataaagtggctttgctcacagggaagaactcagttaacataggaaaagaagaaagcataacgaaatctatggaaggtaatgggatagtgaggtgattggaaacttcctcattcatgtcattatgttcactattaaatagcagattcatgaagaaggcaacgggaggaaaaagtagagatatttaaacttccatgagaaaggaaaaatcattcttgcccaagctttgtaggcaaagccttctgaaattcccacacaggcattagtacctttcttctgcctctctccttttttttttttttttttttgagacagagtctcgctctgtcgcccaggctgctggagtgcagtggcgcaatctcggctcactgcaagctctgcctcctgggttcacgccagtctcctgcctcagcctctcgagtagctgggactacaggcgcccgccaccacgcccggctaattttttgtatttttagtagagacggggtttcaccgtgttagccaggatggtctcgatctcctgtccttgtgatccgcccacctcggcctcccaaagtgctgggattacagatgtgagccactgcgcctggccctgcctctctcctttttaagtgactccttggtagctccgtaatgtgataagagatcagatgctggtgtccagagaccccaggtctgagagcaagcaactaccatgatgtggacctggcgctcctcacagcatgctgagccccctggcccgcgtgctgggacagggtgggagagtggcagtggtctcactgcagcatttgtgggccctcacggatctgagttccacctgcagctctggtgtgtctcctttctagacatgtaagatacaagctcagtgccctgtaaaggctacgggccaatgggacttgatgaaaggaaggaggggagggaaaattctgcatgggagtagtcatgggtagagaagagccctcagcctcctattcaacagcacgcgattcctccaatgccgcctccctctgagctctctgccttcgctcaccttgagcccctacaacgggccgggtgttttgccagaccctgagaccaagaggttgaccgcaaagtgggccctgctctcgtgagcttagcacgatggtgacagagtgaagagctatctgagaggaagcaggatggagtagttggtagtctaagacgtggcaggcatgtgccaaaagagagcagccattattctatctagaaggacagggaggtcttccccagctgccttgcgtcctctccctggggatcccagagcatgcagcagccccaggcaggcttaccaagttcttccacgatgactgcaccctggcttcgtgaccctgcattggccaggttcttcctgagtgctgtgctgagtttgctaagggtacccatggggcttgcctgagtcatctgggttggcgggaatagctgagtttcaaacctgtgatcctccagctgtgggggagacgtacaccggcgcaaagggggctacttctgatcggagatccacgtgctgggatgtcaccgtctgacagcccactcattccttcctgcctggctgtccttcacctgccctggattcaacttcctcaccctgcccaggctctgcttcctcttctgggtctggggtcctgcccaggtgcttctacagaagcagtgcagggtcggtctcacctccctggtcccacccaggctcgttgctacccccacgtggggtggcacccgccctgcagctgctcagcatttggccagggggagccctgagagcagtttgtccaacgtgttatgggttccaaacctgggccggtcagacccttggtggaagcatggaaatctggagccagtaaacccaggcacttccacgcacctctgccactggctcatgggccctcagtggtgtttgggtgctcataaatagtgtgagatgttttggagttgtctttctagacttcttgggctttctgttttattttgttgttgatgatgaattttaaaacagcagtgttttggcttgttaatatttaagccagagtctattggtcttgcgtttacctgaggttgtactctatggcttcaccattaaagtgagagagcacacagacctattccctcacggaaggcaaaaactgatgttagagcagacatccccctttgctctgggagagtgcatagaggaaccgtgatgtatggttttacatagtgtctgttagaggtgacagcagtcctccttgtcagcagtgagtgactttcattggaaggtatagcttctgtggagatgattccatcatttattaaatggcatttaattttattcagtggtttgatttatttaagtttaataatacctcgtcattgacttaccaaaaatacaaatacataagaatttctttctgagtgtttaatttctttcctctaaaaggtggtgaaattaaattagtcattgttcaggaaactggatatttgtggtaaaaatcaacagggtatttttaactgctttgtgactcatttgaaaagacaggctgttgtggtaagggtgattgatatagcaaagacttgtgagccctgaggccaagcaccatgctccggccggagaggctgggctcacggtctagttggtgccactgggtctctgtggtgaggctgcctttgatcttggtgccctggcagacactggctgcagtggtcctcctttgcgtcagaccctccggggccttctgagttgaggaagcgccatgcagtgtgcctggagctggcctcgggtgtcgggagggaggggcaccacagaaggatgtgctccgagacctgggacttgggccaggtgccagacaatcctgggtaaataccagagctgtcccccctgcccccacagacacactgcagaggaccctggcaggtgggctggccccccgccacggcctggtgactgtctccctctgctgtacttctttaaggtcctgggagaggagagaaaggtgagtggggtgccattttcttcctgcaggtgctgggtgaagttcagaaggctctgagaggctgaggggagccatgtgtataggtacatttgactgttcaggctggtgggtacgataccctgtaggggggctgtcccaaaggccttctcggttcctgcattctgatcctggctgtttgctgtgtgaggagggtctcagctcagcgacatcagaagtcagggcagaagtagctcctcgaggcaagactgagcgtcggtgtccacgctagggaagaggggccctgtgtccacagccaccgcccatcagccgagcatggccagcaggagcatgggaccagtgtcaccagaaaattggatgctttgagagaaatcagaattgccactgaagacctgaactctccacattttgcacatttcagtgtctgtaagcactgtgtgggctgaagcagacaccctggcaggcaggtcctggcctgctggtttcggctgtggcatcctgcgaggtgactcctatggtgtctgcattgtctccctgcacctggcatgccaggggctttccctgatgggcactggatctggcgtccactaagggctcagcaagctgggatgatggcccgaatctaaaaaggattacattaaataggctttcaaaatgatgtctgcacatgcagctacaaaagtatcaccaagaggatggcagctgcagccactgctgcttgtgagagaagggctcagttagttagacacgtggctccagtcagcagtccagtatgacctttcctgagtggctggcttgaccattctgctctgacagaaataggttttctagaagctagtggctttgttgtgttctttcttggatgccattatccctgtgagaaggaccctagtcacatggcactcatcccaagtggagggactcgatggtgagaggctgtggcaggaggcaaaggagaaaatgggaagtggttaaggatcatttggggcacttgtggctatttcctacagcacacacatgggagggatgcctcctactctctgggtccagaggctggaacaagggccagagaggtacagggaggtgccacctactccttgtgggggaaggtcccttcacctgtcagcatccccagggagggggctgcctggggtcccacttcctgtcactggaatgtcccagcagcatctcactctgcagcaggagtggccttgcccttcccaggctgtgctggctttatctccatgtcagctctgaggatgcaccctgggccctcttccctgtcatcctcacccgtggagcagggacagcgagtgggcctttgaaagaaatgttttaagtcaagggataactgaaaatgtaatgaatcaacaaatgaatctatgttatggaagagaatttgcaaaattggtaaaggttgaagtagattcccttgagagtctagctcaggtgtctgtaagagcatcacctgaaagcataaggaatagcttctctgcattccagatggacaaggaagaggcttcagatgaatcaggtgatgttagaccaagactcacatttgggttctaagagattctatcaggtagaatcttaattttcctgttttttagcatctgttggtggttactacacatttaattttcacagcacttccacatgctgcaagggagagactattttcatatggtgaaaccaaggtcctgaagctccacaaggtgaaatactttggctggagtcacacagccaactagaggtacaggcaggaaattgtactcaatctagatgagcccaaagccttagtcttcttcctgcccctcccagacctctgaggtcagcactctgctgagtttggagaagacactctgagtctgtcccccctcctgcctggggctgaagcatcaccccccaaatgcagcacacactggcatttgctgctgaaaggagatggatttgtgcaggcagtggaggagcttagcatccaattctgaataacccttcatttcttggaggtattggcagactttcattccacttatcagggagcctcggtttcctgatcgtgccttgcacatcctgggtcatgaccatcggagaggaagacctctctgaaaaggaggcccaggggcttttaaggacagcacctccactgccaggaagctgcccctcctgccatgcaccagcctgggactgccaggggcttggtcttcaactgagaaggtcaaggcacctgggcatggggccagactccaactccacaacattgcaggtaatgacagtagtaacaccagctgctgagatgtggggagtccttctcctggcaagcgtgggacactgtgcttcacctgctttcaggatgcctttggctgcaagaaataaaaccaaatccgtctggtctctattgtaaggagagttgcttttgcagaacaggaagtctagggccggagacagcagccaccacagcctcgtcctgtgtcacggcacttgtcctctctccacaacggcagctggtgagaccagagttgggcttgtcacccagaagcagctgttccatatacgggtgggtaagccaggtatgcagaaatgtgaagtggtggcaagggcaactgaggcaacatgtggggcgcactgaccccacaggtcccagtgagttggttgtggtgtgtgatgccaagaacagattcacatgttgaagaagcagaaaccaagagcaggcagagaactgactcctacagtaaatgtgcagaggtgctgagacaagagggcggggtgtccccaggggcaccctagagaagagtgccggtgaagaaaaagtatagtaatgctattaggaacttgtttatttatgaacttaagacaagctcagtgggcactttgacaggccacactttccttcagccaataaagattctcgtgcagctacataatgagtttttagagcacatttttccatttgttattcaaacacaattagtcacatagtttaaccctgttagtaataggacataaatcttgtcttagctccaatcagctcttctccctctgcttaattttaaaaattaattttctggaaccacagtaatcactttggataagggtttgtgcatacaattatttactaatgatcaaaattaggtctcctgaggctttaactgcatgcaatatgttagaccatctttgctgagaaaaactagtcctggcctcccagtgcaggttgtttcacagaatgtattgcacggagagaatgctctctcctgcaaatgtgtgtctgcaactgggcctgtcccgagcagtttgctggtgggccttgctgaggatggacttcctccatcctttagccccttccacccgctggcaagccctgttactcttagcacccccacagtctgcccgtgtcaccttttctggtgcctttggagatcagaagacattggggcctgagcctaactgcagtttaccctgagtgctggggaccctgaggggtgctggctgcagtgggttgggtctgcagcccccagggccttggccctggcgggatggataagatgctgcgccatcacaggatggtcccttgtggcttcacgcacgcaagagtcagcatgaggtgcacttcaactcatcccgccattttcaagttaaaatcctctgtcctcggcccccctcacacctgcatctctaactcctttccttctgctactgcgtggctcctgtctcccaacggaagccacctgcctgtaaccatttcccgtctgcaccgagaggccacggtgtggagggggagctcctgcccacggcacttggaaggtgctggggcagaacccagctccagcgctgatgtgtggcagcatctctggaaacttccatttcctgctctgtctgaggaggcggggccctgctgatgtctctgtgtcttggagctcaggacagtcaaatctgcaccacggctgcctcccctcttgccgtgtgaacgtggcaggacgtccaccccaccccacttcctgcatggacatggctccatggctgtgccctacctcccttcctgcatgaatgcagcaccacggctgcaccccccacttctgtggttgtggcatgatggctgcacccccacttcccatttgaatgcggcaccgcagttgcgcctccctgccacttcccctgtggacgcggcatgatggctgcaccccctacttcccacgtgaacacggcaccgcagctgtgcccccatgcccctttactgcatgaacgcggcaccactactgtgccccacccctttgccatgtgatcactgccttcatcaggagtgaccacgagacatgtgctcttaaggaacctgaggcccagggaggataaagtcatcttccaaggtcattgacaaatacatcacaaaaagtgggtttagactcaggacccgagcttctagctgtcttctcagtgtgccacagcagtgccccagacgacagaaatgcatttcagtacgcctaagtgaactctcaacttgtcattcaattacttatgaggggacgcgtgaatccctgaaaccgtgcaagcaaaacccacacatgtagcagatcccattgcattgctcaccatcatttatgccctccggcgtggccaccactgaaggatggatgttctaaccttatggtcctgtaatatgctcctctaggtgaggggctgtcctggacaggctctagacagagatgagtttgctctactgtctgccttccaagacttgggctacccggagaagagacgtgggcacacacactattgcacagctgcttagctcagcatgggagataggtgcaggacccagagcgacctgggagcagccctgcgtccagccttgagcgttggcaggttcgggtgtcctcggtgactgtgagcattgcatttgagccaaggctttaacagcagggtggccaggacatgtttttttcaaaggggggcttggctaggctccctcagctctccgtggtttgagtagggtctagctttctgggtttcagtcttcctctggcgttgctgaggtgactgagatctcttcacgttttttacctctcattttctagaatgccagttacctgagttgtcctgagggggaaaaagccatgcaggttcagtaagtttgggaaatttggcatcgtctatcgttttcttggcaattctacatttcccgtttgattttagaggatctgaaaaatcttacagaaaaagaaaacctacctattcactcaagctaagctagagcatctgaaacatttgtgatcacagaagtgctttagagacagcacctgtaaactttacacagaacgcactttgggaaagggtgctaaattgcccatgattatttttaaaatggtgaatgtcatcctcacttttttagacttttctggcagctttgctaaagcggaggtctctcacagctctctagggaccgcagcccctgcagtctgagaataatcccgaaggcccgacgtgacggcacctgcatgttcccgtgtttgcatcagagcaagtgatgcaattgcagcgaggcagtcgtgacctggagcagaccacttgtttggctaaatatgacacaggaaatcagtgcaggaatcttatgtgaaatcccaactactagtgtttctccggagtacaaatatcttttaaaatataaacctctgaatttgaggggcctaaaacagatattttactgtagcattgaatacctcttgatatctatagctgtcaagagcattggaaatgtgagcacttaaattatatacgtctttcacaggaagaatcaccatagttttgccaaaaatctaagtctgtgccttgcccacctgtggccatctacgtgaggctcctgtggactcaaaggcaagggcagtgtgcagtcattggttatcggtggccatcagtgctttcacagagaccgcctattttgctagcaacaggaagtaattttccttggcaaactgatttgctaattcttgctgctgctttgactcgaaatttcatcaggtaagggggaaccactagacaatgcactttccccaatttacctacctgacagcttctgccataaatgactgcgagcaaacagcctgctggtttgtgtttggttttgagtaggaatccacagttcacccactggagaagcctgttacactcactgaacgtggacattggcgctttatttatacctgtgagcagccacggagggacttttcttttctcctgcaataggcgcatgtggcaggtccacccagtttaggataaagtgttctagagtttacagtcgagaagtgttaggcctctgggtcttggttgagacccaagatgagatgggccatctaggccactgcctggacaatggccatctcttttcctccatgtcttttctgtttttctttccttaggctctcgcctcagtctcttaactggctgaaggacaagtagtttgagtaataaaaatgtaaaaaagaaaaaaaaaagaattagtggaggaaaccaagtgaaagtgttttgaaaatccaaaaaattcacaagagaatttggtaaacatcctccctctgctgttggtgccaagtctggacatttctaggaaagagagcacagacatagtccctgtgtgggaaggtttacaagtacataccctctgctggtgatttttattttttggtccctgagagaaccaaatgctaatgactaacatggtttatcttttactttgccctaaaatagcatcttcgctgtcatcttacaacagagattctctagaatcagggcagtagtttctagccctatttatagaaccctggcatcttcagatttatttatatgaggaaatccccgaaaagatttaaatgggaacaccatgtaccggcgcacattcctctctttttgttcacgggtagtgtttccgctcacacagtccctggtctctctgcagaatcctggaagggaatgagaagcagtgttgccatgccaggagccgcgggaacatcacagacactcgaggaagtgggaagcaacattgctttcttcttcatttaaccttggagcctaagtgtgactgcccttttgactctgaccattgaactggcacaaaaacagtattgtaacagtattaaaaacaaagtcagctctttccatctgcccagagtttggtcgagttcctggcccctcggcattttatcaggttttagtaaaggtggatataattttagatatgttttcagttatttaacatctcataagtattttctgtgtttcttagtgtggtcttcctaaaaaacactcatgatagctgatacctacattgatgagtaccgatttgtgccatatttacctacttcacagtgaccagataatttgcattgtcgtccagtgtctgtgctataaatgatgcttcactgggtgcctggagtgcagctgttgccacattttgaatcctttccccagggtagaccctagaagtcagattcctactaaaaggttgaggatgttttatagctcaggatgtgtgttgctatatctgtctgcaaagacctgcttatgttgattaccacatccgggatagagtgagtttcgggacttccgagccctgaccccattcctggagcctttctccacctctgcattctccctaatgagagagtggctcagaggcaccgcatggtagcacacggtggctttggaagcctgccttccccagcaggggtggaactctgtgtcccaggtggtcagcagctgtttgcagggactccaggatttgtgtcttcagaataccgcagacaccttagcaagccctctggcttttccgtggctatttctgggtgtatagtaattttatgacaagtcaggcctgtgtggccctgcagtgacagggatgaaggaagaagagagtctagtggcgtttgcataggctactgcatagtcaccacatcgggtctctgaccttatgagcttagagatctccagcatgtattgttccagtagttacacatcctgtctttttcagctgtgcagcacagctcactgccgctgcctccctgacatggtctcaagtccacaggatcgccctgggacggaggatcagagtgaccgatagcaagcaaggaccttgggtctgcttgtctaaactcctcacatgtgtgcacatctcacactctgcgctcagcccgcgcctgtctcctcagggttccaacttcccctaccaggacacagtcaggaaataacgcccttactgtcctctgttcctctcttgtgcccattcactgatagattttaggtggtttctacatgcaggtactgcctgggtgctggggtctgaggctggcagggcagacacagccttgccctctgggagcccataacccagtgagagaaaccaatgctaatcaccttatagaggcacattatcacagacagtttccaacatgctgccaggacattccatcatgtggggagagctatcagtggggccgaagatgaggaatccttaagtgccttggaaggcatacagtgttccagaaagagggaatgaggacagttgaggaaggcacaggcaccctggatggtggctgagatagtatagaggaggcagcgcctaggaagccagggccttaggtgtctcaggaagagattggtctccagggcaaaggaggtctctggcagagaggggaaagcagctttgtactttgctttgcctgctgcagtgtgaaggatggactgggctggaggaggtgtgggatagccggttgggatgcaggtgcaggagatgctgacgtgttatctggactagggcagtggagtgaagttggacagctgagtgcatctaagtaaaattggtaagatgtgatttattgatttctcatagttttcatggtctgtaagacaacttgcagttctgtgtttcctctgtctttaaatatacgttcaacctaacgctcaggtcatttctagataccattctccaataaaaggagccagggctgcctgggagatgcttaaagaatgaaggggacatggcataaagacacaggagccagcatgaagggccaggggaaaataataacttacgtgtgtggaaacacctggcagacactcttcccaggtgagccacactgatgtcaccaaaaaagggtcagggcagcattgtgtggctcctgagctgtggcacccagggggacacagcatctctacagctaatctcaaagggacgtcagctgaaccagaaccaagagacattctagagaatgacctcgggttttgaggtcatagaagacccccacagaaacaaaagccaaaaacaaaacccaaatctgaggaactaaagagccaaggcagtcaaacgcagcttgggtcctggactgaatcatgaaccaagaacaacattgtttttgttttttttcccttttctaaaaggacaggagtcagacacttggctaaatttggatgaggtctgtaaattagctaatggtagtatatcagtgttaatttcctgattttgatcattgtactgtagttatgcgagtgttcttgtttgtaggaaatatacacaaagccatctagcaggaaaggggcgagatgtctgcaacccactctcctaggtaggtagggaaagagaatgggaatttgataaagcgaatggggtgaaatgttaatatttggagtactaaggtgaagaatatatacagagagtttttgtattgctttttgcacattttttgtaaaaatgctaaacaaattatttcaaaataaaattatttcaaaataaaatgctaaacaaagaaaaacccctgcttagaatcaaaaatgtgcctcttaacatgcactgatgctgcagtgagctctttctagaggagaaacctcacagaaaacagaactgaccaggtcatcccacagtaattctccctgttgaccagaacctcgtctgttaaggccagaccagggcaagctctgcagaggtgcccttgcctgggactctgtgaggcttggcagcggccacctgaaggcaggagaatatttattgccatcaactgatctgtctctggtttttcacaactcgggatcaaggcacgctctgagctggtgctgttggccatgggaaacactcgcagagccacctccctgggaccccgtggtgccctaggcatccccaggcattccccacacttcaggagaagctggggacatgctgctgcttccttccttctttccaaaagccatggaatactcataattctgttggcagaacacactgtgcaaagggggttgtctcttccatgctcagcttccttgtgtataaacgtcatccgagggcgggggattcctgagccttcagcccttgagcctcagcatactgtgaaaggttcccgagaagacggaacacaagggaataaagacctcatggtctcaagcacagtgacagccgcatggttacacttctagctggatttatattagtgtctgtaatcacttacagttcaagaggaagatcttgttatcattgtgagccccttccagcctgtactttagaggtccctttttgatctaccaactttacttgggtagcttcttcatgtagccacctgggggatggcaggggtggctagtcatggaccctgtgaacagtggtgaagcgtgtggaaggaaaacttaagtctcttcccgatgcatcgtttcaccagcccggggaggccagcggctgaagtggtctctggcaatttccaaggggaggagtgtgggagaactcagagggctgggagggctcttcctgcctggggagggttgtggcttggaacacatgcagggcagttgtgcagagcctaagctacacgtgtgtacacacacctgcacttgttgtgtgctgtttcctatgagatgaaaatgtcagacctgaaatctcttcctgagtcccccactctcttggctgtcccagttgcagcgggtggggctggccgagacaaacagcttttagtgcaatagcgtctggaggctgtgggagattagttgtactcctcttgtgcaagcccttatgtatgctgtggctgttcccggcttcatgggcggtgctgcagcacagcacagactcttcctgctgtggctacctcctgctgccccaccacacagtcctccctcggagcatgcactggggcccacggcctagggctgacagtgcctaggaagacggtgcctgcctgctgcccgtgcccaggaagatgccttgctcctcatcgtactggggccagctgaagaagggcacagaggccagcaggggggagtgtgaagtgggccctggtatattgcactcagcagttgctcacctcctttgtaaccagttacatgagaggggacaaaaattcttcattgtattccagtaagattctagtaggtaccaagagcataactaggaacagctttgggaatgtgaattctgaccacagtgaattgtgttgttgagggcaggaatccaaagaagactgggccattggaggatcaagagtgaattatctccatgctgataattctgagtcaaactaaacctggtgtgcaataagccaaaggatgaggcaaagaaaacgaaggggatgggtaaaaagaaacattttgatagaaaaatctgccgtctcagcgaagtctgcgtggtgtctgctttgaccaatctcatgctattaagattttcaggtatttgatcggagggcttggttgttagcaagcagcggaagtctcagaatccttctcctcccactctggaatgacctggtctctggacacatacctggtgcatgtggcttgtctctttctctggtgacgctgtatggccatctccctcaaaggcattgtttgttcttttattagcagtcagttcagtggcccaagtccctggaaggcgttcttctcttattctgtgtccaccctctttggtgtaatttggagttcccctaataaaggacaggttgcttctatagaaaccgaagttgttctgtaggtgaacaacttttatgccatagagactaaagagaaccagatttgcccctgccataaccgtggccctgatgggaacctagaagcttgctgcccagcccaccaggtctcaggtacttaacgggtgtctgcaatactagcagtgtgtgctctcatattcttttattatagatggtattccacttacttttatagatggagttcttgttttaatttagttttatattgtctcagccactgaatcagtcagaaccctgatttggaactagaaatacacattatttacatctaggtttttgaaaatttgaaatccaaaattctacctacaatttccagaatagatcagggcccttccaagtggggacagtacatggaagcctgagatgaagaggttagaacagactgagtgggacctgtgtggctgggcgtccagtgagggtcgtcagcagggtccagccctgccaagaggttgggttggatggaaacacagaagagaccatttggatttggtctttcaatgctgacagattaccttcttcaaaagagtggctttgatgttataaagctactgtcatgaaaaccacatggtttgagttgaagaatggagagtgaaagttctgtgcactgaagcatgtactcaagagagtcaaatacatacaaggttagaatcttgtaaaagtggcatcattgtttaatttaatgtgctccgacaactataaactatttggatgagcagctgaattagggccttattgcacactgttatggattgaattatgtccccctcagaatacataagttgaagtcctagccccagttcctcagaatgtagctttatgtggaaataatgttgcagatgtgattcatcaagatgaggtcgtactggagtaggctgggctccttagccaatatgactggtgtccttttctaaggggaaatttggacacaaatagacacgggacgagaatgccacataaagataaaggtggagattgcagtgatgcttctgtaagccaaggaatgacaaagatgccagcagccgccagaacctccaggagaggccagaagtgggttctccctccagacctcgggaggatcagacctgctcgcatcttgatcatggatttctgttctgcgaaactgtgagacactgagtttctgttaagtcatctagttcatggcattttgttatggcagccatggcaaactaatacacatacactgaaatatttttaggttgattaatctgttaataaaaaatcagaccgtaggaggaatagaaaaatatatagttgaataattaattggtcctcagattaaggaatgaaaccctaactattaaagcaataggtaaaatcatagtggaagattgctggatttgaccatgaagaaaattaatgctgtaaatcaaatgttaaactgttgataagctgcaaaagaatatttgcaatatttacatttgcaatatcctaaataaagagctcttataaatcagtaagaaaaaggtaagtctcctctctatcccttgattttttttctcccaggagattttcctactcccaatttattcactactttcatgaaaaagacaacttgttactccttttcttcccccttctaacttctcacctggtgtcgtagccttgggcttagtaggcaggacctgctctcaatgagagccacctgctgtgtctaccacctgttttatccattccccatcagcactcacctgcctgtcttcccacccaaacaggggaacacatccttacatcttcccagggccaccactccatttgcagctgccccctttatcttctctaggacgttgagtctgtagtcattgattttcttttccttcctccatggtcagtttcatcctcattccagaatcattcctgcctgcatgcagacgtgccttgacacatctcatctaagtgaagcccttctgtggccacattcctctctggctgctgcttccttttatgctgcttttctgcagacctcccaggaccagctgcttgactccctgtctctacttttcctctcctggtttctcccccacccaccttggttggcgctctgttctactaggtgcctgaaatgggtctcatcaaggggccttgtggcctgcctctagttaagatcagtggccagttgggggtggcatctcagcagcatgtgacacagctttgattcctagaaacttgcttccctaagtgttttcgaccccagcttgtgatctcttcatctctctgctccttcatcccttcgctgtctcctgctctgccaggctgcttggtgtttggaggcccgcaagcctctgtcctcagcctcccccactctagtggtcttctctctgagagactgcatctggccccatgccgtcagatgccatctctctgctcatgacccagatctataaccaggacaagtcaccactgaaaggtaccctccgtcttcacttgggtctctagttgccatgtgaaatttaacaaaagaaaatatagtcgaagcacaccaaggcctcctcacctaactaaaaggggtcattgtccgctcagttgctgtggccaaggaagaggagcatatccttgattccccctttggactcaggtacaaatccagtcaactctccctctccaatgtgtcccatatccagtgcttcctgtcctctccaccatgccatctccagtcccagcctgggacgacacagcagcctgtctcctgctcacctcaccttgcctcatatcatccacagcccagcagctcttgtatgatttctagagagtcatttgaatcccactgttctcccatcacacccagaattaaatccaagctctcccctgtggggtgtacagtcccgttctccattccctcccccgtgtgtgtcgtcactgtgttctagctgccctggccttcttggtccctcacatttgccagctcaggtccacctctgtgcatttcccctgtggcgtctccacacagaggctctttcctgagaccttttcttcactgccacttggtcatcattcaggtgtcagttcaaatatctcttcctctgggccttcctgggcttctttggaaaaggcagtgcccctggccagcctccctctgacacagcacttgcttgtggtctccgtgttgttcactgtctcctgagattattttgtttgttctctgttttaccactagaacgtcagtcccccagaacagggacagggtctcttattcactgctctgtccacacctccgagaatggagcccagcacatcccaggcagacgagtacaaggacgatggccttgtttttatagaagttctggatgctcctctagggggatggtcgcccttgctttggcagagccaggatcagaacccagctccccaacatgggtttcttacccccaagtcccgtggccactcaggagcaggaataagaggcagctgaccttaaccaatgcatccatcaggagctagcccgaccacattgagtaggtctgaggcctgggagtcccacccagaatatttactttgtcctctcctagtggagcgggagagctgagaagattgctctcaaaagcttcaaagaaaaggacctgggattacttcaaacaataagtccattgttatgtctcagtgaccttgatgacctccagaagtagtgttctgggctcacagcacactgccctgaagaagggaaactctggaagcccagagggagtagctgtaggagggatgtggtcaactggaaagtccccaggcgttctatgggagggggacctatgctctgccatccttgggctggcagaggacttgggataaggattcccaaaggcaaaactgaggatgggtcttccttaccgccttgggtcgaggctctgccttcctttccctcacagattaaggcagtggttaaaattactgctttcagaagattatcattttccttggtttcctaatgctcctttttaaacctttttaaaaacgttccagcagcccagcttttgtccccactgtgctattcaattcctcttgttcccatcagggtggcatccacatggctaaagccggcggggttctctgtcttccgcttgccgggcctgcagcagcatgagggctcctgtcgctcgctgctctcctttccacagctccgtctgggtttccaccctctttgctggactttccttctcagccatcgttgctggctcttcagtcactgggccttggtgctccgtctcccctctctgcgctccctccctggacagccgtggccattccctcagctttccatcttgtccctatgttgattactccccggtttacattcccatccaaactcttcctcaaggcccagactcctgtttccagctgccaacatggcacctccatgtgggtgcttaaaagacactgccaacgcaacaggtccaaagtcagcatctgatccttccctccaaacatgatacctccaaattcccatctcagagcagcagaccagtacccccatcagaattcccaattcccttcctcactcctcttttgagtttcacgccaccccagcctgtgtaccagaattggacagcgcctgcctggtctctgctgtgggacccaggcctgggctttactttccttgcctgtgtcgtcatgggagcctcctgactcagctggtccccagtttctgccgcctgggagggagcatcacagtcggcctgtggcatcttttgctgcctttgaggaccttcttagccagcagccctttgctgaatgtttttcctttgccttctgccatctaacaatctctgaattttgctttttgtctatctcccctacttgaatgaagttccataaagtcaaggggttttattccagacccgaatcccagcaccttggtgcctggcacggagaaggttctcagggagcatctgctcagtgactgacagtgagggcacatccgcaccctccccatgtagctgggcctgagatggcttgaaaaggttcggccaatctgactcaaatctgaaaacattttttcaaattataggttacattttaggtttaatgtttcattaaagtttgattaccaccaaagaaacttttttcaaaaaaagatgttactggtggaaatccctcttgtaattctggagcactaactattttgatctgctttttaagttataaaatgctgaggttagatgccacatctatataaccaaggtctctatttagacactgatagattctaagtgagtttgttttgttgttttgctgagactgttgtgatttctgtccgaagagagaattggactcttcatgcctaaatgagctttcttccattaataggcacatttcatcttatgctccacactttctgcctctttttagttagtgatacttttatggatgcttggggttgccgactttgtggctgggatgagtggaggagccttgagcctggctctgcaccagggttcctatctggccccaccggccttaccaggtgggattggtgcccgtagcagcagggctggttaagtctcagtagatgagatggaggattggttgttgaatcattacaccagttggtccaagagctacttccttttctggagaaaaaggcctccaggaacatgaatgcattagaagctagcattttccccagagaagttcacgtgaaaactttttcccactctacccccactcatctctttccaaagaagctggttcattcagtcagggcgtgacaatttgcggaatctagcactacaaacaggattcagagtcaggagtaagtttgccatgacttattaccatatcacctctatgtccaaccaggagaccaaaaaaaggagaacctattttatttataaaagtaacattcatagtaaaaaacaaaaagtgaaacaaatactacaaaaaggtatttggtaaacggtgagattcactttcttctcagtttccaactctagtctcattctccagaggtgacactgcggacagtatcttgtgtatctcttcacaaaattgatgtgcattgttgtgatttcccctgcagcttcatagtgttgtgttgtatggaggtaccgtgatagatttacctcaaccctcttttgatgaacagctcccggaaacaagggcccccgtgctttccattgtgtaacctcacgttctagggtgaacgttgctaggggaaaagacgctactgagatgtttatataccatttaatggcacataagcttacttttgtttgcagctctttctaattatgaatagagctgaaatgaacattctcgtgcatgggtccttggtcatgaatggggttgtggatggatagacagatggataggttggtttccagcagtgtcattgctggagcagaagttttatgtatttataagtatgtgggtgggtgtagaaagttcatttttataaataatgccaagggctgtatgtcacttataatacgatgggaaggcatatgacttgggggctggccactggctaggactctgcagttcctcgcaatgtggctttggaccaattcttctcactgcctagggcctcgcaccactggggctctggtgacagttccctgggtggtgaggggaccgtgtccaggcaatctatcactttgattggctgtttctgtagtttcaagaaactctagacgatgtttactgagcctgtctgggagcaaatggacagaccccaagaggtctgatacgacggcgtttgctttcagatctgcctggagacctcttggagtctgagaactccgggcgattggaggatgggggtaagatgtgcacagtcagtttcaggtacttattcttcttggtgttagaccttctgagctggtgctcagcagatcctttttgtttgcttggttttaaaggagttagtgcccaaatggcagtgtttttggctcatgtttcttccctgccagcccagcagacatactccccagatggctgaaagctgctgtgggtcactggtgatttttgcatgggttgtgtggtttttagtactgaaaaagtagcaggctgggagtccaagggctgccagtgagtgtgttctgctttttcaaagaaatctccatagtttctgttttgcctttccagttatcagtatttttgtgattatataatctcattttgatggtatgtaagcttgctttttaaaaaatgaattatgggcagtataaagattattagcgtcaactgtattcatagcaaatatattttggagataaatcgggattttgagggtgaaaattttatcttcaaatacattttctggcatgttgtaattgaataaaattatagccctaaacgatagctccatttatgaaatttttctcatggctgtcattttctgcgtcgtccagactggagatggtactggggattatagcccttttgcagtgttttagccatcctgtgcctgctgtgtctctcagcttctcagacttcaccgtttgtgaatctgccagtcttccttcaccaactggtccgcccatcccatacccagccccttccacctgtctgtcattgttctgtctgtctagcatctgcccacaccttcttggtcatggggccttagcagacaggacagccctgctccactggccagtgggtggtggcccagtgggctgtgtagaggctgatgtcccgctcttgctagttcggtgctgtgatccagggtaccgctttcacagcaggccttacagagcttacctgaggttccctactcaggaaatcacagttagacctgtcctgcttactgatggtctcaggtgagagtttttctgaaacggaatgcccatcagtcagtgacagggtttgaaataagacatgaaggagaagttgtcctgataaagacagtacattaccataaaagtagactgatgatactgcatgcgtttcaggttgctggggggctgcttttgggcttccaatacaagagggaggaagaaggcagtggaagcgggtgctacgtcccttccctatctgtgtccctgagctcggccatcacatagccaccaaataaagagctcgggcatggactaggggaccctgtgatggtcagcttgtgggacctcactgggcaggtgaacacacacctatagggacccagttccagggcctggactcaaggaaccccacctggacacctgggatattttgttgaacccattgagctcctagtctgtgattgagccacactggctgagtgttttggacataaatatccgggatagtgaagacaactgctgaatggaaaagaaacagagatgctcctggtgaagatagccctgaaacaagggcccccatgctttccactatgtaacctcatgttctggggtgatcgttactatgggaaaagatactactgagatgctgagtgaagagaggagagccgcaggtcattattttcacgcacgtatgtttctttaaacttttattttgaaaaaatttcaaatgtatagagaagttgcagtaatagagcaaagaactctcatatattctttaccctgattccccaattgttaatatctctgccacattttaagtcatttccattgtcctgtacatatatagagatacatatatgcacatatatacatttatatgtacacacaccatgattctttggaccatttgagactcatttgtagatatcaagtccctttactcctaaatacctcagagtctattgactaaaaacagggttactcacttacatatcataataaagttaccaaagtcaggatatttacccttaataagatgcagggttgaaatctacagacctcgttcaggtttccccgattgttcatataaacatcctttatgttattcttttattcctgttcaggaaccatttgcattcactttaagatctctagtttcctttaatacagagtgttcctcagccttttcacacctgtcgtgacggatgggatttcttgaagggccattttggtttgtgtggtgtttccttggagtcccatctggtccacagacaggaggctgtggcccacaggcatgatgatgttggctggtccagtttatgctgatgttgatatttatgacttgattagggtgttgtctgttacgtttctcattaagtctttccccagtgtacatgggggattggttccaggaccccctccatgtaccctaatccgctcatactcagtcctgcagtcagcccttggaacccaaatttacaaaaagttggcctttcatatacacaggtttcaaataccaccaagactctattttccacctgcatctggttgaaaaaactatgcttattactggacccgaatggttcaaacctgtgttgtccaagggtcaaatgtattttccttttgtaattaagaagtaatttgaaggaagatgatttgagactgtgtcgatcctctgctctctgcagatgtccattgactggtgctgtcctgatgatgttgtccagtttgtctatcattctacattcttgagtaggcattctgcttgaaggaatatcagttattattttttgttccttatttagtttccaaatttgctacaatgaacacattatatttataatagaaaactaatgtatgtatgtgtctatgcgtgtgtgtgtgtaggagtataatgattgagtattctttatctgaaatgcttggcaccagaactgtttcagagttcggatttttttctgattttgaaatgtttgcagtacacttactagctgagtatcccaatctgaaaatccaaaatgctccaatgagcgtttccgttgagtatcatgtcagcacttaaaaagtgtcagattttagagttttttggattttgtatttttaaattagcaatactcgacctatatgtatgtgtatatatatttatgtgtatatatatttatgtgtatatgtatatgtatgtatgaagcatgtgtatatgtgcatgtgtgtatgtgtttgtgcatgtttgcatgtatatgtgtacgtgtttacatatatgtaggtgtatacggcatatatgtgtgtgcatttgtgtatctgtatgcatatgtgcatgtgtttgtatgtgtgtgtgtgtgcatgcgtgtgtgtgtgtgtgtgtgaagtttccaagcccacatcctctttggttggctgttctggccccttggttctgagtgcatggccctttgtcctgcctctcctggctgcatgctctgcagtttcccctgctggttccgcctcctgcttaggcctctgaggctcaagaggaggggacagtgagtggaatgcaacaggacccagaacagctagttaagaaaactcccagacactcagcaagctaggttagagacagattttgaagcctctatgtagagcctctgtcgctgccgcggaactcctcaccttctccccaccccgtgttcctcaggtgagcagcagtgagttcgtgcagacttcctggtactctgccgctggccaggttgagccttcccacgcccttgcctcctcggcgccagtctgcagacacactctgggctcgctcacggtaaatcctcaggccactgagcatcagcccaagagaaggctgtcaccaccagcagtcccagtgccttctctcgccagtgtcaccagctgactgtcctgccgcagagatgttggagcagcaggagtggacactgtggccctgcagctgcccacgtgtttgtgtttgtgatggtctgccttgtctgtgtgtctggaactcatggttccacccctcccaactttgcacagctgcagggaccatgagtggctgcagccttcagctgctgtcattgtccttacacaggaaaatgagtgcccccaagtggcctctggcctgaagaaagtccttttccttatctgttctaaatgtactgcccttcacagctctcatgaatgtgtccttgttacactagtgccagggcttttaggatgcccttcagggaaacttgcatgccctaagcacactccagtagagggaagccattcagatagggacatcttggtgcaatgttgaatggaagacttgaacagtcaccagcaaaacgtttcggctgagagtggaagaagctgtaggtttgaatgaaggctaccccccccctttttttgatgagtataaaattcaagcatagtagaagtgatgcaagcaactctttcctagggttcattcatcgaacagacgaacaggtggacagtgcagagtgagcaagagcaagcaagagtgaggaagagtgagcaagatgtgactctctgtccaggagcttaggagaggaagaaagacaaaaaaattgttcccagcaacagtggtaggcgctcactggattggcagcaggaccgcgttcccatgagcctgcgtgactagccctggagaggagatggtgctgtgcctgtgtcacgtgaaaaactgaggctccaggcactacagcctgcctttctgtgctcagctccatagggctgggatccggcaaagctgaggatggaaggccacagaggccctcccctgagtccatctacaagaaaaacagttcagtgctgtaaacaatgtacaaggaatagattagatagaggtgagagtcccaaagttaattccaatttaggaaaaacttcagctcatactcctggatatcatggatgaggtcagtgagatatcagaagaaaaggaagattttaaatgtgagatgatttggatggcaaataagctacagagagaagagagagaatgctggctctcctcataggtttgagaggacaagtgaaattctctttatggtcaagttttgtagcaatgtctgactcaagggaaaatgcataaattctaatactaagtaaaatacagtcgtgggttacaacatcctcttgaagttcagcaccttctaaagagaagggtggaggggcacaggactaaatgcttggccttgcagtaaacctaatgtggtgtcatggtgtctccagatgtaccacaggcttcctccatgatgtcacccatctgaaggttacctcgaagggggcagccattcctccaacatgtccttctgtgcctgctggacctgcctctgtcatgaccacacaattgaagtaggaattcagattgtggcacatagcccatttggggatctccagcatccttagagccaaaaaccatacccaacaaggagtcatgtgtgaaaacagaaatctctagctgactgtaaagcaagctaactgtgtcccttctggaatcttagccccaaaagacagtagctccaagagggccctgcccctgtttgggaggagccctcaggttgtatcttcagcccagattaaacctttctagagatgaccccagcaaggacactggtactgggggtcacagcccagatgcctttcatgccatactttcttatctttgctcccctttaatccaccaatggagattttttaaaagtggttttcaattttatttttgacaaaatgattctattttataaaaacatgtttttcaaaataacaggctatgcatatccattttagaaaagtttaaaaaaatggcagatgagcacatcaaaactgattcttccaaataagcctgtctacttggtataaaacaagggtagaggctactgctttgaatcttgttgtccacccccttagccagtgagacttgttcactgtggaaagtcctattagggtctctgaaaaccatggttgacttttttttttttttttgagacagagtcttgctctggtcgcccaagctggagtgcagtggcgcaatctcggctcactgcaagctccgcctccccggttcacgccattctcccgcctcagcctcccaagtagctgggactacaggcgcctgccactacgcccggctaattttttgtatttttagtagagacggtttcaccgtgttagccaggatgatctcgatctcctgaccttgtgatccgcccacttcggcctcccaaggtgctgggattacaggcgtgagccactgcgcctggcaaaccatgcttgactttcaagaactctttagttatttctagaactttatctcctttagaaaaaaggatttttaaaaacaacatctttttaattttcactgcaaacttgaaatctatcaattataaagcagaattttaaaacgtatttttaaattttagactcgggggtgtatgtgcaggtttgctacatggatatattgcataataatgaggtttgagtttctactgtacccatcacccaaatagtgaagattgtacccaacaggtaatttctaaaaccctcaccccctccttccatctttctccattttggagtccccaatgtctgttaattccatctttatgtttatgtgtatgcattgtttacctccaacttctaagtgataatatgtagtatttgcttctttgtttctgagttaattcacttaagataatggcctccagctccacccatgttgctgcagaagacatgatttcattcttttttatgactacatactattctgtggtgtatattaccactctttaaatccagtctaccattgatagacatttaggttgattctatgtctttgccattgtgaatagtgctttgataaacatacagatgcatgtctttttaatataatgatgtcttttcctttgcatacatgcccagtagtgggattactgggttgaatggtaattctatttttatttctttgggaaatctccatactgttttccatacaggttgtattaatttacattcccaccaacagtgtatttggctttccttttctccacacttatgtcaacatcttttgttttgttgacttttaagtaatagccattctccgtggtataagatgatatctcattgtggttttaatttgcatttctctgataactagtgatattgagcatctctttatgtgtttattggccgcttgtatgtcttcttttgagaaatgtctgttcatgttctttgaccattttttaatgggattgtttgttttttctggctgagttgtttgagttcattttagattctgggtattagtcctttgtcataatttgcaaatattttctcccattctctaggttgtctgtttactgcacagaatcttttaattaagtcccacttgtctatttttattcttgttgcattgcttttgagggcttagtcataaattctttgcctaggccaaactccaaaagttttttcctaggttttcttctaggacttttatagtttccagtcttacatttaagtctttaatccatcttgagttaatttttgtacctggtgagagacaggggtccagtttcattcagacaagggtccaggttcattcttctgcttatggctaaaatttcctgtagatgttttagtttgtatggatagagatgttcatagagatagccaattttcccagcactatttattgaatagcatgtctttttgccattgtttatttttgtcaacttggtcaaagatcagttggttgtaagtatgtggctttatttctgtgttctctattccatttcattgatttgtatgtctgtttttttaccagtaccatgctgttttagttccttgagccatgtaatttgaagtcaggtaatatgatacctctggctttgttctttttgcttagaattgctgtggctattcaagctcttttttttttgttccacatgaactttacaatcttttttcctaattatgtgaagaatgacattggaaatttgatagaaattatgttgaatctgtagactgctttgggggcagtatagtcattttaatgatactgattcttccaatccatgagcatgagatgtgtttccatttgtttgtgccatctatgattcctttcatgagggtttgtagttttccttgtggcaatctttcacctccttggttagatgtattgttaagtattatgtgtatgtatgttgtgtgtgtgtgtgtggccattttaaacatgactgagttcttgattttgttctcagcttgaatattattgttgtatagaaatgctaatgatttttatatgctgattttgtattctgaaactttactgaagtcgtttatcaagtctaggagtcttttggaagtgtctttagggttttctaaatataagattaaggcagtgtctcacacctgtaatcccagccctttgggaggctgaggtgggtgagtccaggagttcgagaccagcctggacagtatagtgagacctcatctctaaagtacaaaaaaaattagatgggtgtgatggcacatgcctgtagtcccagctacttggggaaggtaaggtgggaggatcacttgaggccaggagatggaggttgcagtgagctgagatcacgccactgcattccagcaaagtgacagagccagaccctaccaaaaaacaaaaacaaaacaaaaaaaacacaactcatgccatcaaatgaacacagaaaatttgactttctcttcttcaatgtggataccttttatttctttctcttgcatgattgctctggttagggcttccagtgctacgttttaatagtagtggtgagagtggacattcttatcttattccagttcttagggggaaatgctttcaactcttccctattcagtatgatagtggctgtggttttgtcctatatggctctaattattttgaggtatgttcttttagtgcctagtttgttgagggtttttttcatgaaggggtgttgtattttactgaatgctttttctgcatccatttagataatcatatggtttttgtttttagttctgttgatgtgatgaatcacatttattgatctgcagatgtcaaactatccttgcatccctggaagtaaacccacttgatcatgatgtattacctttttaatgtactgttggatttgctttgctagtattttgttgaggatttttgcatctatgtttttataagggatattggcctgcagtatccttactttgttgtgtccttgcctgatttcggtatcagggtgatactggttttgtagaattagttaggaaagaatttcttctcaaatttttggaatagtttcagtaagattgggaccacctcttgtttgtatggctgttaaaatttggctgtagggccaggtatggtggctcacacctgtaatcccagcactttgggaggctgaggtgggtggatcacctgagctcatgagttcgagaccagcctggccaacatggcaaaaccctgtctctactagaaaatacaaaaattagccaggtgtggtggcacgtgcctgtagtcccagccacttgggaggctgaggcagaagaatcacttgaacccaggaggcagaggttgcagtgagctgagattgcaccactgcactgcactccagcctgggagacagaatgagactctgtctcaaaaaaaaaaaaaaaaaaaaaaaaggaaaggaaaaaaaaaaaaagctgtggatccatctggtcctgggctttttttttttttattggaagatttttataattactgattccattttattacccctgcttgtctatttaggatttctttttcttcctgattcaatctcaggaagttgggtgtttccaggaatttatccatttcctctaggttttttagtttgtgtggatagagatgttcataataatctgtgatgatcttttgtatttctgtggtatcagttgtaatgtcacctttttcatttctgattgtgctcatgtgaatcttcttttgttcttaggtaaacttgctagctatcaattttatttatcctttcaaagaaccaacttttgatttcattgctcctttgtgggtttttttgtttttttgttttgttttgttttttggggtctcaataacacttagttctgctctgatctttatttcatttcttctgctagctttgggttttgttcttgtttttttagttccttgaggtgtgacattgggttgttaatttgagaactttctgtctttttgatgtagacatttaacactataaaacttatttcttagcactgcttttgctgtattccagaggtgttgatatgttgtgtctctattttcattaaaaaaatttctttttctgccttaagttcattgtttacccaaaagtcattcaggagcacgttttttagtttccacgtatttgtacagttttgagagttccttatggtattgatttttaattttattacactgtggtccaagaagatacttgatatggttttgattttttaaaaaatttattgaaatgtgctttatggcaaagcatctggtcaattttgtttgatgtgcagatgagaaaaaatgtatattctgcaggtgctgggtagcatgttctataaatgtttattatttccatttgatcaggtctagcttaagttcagagtttctttgttgactttctgcctcagttacctgtctagtgttgtcagtggggtgttgtagccccccactattattgtattgctgtcattctcttcttttaggtgtagttgtatttgttttatgaatgtgggtgctttggtgcttgcacacgtatttccaaaatttatgtcctcttgtattgagtgcattcttatgatataatgcccttcattgtctctttttttaaaactgttgttagcttaaagtctgttttatctgatataagaatggctactcctgctcacatttgttttccattgcatgatatatatttttccacccatttactttgagtctgtaggtgtctttagccgtcaggtgggtctcttgtaggcagcagatggctgggtcttgtttttttatccagtttgccagtccatgtcttctaaatggaacatttaggccatttatgttcaacattaatattggtatttgaagtgttattcctgtcatagtgttgttagctggtttatttatagtctcagttgtgtaattgctttatacagtgagctttgtctacttatgtatgctgttatgatggtgagtatcatccttttgtttccatttttataactcctttgagaatttttttgtaggatttgtctagtagtggcaaattccctcagcattggcttatctggggaaggctttatttctccttcatttttgaagcttagtttggcagaatataaaattcttgacttacatttcttttttcttaaaggaggctaaaaatagacccccagtctcttctgacttgtaaggtttctgctgagaagtccactgttagtctaatgggatttccattataggtgatttgacacttctatctaactgcttttgaaatttgttctttcatgttgaccttgaattaatctgatgaccattctttggtgaatgtgcatcttctatagtatctctaatgggttctctgaatttcttgtatctgcatatctacatctctagcaagtttggggaaattttcctgaattatttccctcaaatatgtttccaaacttattttttttcttctccctcaggaatacctataagtcctaggtttaaataatcttacatttctcaaaggctttattcttttttaaaaaattgttgtttcttcttatctgggctaattcaaaagactagtcttcaagctctgaaattcttctgcttggtctactctattgttgaagctttcaactgttttttgaaattccttcagtgaacttttcatttccaaaagttgttgttgttgttgttgttttgtttgtttttaatatatctatctcatctttcatctccagaattactcttttgttttttttgtgttggttttcaactttctcttggctctcattgagcttccttacacttcatatcttgaattctttatctgtcatttcaaagttttcattgtggttaggagccattgctagagggctaatgtggatgtcacaacattgtttcttcatggagctggagttcttgtgttggtttcttctcatctgtagaagcggtcactacttatttttgaatttactttcatttgcttggtattttttcttccctcccccaccttgaggatgtgactgttctgtatgttggttaagttcctttgtcttggcttctctgtagttttagggggccaaggcttttatgaattacttggttatagatagctttagtgtagtggttttctcaaatgctagttgtttgtaggttgtagtaacagtgtgctggaccagtggtcagactcactgtctcctacagagaaatggggaggtggaggtttcaggaggcttatctcatcccccaccgctgtatactgtcagccggaattactttgaattatgcagttcaccctacaggccagtaggtggcgcttgcagttgagaggcagttgcaataatagcagtggaatttttggcctttgttgatgtggggaaataccagggtttccctggccatgggcgggattcccagggatcccgtcctgcactctgccaccaccctggctggaggcggcagagctgggtatggctgggtctggcaagcccgtgaccaggctctccagggcaggtacaagcaccaaccttggcgggggtctagggacacctctcaggccactgggacaaccctctagtgtgcagcacagttgcctttcctgcgcaacagagtctcttcagtaggaggagcaactgggatgcttagcccagcaggtagccctggagactgccagctcacactcccccaaccctgtggttctccctccagcatccagccctagcaactggcccaaccagctaggcttctcccaagtcatccgcactgccctgagctcctggtactcaggacctcaggactccctgcagcggaaaccaaggctatcaggccacacccttctgggtctggtctcactaagggtggggcacccggctcccatgccaccccttgaacctgcaccacactctttgctgtgttcagacagtgggggctcctccagtatttgaaatcagaccacaagtctcatctccatagccctgggcagtgtgctgcgtcctggggagctgagaccaggcctcagggtcaagcctcagctgtggtgggggacactgaactgctcccaggctaacaacaaaacacttcaggtgggacaatgcaggctattaagcacattttttttaagtaggtttgagtcactataattgaacaggattattatgcgtgttctcattatggtgagtagagccatataatcatgtgtagtgcttcagttatcccttatatcaagaaataatatcattaatttaaaacagaactaaaaataatggcagaattacattcctttttggtgagattaatttagcctaccctggttggttatgccctagtctgaagtaaatgtaatttaccccaaacctccaggcttcagggtctgcccaatttgaggccttcagggccacatggaatcaaaagcctttttgtgtgaagccttggagcccacctggtacacgctgggtagtgggttgcagtggagaagaaaggcaagcagagccagggcggggagccctggttagatcctggctccagtactttccacctctgtgacatcgggcaagctttctgccttccagaaatagctccacctcctgtcaaaggggcagagacatgtgcgtggagttaaggcttcctttgccttcctggcacagcagtcttcctgctttctcctcaaggcccctcggaggccaggtagggtagggtaggtcacccagaacaggatttcatccacatgcacaacctcatatcacgtcttcgggcccttttgcctgctttgataatttctcttaccctgtgaatgcctccacttggccctgtgattacaacctggcttctccaaaacatttaccacgagtatttaccagagttactaaaaagtccattttacattacatcctaaaagagcttttgaactaaaaagtatgctagatcataattaagcactgggatgaaactggtcgcaagagctgctggcccagaagccctcagatgtctcggtttctgtgtgaaggtctcagggtaggtgtggatctcgggtactgtgggtcagtgtgtgcaccctggaggctgggccgtctgtccagggacatcttatgctgcagagggctcgaagaggacaaagagagtgccccatttgctatttttacaaggcgattactgctgagccttgagcaaagactcacagccagtcaggaggtcttttggatgcagtcatgagattccctgagcctgtaagttatccaagagcaaggtctaagactgtggcaggaagcaagagtgagggtctgtgctaagattgacagcaaggaggggcctgaatgactcccacacacacatcaaccccgtgggggccactgagacaaaaaaccaggtgccccagagtggagtttggggccgtggagatataatgatctaccttcaactccaattgttcttaaacttcttcctttaagtttgcaaaaaaaattaagctcttgcttttttgtctatgcagtgaatatgtaaaaagtgacaacagaaagtctgggaacagtggaaccttctattagcacttcagggcttttataacgggattcagtgccaagccagccagaggcctgggtagctttgcaaaccattcctcccccaactaactctaaaaagacagagtttcatgctgttgacataattatgccctctttaatattgccgttttatttttaaaaacaatttgctatttaggggcttttttgcagtagagagaaagaaattgaggatttgaggggtggcttttctgactgaattgttcctgctgcatcttaactggtcatgaggtttgctttctcagaactgaaatcctgagttggaagcagctttcagggtcctgcccctgcacccttcggtggttgtccacaggccttcagctggagcctgccttgttcccagatccacggtggatccaagcacgtcccagggagggcacgtgtcaggggccaggatcttttcaagagggtatctcattaatccatgtcatagcaacactatgaggctggtgctgcttacagatttccattttacagatgaggaaactgaggcacagagaggctggatagctcagccatgttcccacagctagttactgatgaagcatggttatggccaagtctgtttctaagttcctctttggaaccaccaccccaggccaagataggtcataactaatgtagaacttccatacattgattaagcagtgttttgcttacattactgattctcagagcagttccccacagcttggatgaggaaagcaagtcttagattgctaattacctatccgaggtcacaaagccagtaggaggctaagccgggatagaactcagatagaacttgtgggtctcagcttctcacctttcctggtgttaccagattcttatattccctaaacaagtcataccttggaaattaactgcctgtggtaacaatctccgctctgaactgtgagttgctgcggggcaagggccttgacctgctcgagagaaccttctaggcccacctcgtgtgagatgcttgaacactggatgggccagggaaacccaggcctgctccgcaggagacctgagcccccagcagtgctcaggtggttactaaaggggcagttggtgctgtacagaatgctcctcctagaactgccagctctaaaagactccgtggtcagtggctggcagtaccctgtaataggagccctcgtacctcttgtgttccttacaaacattctcatcagtagctctacgcgttgactgggtggtttgagatggctggtatacacagggctttcttggtgttctgtctctggggcttagctttgtgtgtggttggagggccctggtgagattggaagtaccagagagtgctgtgtcaggggcagaggggcctgtcgctggagctggagggtgcctgcctttgtgtctgactcagtctcctgtctgccttgccccctcagggtctcgccagcccagcctctgtgggaatctaaaaggagtggatgtggacgtgtgaccaagcacatctcagcttttaatacccgggctatttatagacctttggggggatggctgtggaacaacaggggttggggagagagtttaaagaaaaatgcagcagggctgaaaaaaaaaatgagaaaaccattggcatggctgatttgaacaagaaaagtggcaaagagacttggagagagatgagacacacacttcaacataatttcactttcctagagaagatcatgtatcctcagtgcagataagctcattgagagactcagggaagaagagcattaggaaccctgatttgggtagcagaaggcatgcactggtcctgaagacattccctatgatggttagcatatttataaagcattgttggagctcagttatattttccaaattcctgtttttcttttatgttaatgcattttaataacattcctacctaggacccagagacatgttttcttcacttaaattgtatttctgtagacttattcagccatgtcagctgtatttgaatattttgcttgttagggggaagtatactttcattgagtgacacataaattctggaaaagagatggtggatttcttgaaaaataaataagagttgaaaacaagtctctgggtcctgatccagccccagccctgggatttctttgagttggagaagtggcccgtaggtggcaggcagggggcagtgaccctacctgagagtgcaggctcccctggctggtcccccgtctgctgggaggctaacctgccctcacagagaagggctcttccgctctcgctgagccccgcctctaccaccccgacctgggcactcaagcttgagtgacattgactccttcctgcccaccgggtgacagctgagggtagctagctgtaggagggtcaagagggtccctgtagaatggtgtggtcccagttcctgattaaggtgggggcctcccagcccttccctctgctgtcagactccacaccggccacagaaatcaaagttcagagcaagtaagcacccccttccaaacacaagaaaaggggccagagagagcggggagcctcggagggagtttgtcaggacaaactaacattctcacccaccctgcagatccagctccaaagctgccactgacacatcagttgcgggacaaagattatttggaggttggcagatgggtctggattcagagaacgcacgtgtttcagcctctcagctgcctgtgtgtgatttcactgccatgggaaagcattgagcgggggtttttctgaccagttggtgtgagagttgtgttgttgcggttgttgtggttggcgtcctcacccccaagtccgggtcttgtcgtatgggagtgggagagcaagtccgtggggtgattgcatcactgtggctggattcactccctaagggagccggtgcaaggcagcctgggagcccagcgggtgggtgggtggcctccctgctgcccggagacagcctgccccccagggcacacgcaggctccacacagccagcctgggacagtggggagagacggaaacacgctcccttgcaagaggcagtcgcaatttaaaatgccatcttgctcctctgactgctttttccgggctgtcgaggtaaggatttgttaaacacacctcgtgttctgggaagggtgcattgctgcagggtcttgcctggaagggatagactcccgtcctctggactctacttctccatcccttggcctggagctgctcggtgttcatggatttgaacagcaccgggcaaatgaagcttgcttgtaactttgtaggggttaggggctaaagaatcttgtgactatgtttttattatgcccttcttttgtattaattcatctccactccaccctgagcctcagtgtctgtgaggggtgaggtgctgcgggaaaggctgtaggtgccgctgctggaccctgtgccctgggagaacaggtcgactcgtcaaaggttatgatgggaagagggagatttacaggatttgttgttgcttgcttgttttttcaattggttcaactgtaaaatgtccaacctggagaccaccagcgtattttaaatgaatcctgtgaatcctgtcacttcttaagacaggtttggtggtttagccgtgtgctgtatgttcccatgagttgtcctgggcattttaagagtatcatgttgtaatcctacctgctctgcccccaggaggtgggaaaggggagatagggaggaagagtcacatccctgcagctggtggggacctgttggctgcctggaaaaacagttgcccatgtgttggagcactactatttttactttacctgttttcttttgtttcagtttttatttcttgaaagcccgaagttgtttatctgtaactatcccctttgtgtgttgcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattaggtagggaaccatcagaacaggattggcacctggggatgcttatgtgcaattgaatgaagaccgctgctgccaaatgccaaatgtgtgactgcagtgtcccctgcgaaattagcaggcagtctctgggttcccctcgactctcctgtttctcctaaaatttcactctcctccctccagcccctttcccctagtactttgggaatcttgccttggatggttgaggtaataacttgccaagggctcagacatggcgaggttccctgtggcttgtccagcctccccagctgtcagagccacatggagcttgctgcacacctgtgggcgggggacaggagggaggtgcccttgaggtgctctggagagagctggccatgcacaggattgcagctgcccttctgagatcagctcctcagctcatgggaagaagggagccatggttataggcagcaaagtgcagagaggtccgctgggaattggagcaaattatgaagtactttgctgtaagtttgagttgagtcttacatggcatctctgcctgctggttaataaggctttgaacagtgttcatgcacgtgtatatgtgtgtgcccatgtcatgcctaaaaagtaagagaatattttgtatcacagaatatttgaagatattgactctttacagaacgtattgaggtattttgttcaggtggcttattttaggtaaaaaagcttttcagacttttgcttaaattcttatctaataaatatagttcttacaaagtcatagtaaaatattcaaaaccaaaattttctctaaatcaacagctatatttgttccatgtcttgaaggagagaaaaataacacagattggaaacttcccatagttctaaatttttctcatgaaccttttttgaaagattaatacattgaatttaaacctctaggtctggaatacttaatttaaacctctaggtctggagtagcatccttccaggtaatattatacaatttaagcctaaataatgcagtgtaaatttgagctgacaccaccttaagtctctgttttctaatgcgccctgtactttggagagacggtatgctttttgaaggaattggatagaactcttgctggtttctttcccatctctatcaattgctaaacgcatttgtgtgatgacagaagccttctcctccattgtcactaacagctttctcctgccaggatcacttactaggtccacagttagtgaccatgatgtcacagttgttcccatggagactagctgtcccgtcaagctccagcttgggacgtccatgagtggatcctacagtggtctgataaggctgtcaaaagcacctgttgacacacaagtaacttggaaattagacagcagtgggaaaccttcagcatgtgtctctacatgtgtatatatatgtatgaaaaaatatatatatataaaattttaaaaacaagtctgtatagtttgacccaaatacaatgattattgttgaaagcccattcacaagtctcaatattcttttcatttgaaagaactatgaaaaggacttctgcggacatttagtacttgaatataattggacacactcaggacacatagaaattgggtacagatatacatacataaaattttaacatataaggaatgtttcagaaattttgaattatctatttcatgtgataccctttgatttctagactatcatatggtagataaataaatgatgcattaaaactttaaccaaatgaagaaccatttactctgagagaataggaaaagaaatgtccataagcacacaggatttgtagggatgtgatatttacataccttatttctttctcttctttatagatggacttaatacattctagtgggcgatgacactttattgtaaaattaagtataaaaggaaaaaaagggaaagggaaacaagtgaaatgattaaaaaaaaaagaggaatatttgtgtcaaattttgggtcctgtttcacaaaaaaaataaaaaataaaaaaataacgaacctcacacagccgggatttgaagatacatgaaattccttagaatatccttcctctccttcctcagttttctttctcaccaccagtcccgttcttattagttactaggaaacacatttttctgttggctgggtttgcagaggactttgcaagtttttagagctaccagtttcaccagcctataaggtcagtacccccaggactcattcccgttgacacagggtttctgtgtccccatccctataacttctctgaatactgttttgtgacccaaccatatcacttaacgttttttaaaaaattaatttaagttgctgtttaactaaaaatcttatttctgccatgatttggcagcattcaactatcagaagctcattagtgagaaaatgcagggctgcagggtgcctctcagagagcctgttgagtatctcagctttatccccgttggaaagggacgcaagggccacaaggccaacaggggcttcttctttatcatggatggtattcctgggcccttctggccctccaactcttagggcacatccccaggcattgctgtctccttgtagagagcacttgcccaggtaattatatgtcaggtattctcacagggatgtgtacatacgccaggctggtggctggggcaaaaggcaggtagtgcttgcaagtctataaggcagatactaaggcagattgtaacccaacccccccataattgagggtatagggcacccaagttggacagcattttaagcctatgtagggcctccagaattgaagattccaaagtacaaagtacattattactgattgagtatccctaatccaaaaatctgaaatctgaaatgctctaaaatctgaaatgttttgagtactgttttgatgctcaatggaaatgctcattgaagcatttctgattttgggattttggattgttcaactggtaactataatgcaaatgttccaaaatttgaaaaaaaatccaaaaaccaaagcttctggtcccaggcatttaggataagggatattcaacctgtataaggatcttaacagctaaaatatcagtcccttaataatattaaaccttttctatacccagaaggaagtgatggctttagaaaaagtgagggtagttcccaagatagcctgcagcaggtggttccctttctgcgggagaaaagcaccatgcgtgggtgtctgcagcctggagggcatcgctcctctgagatgctggtcaccctccattggcagcaacagtggcatccctgctgtcactcggcagagtagcccctctcgctgagggtggtttttcctgcccgctctgtgctgcgcttgtggataagcagagaacgactcctatgagcagactgaggtcaggtggcccttcccagcgttagctcctggggacattcactactggacgcacttgaaaaagttgttgcaaagccccttgccctggtaggtgaagccctagtgaatgatggtctgttttatgattcccagttcacttgtccctttaaatggtcccttcctatgttagcactgcccccaggttctacctgttggggatgtttctcagtctcagtgtctggagtggagttcttagccatgaaaacactgtccctgacccaggccactcaacagccgacagtaagtccagctgaggctgccagaatggggcaggttttttggaaggtgtccccatcccttctgccccgagcatggtgagctgcaagtctctggaaggttcaccttagccagggcagcttcacacatggaggatgcagtgatattaaacagtcagcctgcagacatatcaagtaaacaaattatattttaaaagatatttttggccaggcacagtggctcatgcctgtagtcccagcactttggaaggccaaggcaggaggatcacctgagcccaggaagttgaggctgcagagagctgtgtttgcatcactgcactccagctgcttgacagaacaagaccctgcctcaaaaattaaaaaaaaaaaagagataaaaggaattttgaaaaatacaaatttaaacatacaaaactagtatcttgatgccccctgaacttgaaaatgggattgcagataaacccatccctgggaatgtggggggcacctggtgcctggggctcttgcacccaggccccaagtaactgtagacatcaggcatactaaggtcagataatctgggagagaggctggaacttacacagagaacacagtaaagagaagagggtttccgccagatcttacaaatttcaaggatttgaggaattccgttgtcctgagaattaggttgaaacaggaagagcaacaagtccttttcgggctgtttacagctttgtggttgttcctggtcagatgggaaacaccgtggcagtaactctggaggtcctgtggctgccacgctgttggatgctgacagctggacatgcagaaaggtgtggagggagaaacagccggcgcctgttgactcttgctgattagagggggccttttgcaggctggttttatgtccctctctcccttttgtatgtgaaaagcaacaaaagatgtcctttcccccactaaaatttataaatagaagtccacttacggccttatccacacgtcagggctatctcactgattactctgttgacagtttcttagcctgggaaagccctgagcttgctgacagctcttttctctcccttgggtgggctgtgctgaggaatgatgggcagggagtggcccaagggctgcagctcgatgtgaggccgagacagtggggtgcacagcttccgtgcaccggctctgccatggcccctccactgccaactggcagcacaggtttctgccgaggagtcacactttagctgcaagggttaaggcaaggaagtaagattctcttttttgagttgtcttgatatttaaatattttttcttgaggagtagagtaatgccagcattagtttcagaaatttgaaaaatacaaatgtacttcaaggaatttttgccctttccatttcttgaaattatttttggaatattatcttgaaaagtagtgttcccatttaacttaggccattgtaatcatatgcagtttatagatagtgatgtgattgtttataatcatgcaaggtcatttgaaaatacatatctttaaatcatggagaaaattaaaactggagggaagatctttgaacagatgtgcagtcgacggccaactggaacactggtgcctggagcatttgtgccaggggcactcagctgcatccggaggctgcacagctctggatctctgagaaaggggtcacctgccacgttgtgttcactgacctgctgtgagtgacgaaaagggagttgatgttttgtttgtcttgggacccacctctggggatggtaggcgccctctggagtcaccagcctcagaaaagcacacttctgtcaggatacacagtcagtttcacagcccaccggttatcccgagttcctgggcccccctttgccagggcaccaagccctcacctgtccacctggatctgaccaccagggacacgtccccctgtgtgtttacactgccatgtgcaactttcccatgatctttccaggggaggcgcagggagacaggaaagtattgtccacaaggatgggcgcctgcgtgggtttggccaccccctttggggctggtggctgccccaggcatcctctttggctctcctcagggttctttggagacaaaatgcccttcgctttggaaacagacatatcctcctcatttaggtagctatcacctcccatttttatttctccttattttgcctgataaaaatttttagttctgtaaatcaaccatcaacaggttattagattgttggttttggttttgggtttttgtttttgttttttcctgtaactacagaaagacatttttctctgaataaacatttcaacagaagtcattgatttgttttccttctggaaaatccattttcaatgaatgaacctctttttggaaagcaaacgtaacagtttttgttgcatgttcttggtttctctctttttctatcatggggagacatgagggccacgtattggttcacatgttgctagcagcattccctcccagacagggacaaatgggaactgctccacacttggtggtggtgccaagtctgagctttctggcagccacggggagaaaattcctttccttcacaaactctggctttaaatgtgtttttaccaaggaatcctttccttgtaatgtcaaaaccggggccgagcacgaatcagctccagaatttgcttctgcatgccggtcggggctcatctgagatgagtgcccatggcgacagttgttcgttgtagatggaaagtcttttctgcattctgagatcactttgactcagaaatgcttttgcctttaacttcattccttccttccaagatgaaactttcctcaagattccagtctggctgcaggagaggagggtagggtcttaggataacagaactaccctggtgtcaattccatagcatgttaatctgtaccattttggcatcacttcacactttgaccctgctgtacatttgttcatcttgtttattccatgatttaataaggttagtttcccatggccaccatcctcccatgacagtttctgaggaggtgcctgggaagggacgtaactgccatgaaagggagcagtgcggcctctctgggcacacgctgttctagagtatgctgagttcttcccgctccacttggaaccactgtgttcacacagtgagggaagcgacttttccctttctgggggacagtgctgctatgtaagatgctgtgaaggaggcgtgtgcgtacgtgcatgtgtgtgtgtgtacgtgtccacagcgggtgctggaggatggagtgtgttttcttccctgccttcacgtgtaattcggttgacaagaactattccatgatgtgcgtgcgggcttcagtgtgaaagatgagtatgtacgtacagtcttgctgtgcatcacggcctctcccacagtacacagcaccatcttttctggcaaccaagtttgatgtcatcaaaaagcttctatctccttccatctctgcaccttcttggtcatccccctcctccacctctttcaagttctttctcctttgtctttgaatattttctcacttgttatagtctttacaagagttgaaatttctcaatttaagggcaaaatcatttgctaagagtcttacgggctcattccttaacatctggttgatgccaaattcaaaaagtatataaaaataagtattgacctgaattcttcatgctgtatatcttaagacctcttatgcatttggtaatgcattaaagagagatttaaatttagtttccttcctgacctcatctttattcataatgtttaaagaagaatagaaagttgaacaaatcttccatttggttgtaaagctaccatgaatttcccacctgttgcgtctcacacgtgatgctttgcccctgcagagaggtgcttggaagaccatgagctggtggtccaggtggagagtaccatggccagtgagagtaaatttctattcaggaagaattacgcaaaatacgagttctttaaaaatcccatggtgagtcttacctcttcaggtttggggtttgggactcttgaaatcttgaagtttatacttgggtttcatagtatcagattagaaagtgactgagaggcatggtgtagcatatgggtttgagaatcagagttgtagtttaatgaagcagtccttgcttgaaacccagtctcatgcttcactaaatgtgcgtgggactggctgaaggtagaggtctccttcttcacatagacacagtgtaaagggggttagtctctaagacaggagctgggagaggctgggtgttttctgttattttgaaagttctcagttgaactgatcaaacacttagcagaagaaaaactcattattctctgcaaatagcaaatatattttgtgatcatacgtggaagaatgactagagaaatcagtgcgattggttggtgtcttgagctggtcaccttgatctctcttttctttctttgggagaggcacttgtcctgtgagaggccaggatagggagggcacctcctagctcctggggcactcgctgtcatcctgagtcatgggtcagagctgcatcaactggggagaagacccagggccatttctgactctgataatgtagctgcttttttattccaaagtaagaaatttgaagactgtttttggggaatgcagcagaacaggcttttctcgtgactgggcttaccttttagtttcaggaattctttatctcacgctgtgcacttgtgccactgggctgggacgctggcatcgctctttgccatggagcatgctgtgagacatgaatcccttagtaaacatagttggtattccacactagtacccagcatttcaggaaacaaaatacaaccttttgaaggaggtgtttcttctgtgtgataggagaataaaaaggaccgccattttaaatacaggtgtatgtaattatactggtaggaatagttttaaaattgacatatctatatgacataccttccctcactttgaagctaaccttttacgtatttgttttttcccattttcttagaatttcttcccagaacagatggttacttggtgccagcagtcaaatggcagtcaaacccagcttttgcaggtactgggccacaatagatctctgctgaaatagactttctgaatagaaatcctcttggaactgaatggcagcattgtaaaaaacctaaagagatcgcatctttcaccatttataaccttggctcttaagccggaggggtggtgggggggagggtttagagtaaccagaaattaaaagtttccttggaaaatctgtgtgtagctgggttccttctaagccaaacaggcacttacacgatgcccttgctctgacttagaagagtccagtgatgccactgctgagtgtgggccagggggtgcatggagaaaccccagtctcagggctccctccccagctcctttctgagcaggggtcccaggtcaggccaccgcctagctgcttggaaatctctgcagaagcacagagtctatagtaaaagatgatcgggttaccacaacagacttttaaaagtaacttgccatatattacaaataaagaaacctgctttaattgtcctgattcataaagtctgttctaagaaaacctggtctctccccacctcctcttccagtggagggagccaccagggcctctgtgcccagctctcacacacactcctccggggaagctgggagtggggaatgggaatgttacagctacaccctaaaaatgtgcctgtgtacatgttaaaagtgagagaataaaccatttcctaaggccaccaacaagatccaggtgacattacatgtaagagaaactactaaaatgtagttcctacagaattctcctcataagccctttttctacgttgttatcaccaaatttgtttcagcatctaaaagataagagtttcagagctctgttctggtggtgtcttcagaagcccttctgaccatagcatgtgtctgttctggcgagaggtgtcagcactaagttaccacctatacacagtgaacagtgaaatagcagattctgttttaattgccttgactttgagaggatccatgcgctttgtgaagatgtgcagtgatctcttgagactcaagaaggactgacccaggtgcaccagggctctgtccgacgtgcctttcccacctgggggaaaagagctttgtcccctcccagtctagtagcaggacctgccagcatcacctccccaacttcgctccatgacctggcccttggcctgtcttccctttgatgaaaagcgtagtttcttgttttgttttgttttgataaagcctttattcttaaggctgcctgtgggaagagttagctggaacagggggacatcaccaggatgtcctgcacctgggtgcatcacttgcggacacatgacaccttttatgtgacccttgactggaggggtgcctgggtaaaagtggccactacatactcactgtcagtctccagagtcccaatcacttggtcatggcacttgctcttgccctcagtctgatatcagactggatccttcagtgcactatcttatagggaaattcatgactcgtgttatcaccagtgttggaaaggtccatttgcttgcatatgtttaaatacgaattatgttctatgcaacacgaattgagatgggattttaagactttggaaaggagaacactctcattttgatccaaaaaggagtcttttaataattcagaaaatgtcagctatgctgataacatgtctgctttaattattttagattagcattatgtgattttaaaaatttgttcttcaacagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggtgagctttaaaagctaccaccaccagccctaattctgccacagtcactccccccaggtcctcagagtgaacctgggcttcatttttaaatgcaccttagactcctccaagctcaggacaacttcttaataagctaattgtgcagcagctgaacttggagtcacaggtttcctggtctcgctcagaaactaggtaataaataatacaggcctaagaaccccacctgcctagccccacccccactgcgggttgggagcagacacccctggctgccccatcacttcagagactggcctagttctcataagttgggatttaagctagctgtaaagatgtttgatagactattgccaccctaatgccagtgtaactttatgtatcatagatatttcatgaaataaactgcaggcttgcatgtatccccagtgagaagaaggtgggagatggaaaacagctgcaggccctcaaaagagagcttaggccggaggctcctttgctcccatgtacactcttgtctgctctcttcttgtgctgtccacatataccctgtggcaggagccttgtccacccaatacctggctgagcacttaccatctgagggctgtggtctcttttgctctggccagcagaggtgaaagggagctggcgggaccccagcacaggtgttgagcatctgggaaccggctctgggaaggtgttggggccggctctgggaagtcagcagctgccgacacctgggccagagagaaggggcgtctgcagagaggggctttgaactgacacagggcatggtagcttcctgacctcccagctctgctgtgtggcccgctcactgtcctcgtgtgtgctgaagttgggagggtatttcgtagagcaggaaacagagctgggctggagagttgaggaggagaagggtgggacaagcaagctaccagtgggaaaacccaaagtacggttggactctggactcacaacaaaccaaaggcagacaggccctgtgctcttaactctgacctttgggttatagattttctcctgctttttatcttgaatatccggtcatggggctttgatttgccagaagtatcaaatacgttccaacagccttgtgtgtctgagaactggggaagtgggtgttttgggtgagactgggtgaatttggttttagtttagcacttattacacctcgcgtaataatcatatgtaatatgtatagtgtcatcggggaaagtgcttgtaagtgtgcagagactgccctctgtctaccagaggtgaacacatttgctctttgctgtgcttgagactttaacctggccagtgttgtcacaggaacccagacacctgcagctgctggccgacctggaggacagcaacatcttctccctgatcgctggcaggaagcagtacaacgcccctacagaccacgggctctgcataaaggtacccacgagctgtccacagacggcgcgcatgctcagcagcccacaggagactgacttcttctcttgcccagcacttgattgttgcttctattgtcttcaacagaaacatagtttcacactggatttatccattcctgtaaaaacatttattgtacacttgctgctatcagtccttgagtagctcagaagctcaaggacaagcagacagggatggataatgtggctagtgggctcagtgttttagggagggtggcttttggcatcaaagggtgggctgtggctgtagcccagtactagtagctggaaggggaggtggggcaagggaggggacccccagcctgtcacctgggttgcctgcatggtactgagtgagctgatggcttctgtgtgggcctctggctgtggggatggtcagacaggaatagacacaatgctgcccaccctctgcatgcatgtgtgtgctggcatgcacacacacgcgtgcacacacatctacatgcacatacccacacgtgcatacatacatgtatagacatacacctttgtgcatacacacaggtatagacatacacctttgtgcatacacatacattatacacacatgtacatagacacacatacacatgtgcacacacctataggcagagcccactccttttcccctgatgaggttgtggtggtattaataatcataatggtagatgatatttactgaatgcttactgtgcatgatatgttccactgacagttttacatccattatcttaatcttcacagccccttgtgggataggaagttggccacattgcccacatccagtagccagtgaatagttgtgcttggagtttgccctgtaggctgacttatgagccatagcccaagccacatcccgagaacacacaatacggggagcccctccttaggggaaaatttctttccaaaatatcacctcataccttgctcagggaatactctttcggttataagtaataggcgtctaattcacaccagctagaggcccaaggcagcctcaggcggggctggaggtatgagcagcagctggcactctcccttcccaccagcccacaccagccatgcttgcctgtctctgcaaacgcagtctctgcttctctcatagcaccagccgagcgcagggtagtcacacctgtccctcaacccctccagattcttgggagggagagctggggtgtgtccagcattgtttcttgagtctgaggtcgggggttcttctggagatgcaggtcagtttatgcctgcaacaattctcctccctcaccaaagggccctgcctctggaggggcacctgtcttctccccatggtgcctacttccccttctgtctcattctccagagccaacatcagtctccctctctggaccttctacttggggtctgatcttggggctgctcagacatcagaatccctgagctcctcaggggttgcccctcttggctaagccctgcagcagcccctcctctcagtggcctgggggcaactttaagatctctcctcctgtaagtcagaaggcaggttctcctcccatagaatccagtccgtcgacagagttagatgcctcttcctctttgtcctattgtgcttaccacattacgttgtcctgtgctagtttgtttttctgtctcctctgaagttcccaaaggatggcttattattcagctaagtggtacacaacctggggccagtccatggtaggcacttaataaagtcttgtcaggaaggtggatgaatgaacgcttaacacacaggtgtgtgtgtatctgctgtgctccttgctagggggatctccagctggttgtctctggtttgtgtcagatgcagccctgccttgacagaagctgtttctgactccctgtgtaacactaacaggactttcttttacctcctgtagccaaacaaagtcaggaatgaaactaaagagctgaggttgctctgtgcagaggacgagcaaaccaggacgtgctggatgacagcgttcagactcctcaaggtatgtgacatcttgcggtttgtgttgagtgcacatctcttcgtggaaaattggcctctggacttgatgtctattctggcaggaaaatgctcgtaacttttccgctgttctgtcacaatattttatttatcaaatgtagttaagcatctttctaaacaagatctcaggagcttttaacagagggcctaatattaaacagggtagagctaggttttccggactcagtactactgacattttgggtagaataattctttgtcgggggtctgggggacatccaagcattgcaggccacttagatgtgtggcatacctggtctctgcctgctagatgccagtcgcacgcccggccagttgagacaaccaaaaatgtctctaaatgttgccaaatgtgccctgaagccagaggatggggaattgcccctggttgagaccactagattagaagaataggattcgaaaaatcaggaccagggagaaaggaaatagtacatgaggtgttaattattttcacgactgaaccaactctcaggttcccaaaaagccagggccatgaagtaaacatgatgaattatacagttgactgaagctcctcagcagagacagtacctcctgactgtaagttctaaaggaaatttatcacgtggtactgcatatagagtaatgcccttgacagcaatttcatgccagttgccagagtgatttcatagggctgtttactgtagtcactttggatttcccacagtgtttctgtgcacatataccatatcccacatgtctggaattaagtctacagagtccttgtgagttgtaagttagctggcccaggtgagcttggctaaagtccaggggtctccataggagatgttcgtttagtcaactggagccaatggatacaatggtctagggatttctttacaaaaactcccagccttcgttgaactgtagtggcctttgagctggtccagagactcaaggtgaagtcaattaaggagatggaggaactgaaggaagcatagctcaaaactttcctggaggtgctgcagatccaattctgaatgtagtcctgttgtcccatccacttggcaggtagcattttgcacccagtaatccacagattccagagacattaaggatacatcctagtgccatttttataggatgctggggcccaaaccaaaagttccacagattggcttcctgtatctctctcccagaaccttattttatgttttcactgattaaaaaaagaattatggaaatcaaaactttacaaattcataatggaagaggaaatgtccatgttaatacatcatagatcatagaccactcctgtgtaagccggttttcagtgtaagggtcatcagtgggaactggtcacataggtgacatccattgagggcagtattctgcatggacctccagaaagaatgagattgctctttgtgtcctgttgcggaaaaattactaacaattaaaaagcaaagtacagaacagtatatagagagaaggctacatttgtgtgaagggaacaggaaaaattggaatatttgtatttgatggtatgctcatgaacattgtgtgagctgcaggagagaagaaagaggttgcttagtagggagaggagatgggagaggcagctgtgcagataggggcagcggccaggggtgatcttttgaagctgtctgtatatggttgaaattttaatctgcaaatgaatcatctgttttggaaaaggcaaaaaaaaaaggaaatgaaaaaggaaagtggtagtatactccaagaagctatgaattctattactttgggtaatatataataaatccaagtatcaggttcttaaccactgtttcttgggtgtctctcctttgttgcgctaacataacgagccacaggaaaggatgtgggcagagtgactaatgcaaaacgaactgactttattgttgtcagtgttaacaatgatgtgttacataatattaagatttttttgagcatttgctatgggccaggcattctttatcactttactgtttgtgacagctcagtgacatgcatattatcatcctcattttgtggatgacaaaactgaggcccaagctgtagctgccacgatgtggcagagcagggtcagagccctgacattctggccccagaacccctttcctcactaccatgctttgctgccctccctagagccacctggaagctgccgtgagttctgaatgcattcctcttgtcccagccactttgcagggaagcactttgcatccagtgatacacggattctagagtcattaaggatacgtcttaggtactattcttataggaggctggggagccagacctgacaggaaggtggcagtgatggcctcggggccggtctcaagtggagtgcaagtgatgtgtttctgccccaaatagccataggattgtaatgcaatcgaaacgccatttgagtgttgtcggcactgattcattgcccactatacagaaatgataaccgggatagagttagggacagtggggaggtaactctttatgactccagggtctccatgttgacattcattctaaaacaaggcatcccgtgtgtgtgctctgccttcctccagaggaggacacaggacaccggatccccttttagaggataagagggtctgagggctgaagttgacagggcccttttaccatctactacaaacagcatcttcatatcaaccatggaaaggcagagctgggttgttattttgaattaacctaggaccttcttacatctttacctacacagatacactttcttgaaaaaaatgaataaatcttataacttgggtctacataggagaaagctggcatggctttacttagcttttcagaaagatgctcttagtagcgccagcagataatcttttgtctcatttcttcctgttacattgtttgttaggtaatttcttggaagctgtaggagctgtgtgaatagtattaaaactttgcaacaattatttattgccatctttcctcctccctctgtcttctagaagtctcttaatctactgtagaaactcatccccaagagggaggtcttgcctcatccacacaagagtccctagtactgattgctttggttttacatgacctgacattgaaaaggcaatgaatgcagcattaaacctttgcaacaattatttattaccatttaatcttttctgtctacacacacccatatatgtaaatatatacatgcaaacatgtgaataaaataaaatgtgtatgttattaggtacccaaaattgagaatatttgtatcttcctggtatgtcaattctaagacattataaaatatgctttattagcaatgctccttgccccagagtctaatctggcacatattaatttatttaatgatttttacctcagctttgcttcattacacagtttttcttggaccatcttttttctacttttctgggtccttatgtttaaggaatatctcttataatcacaatgtaactattttactttgataatctttatcttttaaccaaaatatttactgtgatttaattgtattatttagtgtgataatcatatttgtatttgaacctgccatttgcagttttttccaggttgtcccacctctcttgtattccttttctcttaattttttagatttattaagtatatttatgtttttccctctgttaacccaatacgtacatgtacatttactattttctcctggttaccctagatatcacatcttttttttttttttttttgagtcagggtctcaccctgcctcccaggctggagtacggtggcatgagctcatctcactgtagcctcaacctcccgggctcaaaccatcttcccacctcagcctcctgagtagctgggactacaggcatgcacttccatgcccagctaatttttgtattttttatagagacagggttttgccatgttgcctaggctggtcacaaactcctggactcaagcaatctgcctgccttggcctcccaaagtactgggattacaggcgtgaaccaccgcgcccggcctaacatgccccttgaacttattaaaatcttttataatgtagtacatttactgactgctttcaggcaggcatgaggacctttcactccatttgctccattgtcccttttgaaggattcttgtcatatatataaaacctcttaagacataatgttattgttttatatactctttaatcacctacatctttgcactttaatatttcctaaatttgcattcttctctctgggactagaagacctcagcttagcggttcttttcatgtgggcctgagaaattttctcactttttgtttcactttcattcttgaaggaacgtttcactggttataggatgcaaggttagcggttattctcttctgcatcttcccactgcattgtcttctgaatcttataatttatgtaaaaacattagttgtctgtcttcccattgcttctgtgaaaataatgcacgttttcctctggttgtttttgacattttctttgtgtctgtttctcagcaatttttccatgatatatgctcggagcgggcttacttatcctacaccctgaatctgtagcttgacgtctttttgtcaactttggaaagtttttggcattatctcatcaaatatttcccctgtcctgttcttgctcttctcttgctggagtgcagtcgttcctgtattagacctttgcatcatgttctaggtatttttatcttagaaatgagtatgtgccatgagacctagagccagaactgagcttagatcccatgaaagaagagctgtcccacttgatgacttcacttcctgtttctgactctttcttcttctccacatggttggaatgtgtgatttgggtgtgtaggttgggatgctggatgtgtatgagactttgcagggccctgagtcctcattgccaggatcagaaagtgcagactactgagccaattaggtggcaagcctcagctagggagggcactgggtctggaacaggtcgtgtacgttcaaagtcgtgactgcgggcagcttgcctcattcctctgtgcttcagttctgtgctctgtaacatggggataattatagtgtacagctcataaaatggagaggattaaatgaaataacataaagcacttagacacatagtgtcttagacatattgagcccatagtggcactcaataagattacttgctcttgatgttattatgtttgtcactgtcccgcttattccaaaaccagtcagctcttccctcctgaggggccacagtagcagcagcactgaggcatgcaccatattgaatgtgaagttgaatgatttgaactgtgcaggtccacttagagatttttttatatatattaatctattatataaagttaaaatttatcaaaactgaatgcatgcaaacacagactgtatatggcaccatttgtagtcaagagatgtaaacaaacaaagatgcggattacctcagaactgcataaaattaactatagtccctgctgtattactctcataattttgtagccacctcctgttgctagtacagtgaactcagatgttggacatatccatttagaaacccaccttgtgttgctaattatctccccatgagcaggtcctctctccaataaattgcatgttgtagtaaaaaaatgggctcatgtttctggagtatttttcgttgtgtgtagtgcaatacaggaactttaaagaacaccatgggacccatgtgaaatgccactagtgaagctggaagtgcgcccaagaacagagaaaagtcacgacatgacaagaaaaacttaaattgcttgatacatactagagattgaatggttgccctccacaccacacagataattcattgtgtcaacatgtagacttacagaatcgaatgcagtacagtcccataattgtattgtctcttatgattttcttaataacatttttttctctagcttccttataaaaatatggtgtagaatacatatatgaaatatatgttaattaactgtttatgttatcattaaggcttctggtcaacagtaggccactagtaggtaagttttgggggagtcaaaagctatactcggattttttatttcaaggggcgtcattgctcctaatccctgtgttgatcagggtcagcggcactcaggctcctggaggctggtacagggcatcactccctgttccgcactcaacattgccctttcctgctgtggcgtttgtcacatgccgggcctcggggctcccgggccggtgactaactgtggcttctcctctccagtatggaatgctcctttaccagaattaccgaatccctcagcagaggaaggccttgctgtccccgttctcgacgccagtggtaagtaaagccaggagcttcagaagtctagtgccttttcagcttctgcatcacatgtgttaaggacgcctcatttcacacagggtgggcaagagaagctctggagagtgtgtgtgcatttcagggaagccagtatgtcccacgatgacgtgggttttgtagtctcaacagtgcaacgacagggagtgaattcctctgccgttcttctcccgtccctgcatctcccctcagggttgtgtaagtaggtggctctctttaagtgctcaaaaatggcagcaacaacttctggccttgtggggtactgcctttcctgcctttcgcttttgttccttaaaccttgggacccatgggagctgttgactattaacgctgcattcattccctggtgagaatttagagattgtcatcgttcctcttgtgttctgggcactctgttctcaaaggagcagaagcacttcatcttctcaaaatacagtcctgagggtccttcagcatctgcccctttgagatgccaaatggtgccacagaaagggtccacgagttttcctgaacccacgtccccgagggaatgactcactggggaggcctaggctcaccctggctgttgatttctttgatgtgttggagtgcaggtcaggagcctgtgaaggaccacatggtccaaatgctgcgggtgccgggggcctcaccagcagcctttttaatactcagggaggactagaatgtgtttcgttcttaagaaaaactgaaggggccactgaattttcagcctgaaccggtgaatttcccacctgaaacttggggagttcagaggtagaaagcaggcattccctgctcccctttcctgaccgtcttgatgatagtttcatgccaagactccactctgccttatttccctgcattttaagaactgcggcctttccttttcagcgcagtgtctccgagaactccctcgtggcaatggatttttctgggcaaacaggacgcgtgatagagaatccggcggaggcccagagcgcagccctggaggagggccacgcctggagggtaaggccccggccctggccagcctggaggggcaccctcaaggtggtagccccaccacgtggtcttctcccagaggaacggctctatgcgggttggcaagaggggtgccatgttgggtggggtggcctctgagttctcagctgcaggaagcagttggcccttctaggccccttccatgttcccagcacccagcctttccccgctgtcccctgtcccctgggctttcatggaagggacaggagaggaacagagttctctgccctccgtggctcctatgcagaactgttctgctgatgaactggcagtggctgtctgtggagtgcacagagcccaggcctgagtggggccagcaggtgctcacatcaaggtctgctactaacagcctggaggccttgggccactccctcacccctgaggcttaggttcttaatctccaggtgggaagactatcactcggcttctaagtcctgagacttaaaggccatgtgcaaagcaggagcctggactctggcattttctgtacttcagcctcaggggatgggaaaaagaaggaagtcccaagcacggggagtccagtgcccagtgttttgagaactgcgtgagtttaatagaaaggcttgtgtgtttctcctgcgatttaccaggatgttcatggcgttttcatcgtatgtcttcagtgtgagaaataagcatgtctacttcgatactggggctactagagatatttcagggtgttcttaacaactgggaaccctgagctctttgttctcaggggtcagtggggtcttcagatggggcaaggtcccttgtgagcccagtcaggcaccccacccagtggcctgccatgagcttggacatattgggtgacttggtgtgtctgtctgctgtcctcggtgctaatgtgggatttcttttgcagaagcgaagcacacggatgaacatcctaggtagccaaagtcccctccacccttctaccctaagtacaggtaaacagggcacattgcctgatgtttttgtacataaagaaaatcaaacagcacccccctccactccccctcagccttacgaatttgcctgtggccagagtgcaccacacaagctgtagctgggggagtcaggggctctgagttgatcagagttggttgtgctgtcagggaagccattctgcagaggcaccaccatcctaccctcctcctgtcttccccccacagtgattcacaggacacagcactggtttcacgggaggatctccagggaggaatcccacaggatcattaaacagcaagggctcgtggatgggtaaggaaccaccactgataagagctgtcatctgctaaggttttattgtgctggggatctgttctgtttaattcctcagacatccttgctggacaggcagcagttttgtcctcattttaaagaggagaaaaggtaggctagaggtataagtggtacgcagggcttgcccagctagtaaggggcagaaagggatctaatccatgtctgcccagactgtatctgtaattatccttcacctctgtatgaaatctgaagagatggacaacacaagttgttttatcttcataaggtagtgggcagatggaaaaaaaatgcttttgcctacgctttttgattgtgtactatatgaggttggttttgctgagaacaaatagccccaaaccttagtggcttaaaacaacaaaaataaattacgtatcattgttggttgagtggcctttctcacctgggccagcttggctggggctggacagtccaggataggttcactcgtgtttggttgttgctgtgagctgttgccgtggcaattagtgactgggcatgtgtctgcagcagattacttgaggctcccaggcatagcaagagaggttaaaccccactacacatgcacgagacttctcaagattctcgtaccatcacatttgccaccatcccgttgaccaaagcaaatcccaagaccacacttgaatgaccctgggaaggagccagccacagtgtggatatagggacagggacatgggatgcagttaccacagaaggccgacactgcggagccagcagtcttccagaaagagacacaggctgatcatcctccctgaggaagtagttacatccatgtgggagctgtcccatacggggtctgaatactcaaaatacaggttcctggaagctgctaaactcaaagaatgattcttgtgtccttcgttttacaaaaagttttattacggaaattttcacatttacataagtgtataatgaaaccccacttacccatcacgcagcttcaacctgcttacttcacctcttccctttcctacattctcctcctcctcctcttcatctctcttttcccttttctcctcctcttcctcctcttctattttaaaggaaatttcagatatcctaaatttttgccagcaaatacatctcaatgcctgtctctaaaaaaataaggacccttttgttttgatataactgcaatgttattacacttaactaaataaataagaatttcttactatcatctaaaagctaatccatgttcagatttccccagttgtcaccaaaaaaactcctttaaattaagttgaggttatttaaggtaggacccacaaatggcatttagatgctataccatatacttctgtctccttggatataaaatagtctttctcatcactctgtttttcttctatttttttaaacatcttttgtttgttaaagaagtgggtcatttgctaatagcatgtttgtggtttattttaataagttcctctgtctccctgattcctggggagtggtggtcatggtgtgatcagatgcatttcttctgcctggtgtctgcagggcaggtactgggtgctctgctgcctggagtggaggaggcctgaagcctggctgctgtttagtggtgtcgggtgagcaggggttcaagtgcagccagctggaacctccccaccaaggctaccgtccccgtccaccacatggttttagcagcccttggtgaacttgcccaggttcagtatttcattaggtgttccaaaatcatcattttctaattccttcctatatgagctgaagttctttcttgcattagatatttcctggaaaaagtaggtaaatgcctggttttccccttgtcaatttttagaacgagtttgtgttctcccaccttccactagaggcaaacaaggggtgtttttgttgttagtttgtttggattttgtttaaactgtcactgtgaacttagatttttgtgtttgatttatttcagtcaaaacctcttctcgacgctcactttgcccctcattggccaatggttccttcaagttgcttcctgagttcttttgagctagcattaatggtatttgattttggggtgacaagatgtattagactcaaatgatgcatttctcacagggaccctgattcattctaatgcaaaatggtatttggagactacaatctttagatctttttagtaaacagagctaggacatgggcttttttaaaacaaaaaataaatgttgggttcacgttgatattgctaattcaaatttgagattacaggattttttacttctttgattttgttgttttttttttcctctgatgatctctgttaatggcattaacttaattacttattactttatattacataatacaaaatacatacctgtaatatcttgaaaatattaatgctgatatttattcagtaagacacctgaattgcgatttctttacagtccttttaatccttaaggattaatccaggcaggttaccttaaaataccttgcccaaagtcacttaaagtaattcttctctatggttctgtcaccaaactgctgggtaaatcaggtttgtttgtttcagtttctctttagtgtttgcaagtggatctgatttattttctttttggttgaatgctgctttgtaaattgcataaaacattttcatggttccaaagtcagatctatgaaataaggcacatgccctgtcctctcaactctgcctcccaacccctacaccagataaacagcttttattagtgtttgtttatccttctgtcatttcattgtacaaatacgagtgaaaagattttgttttctgcctctcgttaagcaaatgtagcgtgctgcaagtactgcgctgcgcagttcccgcagtctctgcatcccaaggatcgctccacagcagcgcatcgcgatggcccacatttcttttccactcttgggttttcttttatgtacatggaacatcattttttaaaatgtcccctactgagggatgttcaccatgtttccaggcaaatgttatgagacacagtgctgcattgtttcataattttgccatgtatctttgccatgagtcctgagaagtggggctgtggggtggaagggcagggcctatgtaatattgtgaagtatcaccagagtccctcagcaggcttacttcttcatctgagagtcatgctgtcagccgcatctctcatgaaggaggctgaccctcgtttcatgtatggaaggacttctttgtcttttggcagttctaccctgtttacattttttgtccatttttctaatcagttaagttgcagacacttttgtttttcccactcctaaatcataaaggggtgcattcatgttgtcttgtacttggattcttttcccccctctctccttccttccctctgctcctctttccttccttcctgctctctgcattctccctttctttcttttgtccttagttggttcatttttggtctttgtttggttttgtttcgatcccagatgcacttgggtttatttatcctcactgctgggtagagtatgggtctgattttattttgtttcccatgtggctttacaattgctccaaaactccttactcaagatgtcagctttatcacagagcagtctctcaaagcattagaagcaactcctcctctaactgtaaaacagtatgtttctcctctaaagtttctggcatgcctgaggagagaaaagcctaacacagaaatttctctttctgtgacgtttttgagttaggggtatctgtgtgttctggggcttctaatacagtgtatacctgcttatacccctgaaccgtatcaacagtgggcccagaatgttctagggggacctctgttacccttgccgtgtgtgggaggcagcgcaggctcacttcggggtagcgtcactctgctggagaattggcacttccacaggaggctttatttggtgctgtggccactaagtgtcctccccaaggccagggcagtgaggacgcccatcatcccgaggcgaagatgtttctgaaccttgggggcgggtgtggcagtcatatgtttgaagaagcttcctgagtgattctgggataaggcccactctgtccactttggattgaaagggctgccttggggtggggtggattgcaggtcagcactgctgggccacctgaattgtgtgtcagcgttttgcttcccccagccatgtttgtctttcaatttttctcggatcagaaacccagttggtgaggcatccgtctttccagacctgtaaagcgatagaagcatcacctctgttaccttccgttccccaaatcagcccggctggtgccgcccgtcttattcttcagcaggtgttcctctccgtcctccctggagccttcctcgtctccaaggctgtcatttccagctcccgccttaggctgctggagcgctaaccacacacagaaatgcagataatgggattgattcaggcgttaacacaggaacagctcatcttcctctcaattcttgggtgtagggaggaggtgtatttgtataacaaggtaaataatccatttctaatctttactgatccctgcagagatgatgaaggcaagccagtttaaagagttaaacaacaaagaaaagaaaaccacctcgaaaaacagcacaagattctggacagacagtataacaacagcattttccatagctttattctcaaacggtgtatgcagttagaaagagacatcagagccttaaataagcccgtcaagtattcctgaaatcccaggatccaggcagctcccctcccatccccgtccccacccatgcagctgagcgtgtgcgcgcacatactcgtgctttaccagccctgcactgaatttgccgcctgcttccttcctgtcttgccacccatgcccgtcccagaactgcaggagaaggatctttttaaggggaaatctaggtctgtagtcctctctgccaaacaaatcccaccccacccccaacaccatgcttatccccccagggcatgtggatgccccccctgccatgcccacactcatggtccagccccactggccttcctgctgtgccaggcatcgatccctgtgtcatctgcctgtgcagtccctctgtctgcacttcatgcccctccacatgttggaaggaaacctcttcggcaaaatttgaattctttgaagctttcccttctcccaaccgcagaaagagaggtgttatccccaggactcacatagcacccttgtaagagggatactttcacttttcgtctgcttttcctgctgaaccaggaactcctccatgactggctgtgtgaccttggggaagttgcttagcttctctgtgtgtcacttcccttatcattgtgaaatgaagataacagtatcaccatgaagatgaatgagttaatacatgcatgaaacactttgcacggtgtcttgcttgtaaacgtggtctagattgtactctgatcactgtcgggtcctgtcacaaggggctcttcgttcatttatgatggactggtgagtgcaccatccctagcatcgattcttaagaacttacctggttcttgccactgtccatcctgggccgtgtttacaacttctgagcctggttagtagtcacttaacatgcttagcttctccctgggcatctttcctataactgcaatccccttagaaatcactggattgtggcagttggctgattgcagtgattgttatttcaagctaccttgtattgcgtgtgatcatgcacaaagctgtatatacatcagccatggtcttctcaatggtcctgtaagagaagagttattctggctgggtgcagtagctcatgcctgtaatcccagcactttgggaggccgaggtgggcgggtcacctgaggtcaggaatttgagaccagcctggctaataccatgaaaccccatctctactaaaaatgtaagaattagctgggtgtggtggcgggcacctgtagtcccagctacttgggaggcttagaggggagaatcgcttgaacccaggaggcggaggttgcagtgatctgagattgcaccattgcactccagcctgggtgacaagagcaaaactccatctcaaaaaaaaagaggtgttgttccccttctgcagatgaagaaattgaggctgagaagagaagttgcccaagatgatgaagctaataagtgacctatccaggattcctgctgatgcctaagccatgccattctccccgcatagcagtcatctcagatagacaaccttcaggcattccctataaagctcaagccttccagcagccttgggacttcccagggtgagcctgcccctctcaggggtacacgtccctctcgggtaaacaggcctgggccatgctgccattcactcgtctgtagcttcccatctgcagaaggagacagcagatagttaacggcagagaaagggacgccccacattttcctctagttagagctgaagctcggcaaacttctgggtgtcagagtaacgatgttttatttggaatgacatgactctgacaagtctttgaggtgggcacagctgcccagcatgcaccagcgcttgggagaagaactggatctccttgtcttctctctggcggtgccgcgtgttccccagtggggtctgagcttcctcacgccgtcccatctggcctgaccaagccaaaccatggaatcccattctgatcggtgtttcccaaagtatatcctgaagcacacaaggcctgcaaagtgctattttagaaagggtgggggaggtttctacataggtaagattggaaaactgctaggcagttaccatgaatattcacatatttaaggctctgagaagtcctgtagtaaaatatatttcttttaccttttcagcatgggattttccagtcttatttaactgctttccatcttcacattacaatctagacctggtgattttgctgatgattgtagtttggttttggatacatttaaagtgagttccttttcaggccatttcttctttgtagctttcattggatctttcttcgctttctgatgtataactatcttttcagctaactccagattttctcatgtaagagcaatgattttatgccttttttgtgctattctaatttaggattaaaaaaaaattttaaggttgtagaaaggttgtaatagtaataggatgaactatacacacttcgcccagatacccttattaagattatggcacatttgcctttgttcttagttactgttttttcttctgaaccgtttaggagtaagttgtggcatgatgtccctttagtctgaattattacagtgtaaaatttctaagaacaagaacttctataaccacagtaccttataaaaaccaggaagttaacattgacgacgcagttcattgtctaatctatacccttcttcctaattgcctcctttatagcaaaagaacatcttcatcctaaatcttctctcccagcatgtattcataatcttgacctgcgtttcgagtagaagccaattcttgtagagtgtgcctgggctcagcctaggctcctcactcatggtgagattcaggctatgcatttttggcgggagcacccccgaaaagtgatgttgtgtcatcttcagtacatcgtctccggaagccctcaaggtcaatttgtctcattgctagtggtggtaatttagacacttgatgaagaagatgctgtcggccggatttctccactgtaaagctattattttcccctttgtagtaaataagtattaacagtacaatactttgatgccatgaaaatactcttttttctcatccacctttcatctgctggtttcagcatttgttgaagatcccccctccttcgttaattgttagttactacagtaattgccaaagggtagtttttgaatacatcttgcctttatttattggctgacattctcctccaagaaagattttcatcttctcccgtattaatttatttgcttatttatttttaaataatactacagacacggattccgatttcatgggttatgattcattacttttaaaattcattttgatgcccagatttagtcatcctgcctcctgtgtctttttgacatgtcctcattattctttgagcacttcttgatatgcaggcacaaaataatccttttcatcctatagtttccctgccctaaccctgtagtcaggcatatccccaaggagcccagcttttttccaatggagaatgacaattcagaattaccgtcttggtgcttgcctggtgtgctgttgcccctagaggccacttaaatgccaaagcactgcactgaagcattgtggctccaagcctgtgtgtgtgtgtgtgtgtgtgtgtgtgtgtgtgtaagagagtgtgtgtgtgtgattagttccagattttaaaatattttagcaatcaactattttcccttccccaggctttttctcctccgtgacagccagagtaatccaaaggcatttgtactcacactgtgtcatcaccagaaaattaaaaatttccagatcttacctgtaagtattgatgttctcagaccagtccttgtggtttgttttctggtttcattcttaatgcaattttcaagttataaaccgacaagaccggtaagtatcagacagtttcaaggctgcagttaagaaactttcaagaatttctttacaggtttgtcttttgaaattagaaaaacatttccctggaaataatcctgaaagtggtgatagggtgttgaggccccccttgagcctgtgagctcttggttgcagcagaaagggtactgatggggaggatcaaggtcgcaggaaggggaggtggaggagaattagctgagggcccacagctgaaagggtactgatgggaaggatcaaggtcacaggaaggggaggtggaggagaattagctgaggtcgcagcagccgtgagcacgtgggtctggaaggcaggagttgtgcagcaggattgcctgttggctgctggagtctgaggagtcttgtaatttgtcctggtgtacaccagggctatccaagaagcgttaagtggcctcccaaagagtaattttgtttctccttccacatggtccttggatctaaagaccattctccctttgaacaattccaaaaacttcattacagaatacattaatcaacactactttttttgacaaagcactttatgtttgattcgcctgatgtttacctctcacttcagtatgccacagttcaattctagttcatgattagagtgctagatcagcgcctacaagaattcagtttagttgagaatacaatacacaaaattaatagcagctgtttacatgctgaattgataaattctgcaggtaatgataatgtttgtgaaatgcatcctgtggaacccaaactctaccaaaagaggctggctggacagtttcctctcagagattcaatctgcatgtcagcaaagaaaaagctctgagaaggcttaaattaactaaactcacctgttttacacagttgaacctggagttcttcaggcttatctgacccccaggactttgttatgatctcaagaatcgtgtagtgactggcagccatggaccatacaggatgaggagggtgtcttgcttagcttttgtgagccaggggaaggcagtgtgccacgcactgtcttttctgtggctgcttgcttcctgctgtgtgctgacatccccaccttactcgtgaggaaaatgaggctcatggctgtcagtggctttccctgcaccgcactggggtgaggaacagaatctggggttgagcccagccttcccagcttccagccaaccttatatgcaaatacaggaattactgtcctagggaaagtgctgcatagacgatcctttttgttcttctactgcattatattattcacacagttataattcttttagctcaaaatctaaaatgaaaagtgattgacattttaggctggatgagtaaattaaaaaaaaaaaagaaagaaagggggctttcatggtaggcagagtgtgtaatgcccaaatcctacaagtaacaaaagaacagcaacttgggacttagggcattaggtgtgcagcctctgtgtgtgaaaactggctgtgggatgtgctgttagctctagcagtggttttagagttacgaagtggttccaagctcattaattagccaagccttaaggctgacctattccctgtgaacaacacgacctcctttcagcagtgttttgcactgtactacagtcatccagctgaaaactcactgagttaaaataggtgttaggaatatgattctctctgggagatactgtggcattcccctgctttaataaaaataactgccccatattcagggacctaggaacggaatttacctgcgtgagcttattaatccctcatagccacccaacagttgcttcatcatggagcagagtaaacccctggggcctcaggagttggctgaggtcgtatactgaggacccaggtttgggcagtcttctcggggcatgctgtgtgcagtgggtacttacaagttaactggtaaatgtaattctcatgagctgggtgaactgggggcaacttcgagcccttccccttgaccaccttagggagcaggggagctagctgtcctcagcagcctccgcagcccacccaaagtctgtccctcgctcagggacatggcagcccccagcacacatcctctgctcccgtctttcccgcccctggtgttttctagcctaccttgccctgtgtgtccctctggaatcaaatcatgggcagatgtagctgctgctggccgtgggccccgttctgttccctgaggtggcagcctctaacctggcaagtgttcttgtgtctctccagtgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatct

SEQ ID NO: 17558 - DNA, 23539 bp, Human
catatctagtcctgcttacattactaagtggtaggaaattttaggtaacacctcagactttaaagtggcctactgagctggtagaaaagtgtgtagttggtgctcagtaattgttgaaaagatagaagctttacttcaaagctcttgtagtttgatcagtttggaaaaaatattttaatgttgggctctgttaacagctggactggtggctgtctgaattgggaccatgcttggggtgaggtttttttcttacttttttttttttttttggtgagacggagtcttgctctgtcgcccaggctggagtacagtggtgcaatctcggcccactgcagcctctgcctcctgggttcaagcgattctcctgcctcagttttctgagtagctgggactacaagcatgtgccaccacgcctggctaatttttttctatttttagcagagacggggtttcaccattttagtcaggatggtcttgatctcctgaacttgtgatccatccacctcagcctcccaaagtgctgggattacaggcgtgagccaccgcatctggccacatatttttttaaattaaatgtgatacataaaattaggctgcaggcatggcctgatttgcaggtgcttcatgagcaagcgtgcacagcatttatttgctgctcctggagtctctcgtgtgtgcttgtagcctagccttaagccctctgtggacggcttggaatgcgtactccaaatgactcttttggcggggtgggaagtggcaatactttaggtgactgacagttgaaattaaccttacacaagagccaaactgtaggctgatgcagggccactcacctttggactcacccctggcaggtcctgtaagaggtgctacttgcttccactttgccagctgttcgttggccctgttttgtcttctgctgtttgccttatttatgaaacagaatggaaacaggcgagtttgatttcttataattcctaggagtcatagaatggaagcaggtgagtttgatttgttataattcctaggattggataatttgccttcccctctctccatctttaattaatcccttaaaggaaaagaggacgacagcacttttcctgcagtcatctgtgtaggcctcagccttaactcatgacataggctggtgccactggccacagggctgacctcagctcttggagcccatggggtgacaggagatcagcacctttgaggtggcggcgtgaggcgtcttccaggccttgctcatggtgcttgaaaacactgctttagagctttgttaagagagagaggccctacttactcctgtcccacaggcatttgggtgttgacctccttgttggcctcttaaggagagaatacttgagtattgaattcgatcagcttttctgcctccagggaccctgtttctctctgctgagactgtggcggatgaaaccaggatttagtggatggtcaccaggtagcttgggcagacctgggccgcggggcccctgaggactcatacgtctttttcctgttcacatgttccttccccacaccttggcccattctcagtccctcccatgctccttagcgtgaggcactcagggaggtgcccatggggccttggggcctgtgctggagctggttcccagcctcagaagtgtgcctaactgtgccacattcattggaaagctgctttcacacttcctggatggaattctctcattttttcaatataaagtcactgagatgatttttttggagaagtctttaaaggccagttatacatttattgatacttggtattgacaaagttcagttgtttagtgttgctaagtcatactgtgtaagtttgttgagcacagagttttcattttatactttcagaggagaaatgaaactgaatttcgtggccagaaatatgtttgagcgtcatcctgatgtaagaacagaacagaaagtgtgatgacatttcattgtaactctagtatgttttcttttttgtccattagactacatgaggaaataattgacttttataacttcatgtccccttgtcctgaagaagcagctatgagaagagaggtggtgaaacggatcgaaactgtggtgaaagacctttggccgacggctgatgtgagtatgttctttggagttctgtgtcgcacgtcacgtgcgagtaaatttaaataccctgtgatgatgatgtgtcggctagatccacacagaccttttctcgttggcccgaggcagcagttctccaagtgtgctttgagaaggcctccgttgcctggaatgcatggcccccggcgcacctgcacctgctgtcttagacacctgcggtggccgcacatcttcgtgatgctggcgcgcactcaagtgcgaagaccatcggctgagggatttgttgggtttttttttttttttttttggaagggggagaatggtgtgattgtttctcttaagttcaccttaaaatttagaaatttcaccctgtcacccacccctgcttccccaccaccacacatagtagcatataatgtgctcatttttgtaaaacttggaagtgttccctcatcacacaccactcttgcagtgaaggaacaagtgttttttgacatgtggagtggggccttctggaatgcttggtgcaggtggcgtgaagcctgcccctggccggctctattcagcagccttccctactgctgactgggctcagtggaccagcagggctggccgtgccccagctgtgaggggcatgtgtgctcttggtgggcaagggcaacccagttttctgcgcctcttttaaaatgatacagatttttggctttaaacttcagagtcctaggacaaagccctgccccagtgccttagctgtgggtttaagaagaggttgaagggtttgaagctagctctgaaaagtcctcagctttgaagggttatagggtgaggacaaaacttgtttcacctcttaattttgagtttttaaacattccttttttgggcatgtctttaacttaaagggaattttctggttgattgttatacggtcccctccatcagtttccaaggtagttttattttttacccaagggtatagtgagggctttcttttagtaagaaataatggtagtgtgactgcttggtttgtggtatacattttaaggcaaccactctttctttcaggtacagatatttggcagctttagtacaggtctttatcttccaactaggtgagtaccagactgcatggcatgggctagtggggggctgggatggtgtctatgcaatattaagggctacaaatagattctttgtaattgagtctaaggcgagaaatgccagctaaaggaaaagactgtggttacagagggaaattggcagaaagatttaatttagtgttatgatgaattcattgctttgcattttgcctctcacacttaatttgttggggtgcaaaaatgcttcatgctggaaatatgaagaagacaggtgggaggactgtgggaagtaaacgcaatagaagacattctgctgatattttaggacatgtgtttgaaaaattgatcttatgttttgatgaagattcaagcaaaattctctttaaatagtattttctaagtatttttacctgataggaaaatgtcaaacaagtttgcattctaaaatacaaactagtattttctcattaaggattcttgatagccaaataaatttcctgtgcactgtctcattaaaagcttaccttctattaacccactgctagttagcatttggaggccgaagaggctataatctcaggatttgggggttgacattagcagggccagtgggtaattgaacaggtttgggtatccaggaatctctgggtccgcaggagtgatccagcgtaggcagtgccggagtaggtgctgggagagcggggcctcagcctggtttgggggcaggcattttcatctgaatcccctcacatacctagtgctgttgggagaatgatttaaccttcttgctttccatcttatgctacaaatatggaagtcttcccttaagttcagcgaggacttgctgtagttcatgaactgcacttcacctccttaggggccataggctagtgggattgtgtcttggcctttgtgggagacacaggcacatgtgccttggtgcttatcctccccacacgaatgtgtaggctgtggcgaggggagcagtggctgacgtgcgttttcttctgtcagcgacatagacctggtggtcttcgggaaatgggagcgtcctcctttacagctgctggagcaagccctgcggaagcacaacgtggctgagccgtgttccatcaaagtccttgacaaggctacggtgagtgcctggctttggcccctctgaccgggcaggagccttgtcacatcccaggtggtcacaggatacgcctgcgtcacgagcttgtggtattttacacagttattggctacagttttgaagattaatctgcttctggtatagacatgtgttttatgtttttgtttcatagtcgtgatcaccaactgagaacatgtttagtgacagtctgaacttttgggacttgtgagcccattaaactgttcttggaatgaaaatatatgattgtgtctacttgtgttaggatgaataggaaaggagagtcatctgaaaccggacactgacattcaggtgctgcccattatggagagtgtggctcaatgattaaaccatggtttttatgattaccatttgctatgttatgttaaagaggaacaacttagctgttcctttcgtggttccaaaaaatatacatatatgaaaagcctcttatctttgggggaagtttgaagatgagactgtttctggtgtgtacttgctaaggtttatgtcagttcaagattataagccccccagggactatgaggtacttgcctgttgtatgacagttcttagctcacctgtgcgaccggctagcatttcatttttaaatttgtgtgtcaacttgtgtgtgattcacatccttatagtgtttagcagaatgtaagttaaggcaggagcttcctcctgcctgtgtggtgataggggagggggcattcacatgtttctcattgtcaggtgcttttgattgaggctgggggcaagttttaaaacatgatatatgcactgaaaagtgcacatgtaccaggtgcacctcttggtgagagttaacgaagtgcacatgctcatgtcactgtcatgtggaccagagcgagcaggcagcaccagaggttccctccaggcccaggttccagaaggggctgttggctcttctcattagcacgagacaagccctggccggccactttctcaaatgcttacgggccttattgcacttagctctcccagccactctcatcagcagatgctgttgctgttcacattttacaggtgaggaaactgagatgcggagaggtgaggtcattagcccaaggtgggtcagcggcatagtccaggccgctgttgtctgctgctcctctgtgtgtgccaaggggcagcggggaggtgggtgggaatcctgaccaggcgaccacctttggagtagaggaactaaggcgcggctgtcctgaggccacacagtaggttgagcagttacagtaactgcttagtcccagtgacctcgttactgtcgcatattggctactaagtatcttttcctctgttacctgagggccagtgtagactgtagggagagcctggagcctgccactgctcatttctggggagcactgtgcagccggccagtcatgggcacaagagacccagggcgagggctgagtttaaggtgaaatcttgtctatttggaacaacaacccaaaactgtgttacagtgttaactcctcacctccaggatttggggttcctgccgtgagtgagtgtgtgcaagagtagggcaggagagtgccaggagtgattgtgggaaggagtctatgagatggaaaggaagctgcttcctaaactgtgggtgtcagggaggcatagccattgagtgttggcttcttccaaagcagtttctgatgagttctttgggaaagtatttctttctctgccttcttaagaacatactggcctcagggcttaccctgcctggtggtcgcagtggtgtccaggtgactctggccccactggcatgtcctcacacgctgagtccttggttggttgccctcaagtgtagacattaaagcccagaataggtgtgtactgaatgcactgtccctacgttgcctatcactggcatttgaacttttcgttagacactgattgttttggttaaaggaattcctttttttaatccttcaaggctgaaggaaacaaaacattgccttttcttctggaagaattcagttttactggtggggtggagggtggggcatgagtgtggtctggacagttgctcaggcagattttgaatgccattcggtgacagttcttgttggtgagaatatttctaaaatagccttttatttgctgaattttttaggggaaaaatttttttagtaaagttgtcttaaagagtgaaaacccgaagtagagaaacaatatcagtataacatacaatttaaaaaatggcttcgaagttacattaaatgatttcaaaaattctgccaaataaaagtctggggccaagcacctctctccatcccagcacatagggtgggcgtggcagagactaactcctgttccctgttggctccctcccctcacgtctctttgatgcttggtcacctctggtgctgatccagggctacaggggctgggcagaatgtgggtcctgctgtgaggggctggggcctgggagtcgtcctgggttcagggactactgatgctgacagtgttctctgaccccctttcattactaagaaaaaacaccaaacctctgtacagctttggcagcattttgatgcctggctgtggagagtcctgcatgttaaagcagtttttaaaatgaaatctttacaggtaccaataataaagctcacagatcaggagactgaagtgaaagttgacatcagctttaacatggagacgggcgtccgggcagcggagttcatcaagaattacatgaaggtactgtgcttggtgacccagcgcggcgagagtgcaggactggagtgcttgtgcttggtggcatcctacgatgtttacagctgtcagctgcacacacaagtctttcgtaacacagactacacttacattatttctcctacaatattatttctagagatactttgaaattacatagctgtttttaaaatttgcttttcctgagtaaccattttataaagttgacaattattttagagagctttgttaaaatgttctttctagttattacagactttgcttctagctcagtgtgcctcattcgcaggttttacccaggtggaagttgataaatcatgaggtgccttaaatatactcactttgggaggtctcagtgcctgaggatgggcagagagacttggttgagctgacatgtttgggactctgaccatgtgcctggtcttaaacgggtggtcatgacctcctgttacagtagaggccgtgcagtccttagcaggggcagacgcacctccgggtggtcgtgacctcctgttgcagtagaggctgttgcaatccttagcaggggcaaatccacccctgcaatctggtcccatcttgttccattttcaagggccttgctcttcaggttcccccttcccccttgtcatctggtctgagggagcatgtccacccccagcgcaacacgaacagcagcagccaggctttccctccctcccgccatctcctgccgctctgccttccttgccagcctcactctgctctcctgctccggaggcccccactgtcctcatggcctgtgtagcaagcacataaacactccagtgaacgcgctggtctcttcctgagttcctttgtgcctgtggactcgtcatggtaggggtgcacccctgctgagtcgtaacccagggagagctccacagtctcgattttcacaagcccctcaggaaattaattcttagcgtcccccaaccaaagtttgagacttaatgactgagagccttcagatgggcaagaggatcgaggaaactttcctttctgtcttgtgtgatttgctatgtgaaatctctttgaaagtatggtaattactcagtaaatctttttcttttggaatttacagaaatattcattgctgccttacttgattttagtattgaaacagttccttctgcagagggacctgaatgaagtttttacaggtggaattagctcatacagcctaattttaatggccattagctttctacaggtatgtatgctttcttgagactgtttctgttgagacatgtgtaagagtagactcttccaaccagttgcctagtgggttccagcagcctttgctctccttttactgtattgtttcaatttggtagaggctgatttctgattcttacaatcaaaccctcttgattaatgcacctttctggatgctcattttgtactgggtgtaactgttggtgcaggggtgcccatctggttctgtgagtccagtgcacatcagtccaagctcagggaattctctgtattcagaaatgtccatttcatggtaaacaataaacatttcttggtgcttgtctgtgatttatattgaaaaaaatttgtctcagaataaagttgagtaccacatatgagaaaaggatttacaagagagctttctcagactgatgaaacatcattattttgtcttaaattatatgtggtccttattttgctgagtaacatggaaaatctatcaatagaaaacctacgtgttttaaaaagtattgttaaatgctgtgatgtattgataaactgtaattatactttttaaacatataaaatcatctctaattggaacagtaattattccgtttatattttcttgagtgaagaattctgtcctttacaaaatcttgcctatataatttagccgcacggctgtatttctccagtgtttaccattaatttggtctttgtgattgtgctgagattaccgaatctgtccatgatttggtaatgttctcactgtcatgaatgctatgatagtagaatcactgggtaactacctgtgatgatcgcagcttccttggtctgtctctgccaagatgctttaaaagtagtgaaaatggaattccatgtctgttttcttacagttctagtcacactgtcctgtcttcactttcccctctgagatgtggcccttatatatagcctttcttccatagtttttggacattattttgaattaaacatgggcctctgttctttactgatatactcctgacttgcactattttcatggccttgtagtaacaacagctacttaatactttgatcatgcatgtgccatgtgccaggcctgggtccagggcctcctccaccccctcagggggtcctttcagtgatcctgtgaccccacaggaggccaccacagcatgagtgggattcctgtgttcactgccacatccctgtgccttgtccagtgcccagagcttgtcctgcctcagcggtgtgactgtggcagcatctgagtttcttgactaagtgaggggaggaggcccaccctggcaccggccaggctcttggatatgtgattttggctaaaagacaaggaataaggaagggaataaaggtcaggccagaatcggaatcctcctcttgtgtggtggaaatatgcagagaactccggaattcttctgaaccctaaaaacatttgtatgctttctagctgcagctcctcctggcactctgtgttataaatagtttcaagcaccgtgcttctctgagggctttctctcatgtgccctcgtccatccctttcgagttggcactgtccgatagaattctgtgatggtgatggccacttctgcatggtccggcaaggggctgggcgccacatgtggctactgagtattgcagtgtggctggtgagagcaacaagctggatttttaattaatttgttttaattcatttaaatagacatgtgggcaatgcaggtctggacagctgagaattatgaccctcaggaggtgtggtggacagtggtttacttccgaacaagcccagtgcctgcttttgaagacgatatggcactgaactgagagtggtgctcatctgtgtgacaagcaggatggaagcttgctataaatattgtgatataatgctaatgacctttacacagctaaaatcagtcctttcacttttccggttttatgtgatactgccatactagtcagtctaacactgacccctgttggttgtgcttcagcataacgaaattaggatgacgagaatctgaaattacatctaccatccaggtgactaagttatgcagaatatagtccaacttatttgcccatatttggttaatcagatatctgtgtttgcaggaagtttgctgtatggattaccaatttcaaaaatcaaactacactaaaattcagatgagtccgttgtgttccttttgaacactcctcgttgaagaggctgctgttcaggcttcctcgtggtgctggtgagtgagcgagtgccactcactggtattgccttgaagaggctgctggacagcagacttcgtcgcgtgctattttctttagaacatgccatgaatccatacaaattgtgggtgcattgcttttacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccaggtaagggcgccctgatctccactgctgagagctgggccagcctcggggacgtgctggtgacagggcctgtgttggggctctgagagccccgggcagttcatttgctcttgatgcaggtttctcttatactaaccagttaataatcacactttgagaaatccttatttaatgcttctaattaacttttgtctttctaactgtttacattctataataaagaagaattaaggaaaatcttttctttttctgattattgaagtataacatatccaccctaaaccatttgtttctctgaagtatgtaatatagaaaaaccatggatgccataatccccttttatttggacatgtatttctccactttttccctatatggatattaatgtttattattgttatcttgttgaacacatcccacaacgcaaacacgtttgtcacttggcttttgacttaacgcttacccttgaccctttcctatgtgtgtaggttgtgttttgtcgtgaggattgccgcattgaagagtctaaggctgggctagaggtttcccggttttattcccattggcgtattcaggggtatttatgtcctcattcctttggtgacagtcttttaaaatctttgccaatctgataaaaccatgtgttaacgcttttaaatttatatttctttaatgattagtggggttaaacacattgctatttatgaattccacaaattttgattgagcgtctgttaggtgagataccattcttactgttggtgataaaatcgttggcggacgggtgacagaacaggtggtggagagcccagctccaggcgcgtgtccctgggccttctcctctgtgtggctctgtgtgctgtccgcccggttgctggctgccctcctctgctgtgtgcaaggcctgtgtgtgtcagggaagcctttcttgtcacacatgtcatactttttccaatttgttttttgcatttgtatttttttattcagctcctatacatttaaaaaaacacctcagatttaatggttgtttttgttttatggcttctgggatgtgagctttatttatttcctaaagatcgtctcaaggaaaacacattggctgatgtgttttgttgttgtttatagatggcatgatttgtgcaggctcttgagtggttttcttggtagcacggtatggcagtgtatcatccatttttgtccgttggatgagtcacattggagacattggcattgtcttcaagtgtctgctgaaatgtactcaaaaaacaaagacccacataatcgttgagttataatataaatctagaaaagataaaactccagtacttagaacatatatcctttaaaagaaatccacacttaacctgattgtgaagaatgagttgtttgtagattaaaattcgaaacagtgcatttcttatgaaaattaagcttctcctgactggcttccttggtgactgctgtgacagattcctttgatttgctgtcccagttttccacacgtgagaattcacattccattctaaaggatttacttcctgtaggttccattagcgttgactgagttgtgatgcacttggggtgagctgcccttctacctgccctgttggggcactgtgaggcctcctgattgtcagatcagcgatcacagtgggtcggtgctgctggtctgcacaatggtagtctttggcttcctcatgtttctgccacctggagaggtggctttttgtgggctgtcactccgtctgtgaatggcagccgcctccgtgaggtgggccatgagcacaggggcactgatgatgcagaccagtcctctcggcactcacagactgtgccctgtgcatggtgattgacagggcctttgccagtgccaagtgccacccgtgcccattgtgttcgcctgtctgggctttgctggtagggtctggaagagtttcagtggtgagggcctgcttcagagtcacttgtatgagaagatccgaaacatgtggacgatggtgtgcatgtggggagggtctgacatagcctttttgctgcagggaatgacgttggccggagctcctatggcgccatgcaggtgaagcaggtcttcgattatgcctacatagtgctcagccatgccgtgtcaccgctggccaggtcctatccaaacagagacgccgaaaggtaatgggttgtgtgtctgcgtctgggctcagcgtgcctgtgggatggtacttatccctttcctgtgtcatttacctccatgaaatttatgaagggatgttctgccgtatttcagtagaatctagatatgttggtgaaggaaggccttctaggaatatgggatggctgtgtgggattcatccatggttgagagttgaaaatttctttcttggagatttgacattttcttcagggtcttttgttttggggaggtgatttctggcttttaaaattcagtccctaccatcttctcttatgtacactcgtcccttgttctacattttggggcatttttacagtcccaaaatgtagtcagaagtatttacttctcacccagatcatgctgtggtagtggaaagggtggtatttgaaggggtgggagatgagataggaatgggaaggaagagtaacgtggtcgtcaagagtggaattcgaaacagtttgatagatctgttctgtggtggatgatggaataaacaggtttcgaggcctggctcagcagccgctgcaggtgctggtggtgctggagctctgtgtgttcctgagccgctgtctgctcggtgttttcaggcggagctctgggccccatgtagggcactcgtctcggtaccgtctccattctcgtccgtgcagtgggaagtgaaatgtcagcactgtatgatcatcgtgggtgggaaggccccgctcccctacttggagctgcatttcacagtggtcttctgtaggtagatgtactgcgatcccagggtatgcttgagctgaatcattaaaagtcagagatatttgtcaacgtattttagctcctttcctactgtccttcacctagcgagatgatctgttaggggtataaggtagctgttcgagaggggttctcagctccctgacacctgttgtactctgttgatctccaacaatgtccctttgcagtactttaggaagaatcatcaaagtaactcaggaggtgattgactaccggaggtggatcaaagagaagtggggcagcaaagcccacccgtcgccaggcatgggtgagagattaattcatttgtgttcatcctaaccactggctggcatgttcatgcagaagtgtctctattcctttgtggtaaattggtcaaattaagaaaatagctagtttttctgatgagcattaattaagaagacaataagatctagagcagcactgtccagtagaagcaatataatgcatgccacacatagaatttcaaagtttctaggctgtgtcaaatgtgaaaagaaacaggtgaaataattttgatagattttattccactcaagtcaaaatattaacatttcaacatgtaatcaacataaaaataattaagatattttatagctgtttcttgtactgtctgaaatccggtgtgtatttattcgtacttatagtacatcctaattaggatgctaaattttcgtaaaaaatacttgatctatatttagattttagaaagttcacagttgaagatgatttgcatacccaagttattacaaacatgtttaatgttttccaacaactaattgaatgtaatttttaaaattaaattaggcaaaacctaatgttgggtttgttagtcacattagcagcgttcccggctcagcagagcccgtgactgatgctgccggggcggctccacgccgcagttctcaggagttattaaccaaggctttttccctccacagacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgtaagtgccctcccctcctccgtgtgtctgttggacagtttgtgtctctggtaaatgtccatagccgcgagcttaaaatctcccccttggttttgctcaggttttgtttccttgtatgtgtgtggaggtgggtggggggcagccccgtgatgtgggcaccaggcttcctttcccctgccgtgaaccttcagaacctgtctgtgcgactcatgcggctgtcgagggcagtaatcctctaaatggttgaactacagtggacttccttgagtagtttttaaaaatttatttgaagattaaaaaaaaaattaaatccaagtatctcttctgtatttcctttaacattctttttcagttgtgatgaaattacttgaaggaagcctgggtaggtttgggctgcctgttcagaagttagacttaatttgaataacctttcatagccagcctggatgcaggcgtttcttttcatagctttaaggaagtagtagtgcacctttgtggtacagctgtcctttttgttttttgtaccgggttcaaggattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcaggtacgtggccctctggcacccttcccgctggtggcccctgggaacagcatccgagctgtgatatgcactagaggagattgatggtcctttgaattagaagagtaactttttgagtctttggccattggtgtgttgttctaggaaatcctctcttttttgtggtgttgaggtcccccatgtatagtttcagcagcgaggacactgtggttcttgagtgctgccgtggcttttcacgggggccaggttgactgccttcctgcaagtttcctcactgccccagcatgagactgctgtcgagggtcatcttgagagagcgactcagtcacgacccacttagctgggcgccaagccgtgccagacacttgtccctacttcctctcagaatctcaatgaaagttttaatgtgaacttattagacttttttcatgtttgaaattaggcataatttctaaggctttttctgttggaatatactgtttttaaaatttagataaaattagaaatctaaaggataattttataaatactaaattttgtatctacttgcgattatacatcacttgaatatgtgtgggtataaaacccaacatgttaattgacttaaaaccattttctgaaatgtggggtataatttgagcataaagctatgtaggtacatgcaaaagtgttttgactcatttcttggagttttgcactctgctctggggaagacattctcacaggatccaccgtgattctggcggagcttctgggatgctggctctgtaatgacccacagagctgatgagcagagccatggcccagccggacaccgtaacgtgtctaattgcagcataagtgtaaaattcaggggcaattatttacactcttaaaatgaattataccacagataaacttggtcgcctttttatggtcatcacagtggccctgacgtcctggccatgtgtcacaaaggtgtttgttttaaccacccacaagccttggggcccttgagagcccagtgcggctgctgagctacagagccacactctgcggctgcttgtgtggttcgagtgtgaagtccagggacgctgagggtttataggtttttatctaagaagactcttggccacagtcaatctccagaggttgttggggtaaatgcacgggatgccaagatgcaaccaggtcagtattgcaagtctgagaaaaggggttctcgttagcgcacttctgctgctgacagtaacgggtgatgctgacatagaagcagcctgggacctggacagcaggcaaggaaggaactgccagccgtcccacggcctctcaggccaccagttgggccagccttgggctgtgacccctgagttcagcgtgtgagtagggggttcaccacgggggtgacggttgttcttctgatgactctaatgtcttgatcgtttgatcttcaatgagtttcaaactttatgacttggattactgggcatactttatatgccagttgctgttttagaatacgaagtatttccaattcaaagcacaatattgttaggtaatagtaaaacagactgctctatggagcccacatgcaactgtgccatttatcagctgccctttggtggtgctgagcttagaagccggatggttttcctctgattgctttggtacccatggccgtctctcattttgttcctagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataaggtatagctctgtcctggtgcattcacctacctgttcaagctgccatgtgagaggcggtgctaaatgttttctcctccagagagaattccagagagatcatttgaaaacggaatttgctttgttgtcattcagcctgtttgcttgtctttccaaacaaaacttaaaaaagttaaattattttaagatgtaatatatagtttaattggttgccacaaacatctcttaattcctctgttgaactgattagcataaaactgaagtttgaaataaggctcaaaatgaagacttttcccatttacataattcatttatatgctaaataccttggttttcaagaagcaaatgataaaaccaagagcagatcttgccatgatgtcccgtgtatgctgctgtcattcccacgttgcctgatccccgcctggggcaggagcaagcgtcagggctggcagagctgtgtgctgggcctcagcagggccctggcatgcgtgcccttgtggctcctctcaagtccagctgtgtgcatggaggaaacaggtcacgttaagtctctatattcttgaagtacctgaatgattgggagagccatggcgaggatcttccaggtcagcccccgtcgtgtgtgatgttccttgggctctgcggatgctcggtgctttcatcggtgtccacacctctttattccgctcctcctttgcttgtctaatcctattttgccagtaagttttttattcttgaggctttgttggccctgtgttgtatgatgattgtttttaggagttaagtaatagaacatttcctcttggatttatccatccccgatagacacattcagggtgaaagaacaacttcgcacaccggcctcttctttgcattttggctttgctttcccagtctcctcctgctgtttttcttgctctgagactttcctgaagccggcgtgtgttccctctcagtctgcttggccgcgactttgcagtgcagggaatgtgctttgggtgtagcccaagcacaggctgctgcatgctgggatcgacaggctgctgagggcgagagcgccaggtcctggcacgtgtgacttgcttggttctttctagaaggtcacagctgggggaagaacatgacagggaccttcttacttctgtttttttggagacagaatctcactccatcacccaggctggagtgcagtggtgtgatctcagctcactgcaacctccgcctcccgggttcaagcaattcttgtgcctcagcctcttgagtagctggaattacaggtgtgtgccaccacacccagccaatttttgtatttttagtagagacggggtttcaccatgttggtcaggctggtctcaagctcctgacctcaagtgacatgcctgcctcggcctcccaaagtggtggaattacaggtgcaagccattggcacctggctagggaccttcttatttctatggataagtggaacaagttagaagtgaggttctgctgaatttgtgtggtttgatcctggtacatggttcttgcctttagtcattcacggaatgggaagaatgcttttctctcagatggaggagttgggaagtcccagagggcaggtgtccatccctgctccctatgtaacatcacgtcggtgcttagtgtggtcactgcccgaggacgtgggcattgtgcctgctgtctggctccaacactgctgtctctctctttctccagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccagttttgtgtttgtgtccaagtgtatgctttcaagggcaagagtggcttctacattttccgtattgaatttctaaattagggcagtgctttagccatttattctaaataagattcaagagaaggcagatgattccagtcctataaagcaagttgcagcagggagattatgttgtcactggtccattgaagtaggaggaggtaaaaatacaaaaattagccgggtgtggtggctcacacctataatcctagctattcgggagggtgaggcgtgagaattgctcaaacccgggaggcagaggttgcagtgagctgagaccgtgctactgcactccagcctgagcaacagagcaagaccctgtctcaaaaacaaacaaaaaaaagtgggtggaggttctagactttgcataaggcctatgtaacagtaacagaaacctgtcctctgtcctcacattctgatgctaacaggaattcagtaaaactgtttaaatgattcttatatgaagtttctggcaagctgctatgtgatactatgtacttagaccgcccaggggcaacattttagtttcttcatttcttttaggtcagcattgcgtcacttgcaaacaagacattacaaaccaaacaatcataatgtggcttaaaatttaactgacgtttgggatttatttatttatttattttgagacagagtcttgctctgttgcccaggctggagtatagtggcacaatcttgtctcactgcaggctctgcctcccaggttcaagcgattctcctgcctcagcctgccgagtagctgggattagaggtacccaccccatgcccggctgatttttgtatttttagtagaggtggggtgtcaccatgtcggccaggctggtctcgaactcctgacttcaggtgatctgcccacctttgcctcccaaagtgctgggattacaggcgtgagccaccgtgccctgccgacgtttggaatttatgaggaaaggtacaagaattcttctaggccagtaagtgacagaactgcatgtcccagcctgtgcagccccttgagtgcatgttctagagccatcagctctagagtccttccggttgtcaaggtgggtgttgtgggtaaaacacacattccttccacctggagaacagagcagccctatcctcatggcacctggttcctaagagtgtgcagaagccgctgacagcaccatatggtggtgctggggggaagacgacaggcagctgagtgggactccaaagcctctccagggggcagagccctgtgcagcttctgcatgagctgcggtgggcagggtggggctggcaggagttgagcagggcctccgagggaactggagggcttacagctaggggcatctggaggaggaacccaggacagtgctgaggtgcagggcactggaggcaggagacgtggctgagttagcctctgtgttggaggcaggactgatgggtatccggggggaggcactcttgacctgccctggatttccctgtgagttgtgatgcttcctactcagctactgatacctgcaggagagctgcctttaggaggcttccaggagcagcctctggagcagctgtgttaccagggagcctgaggccccacagaggcacctgaggtgtcaaatgggtcccgctctcctcggaagctgggagtactggaaggtaagggctttctgagggcacagtgaacctgtccaggccactacgtgaacatcagcaagcccaccatgtagtctcgggaccccatgcgctggatctcgtggtaacaggtaaccccctcgtgaccagcttccgtgtgttccttttgatttgcccagggtctcgagtgccacctctctaccctgtgagatacgcagaggaccctgtaaatgccgtgccccgcatgcctcggcctgggcgtgagccgtacgcgggggaggtggtgacgtttgtaatccagacgtcgtttcgttgcgactgggtcacctgtgatgccctaagc

SEQ ID NO: 17559 - DNA, 18474 bp, Human
ctgactccagaacccattcttaggccaccacactgcgtctagaattaataacacaccacttaaccccgttagatcagctcccctcaacttgaaagatagtgaccaggcacctccacaagcagagcagccaaggattcaagtatatgttgaggaaggcaggcaatacagaaaaaactaggtggctcaactgagatggaacaagcagaaaatgcaaaggggaggtccaggaatagaaataaacaggaggtaggagatgggtacacagaatgctggttaagacaaagagaaagctggatttgggaaatctaaaagtaagaaactctggcttttatctctgtatgtaggagggagcaaagataacctcaaggccatgtggggagctagcaaggataaggtttctgggaaaaggaatgagaaaagggagggtaaactcccgaggactacaagagcaggagaggctttgtgtggccaggaggagaggccagaagtcaacgaggcaggctagaataggcactggataccaaaccttcctgttcctaaggagacttccttccagcctgagcctcctctagtagttcggctactaaatgctctcagcccttaggggctgtggtgggaagtggggagcggggattgtaaagtgctctaactattaatataatgcggactgagaatggatgctggcacaattttttaaaggcagtaggcttaacgctagtgccacctacccctactccacttctctagcctaacctcagccacacccacatgctaaggaccatccaggaggggggagcgtgtagcgcgcctgcgtgctcgtgcgcacgagaagcagagaggcagagaaggagacaaaaagagatagggggagagagagagagagagcgagaagagagagacagacaaggacagaaagggggctggaggagaaagagagagagagatacagagagagagagagagagagagagagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggacccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcaggtgcgtagatctgtgttttttgtgggtgagcgcactcggcccttgggtggaaaggggacgccgcctttcccggggggccggcttcaaagctccagaggctatcttttccttctcaactaacggggccccgggcgggggctcaggcgccgtctctagtggctgcattccactccgcaatttccaggcggccactggactgggagtctcgcgccgggggccggcgctgtctcgcgagccccctcctcgagccagccaatggggttggttgctggcaccgcccgcccgcctggtgcagagcgctgggcgctgcgagcggcgctgccatttaaaggggccgcgacccctgtcccggctgctagggagggaggtagagaaggagcgcggggccgtcgctgtctgcagttctaggcttgtagcctttgcactaaccctgccgcaggtaggggtcgggcctgctcaagccgaaccgaacctgcaagcgggatcttgcagtagccgggaggcggtggtgggggggtctaaggagagatcgtagctccaaaatgtcttcctgtaaatgcctgaggttgggggtgggcaacaggagaagggaggactggaggagcaatgggaaagggggacggggctgaggaagtgggcgacctgaaaggtaactggggggaaggggttgcgaagggcagtttgtgggggcgggggaagggccgagggaggacctagcaacgcggggagggggggtggggccagacagggtgggtaaagactggggagctggggggctcctgcagagtggggagggaatagaaactgagatcgcgggggcgggaaaggctcctggtggcgacggccttaggagactctaagggggcgttcagcctgagttgcggggggtaaaaggtaaggggggaagggaatgggagttgcagtcgagtaggggggtgggcgggtagaacgaccgactgcctggccagtgtgggcacggggccagggcggggaacgcctctccccactgggggcgctgtattggggggagtggtcattaggactaaagccttcggaaatgcttgtagattgtggtggtgggggctgctcatgagaaatccaagtggatgatggggtgtgtctcagagcctatataagaaggaattcaggctaagaccacctctactgccccctcttctactcctaatctgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggtaggttgcctaattatctggagaatcagggctgggagagggtggtggtaaggaggggtggctatgtgctttgggaagtagtggggaggaggagggtggagagataagtgtagggatgtgtgtggggaaggacttggggtttacgagggaggagtggggtggtgtgtagaggaagattaaggaaagtaggggtgggcacaggctgtgggggaggaatggggtaaggtttcagggagcgtaggttgggaggagtgaatttggtgggaagggttccctttttcctaccccagtgggcttttggtgccagagtccttccttcaggatttgggggagtacaccaggcttcttggttctaagacctttacagctttttggttctagatgggagtgggatttctgggtttgatgaatggtaactaggttctggagcccctaacagcataaggatttcagcagagcgatagaaatgcagggtctaggattgcgtctctgataggggagggacaaccttgacttgagaggctctagtgtctcccctcttctgcctagtggtgtgcctctatcaggctgtgacgagggtcttagggcttatataaccacctgaatccaggggaagctacccatacactgatgcttccttttccttttgctacctttgggtggttgtgtgtgtttttcattggtaaaatataaattcttaatgaaaggtatattacctgtgtttccttaacccccaaggattgggacagaaagctggtgggaaggatagattttttttttttcatggaatagctgcacgtgcacccccccacccttagtacagagcctgaggtaaccctgagaggggccccaagaagccacaggcactcgagttttccctttcagttttgagtaagttcttccccaggaatggaggcgggggttgggccggggagagggtggtgagggcaggctcaacatttaggctgccttctgcttcctttgcaggagatggcctgactgcgaaggcgagtgagaagccgcctgaacgggtgagggggaggggattggaaggagtctggttcccccttagctctgggaaggacagacccttcattttccctcccagatgttgttctgtagagagtgtgtgtaaggagagttaggaggagggagggagcactagtgtctactgcttgttggggagaaagtccaacctccttttcttccctcctcctaagggctgggccaagggtccccactctcccttccccctcccatcttctatccccccccaaaccctgtactagtgttagcctggccagggtgtcagttttcctcccctcccatctttccgaggtacagaagagaagcgagcgcgttaggagagcagaacctccaaaacctgaggttgtagattccactgagagcagtaagtaggatttgaggaagtgtgacctgggagttctgggtgtggaaaaggtccgaaagtggcatgcggcagggcatggatcttctagctcctgccgtcctgctccatgaagcgcatgaagtgcctgtctctgctatgggttggcatgggaaccaggggcagtgggggaaattgaaaacaagagcagtgagaatggcgagtttcctgtttcagctatgccatctctgtctccgaatcttctcatttagagcctctccctttccctccctgggaggttacagagtaaccaagggagagagacaccaaggtcttaagatactgatgtaacaagggccagggtgtaaaggccggaacaacagggatcccaggagagggactgaactgttggtcaggggatggttggagacctggtttggtggcctttctcatgtccatccccccactttctcagttccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaagtgcgtgagggtcttgggggctatgcagagggcagggatctgggcaggagtatgagtaagacagagactgttggtaagaacctagcaggatggagctgggcgagagagtgatgtagggagagagtcagagtatttggctctgtggtcattgatcctggaggaggggcggaagctgaggaaatgagagggtggtcttgagtgaatattcaaacctgttcccacctctagggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtgaggacactcagtgggggctgatttacagagcctggccagccctgacctgcccctcccatcctggggctgcagggtccaggccctgtggaaaggggagtggggaggaaaggcggccatcatgagggagcgtattcaaggacagagcttctccaggatgtgcacagctggccttccttacctcccaggacctcaccatcaagtcggcagcctgcggcgcaggttggggggtccctgggcccactgtctgctgtgaaggtctagggtgaggtggggggctgaccttgcattggggtgggcggtggtggccaggccctagctcagggtgcgtgtatgtgtgtggcaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatctgttatgttttatttttgaagctggctggtggatacacaggtctttgttacatcatcatctatactttttttgtatgcctgaaatatttcatgtttaaaacatttaaaaaataaaagtgaagggacaaatccagcctcagcctctccttccccatcctcacagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggtaggtgcaaagccctcttctctgagtcccctgctggccttctctctacctcccatactcccctcttccagagtaatccttgctgcccgacctcagtcccaaccacatctccccatggattttctgttcgtctcttacactgccttacaccttctgtgtgctctctctctccctctctctttctcttttcctctctctctttctctctatgccccaggccctccccgaccctgcagcttctgccgccgcagcctctctgacccctgttactacaacaaggttgaccgcacagtctaccagttctgcagccccagctgctggaccaagttccaggtactccagaccctggaccagggatagaagggtttggcaacataaagagggttggagaattggggtaggcaggcctgggcagagcaaagaacaagcctgactccccttccccaccgctgcacacatcttgcccctcccttacttgtcttccttccctccagcgcacaagccctgaggggggcattcacctgagctgtcactactgtcacagcctcttcagtggcaagcctgaggtcttggactggcaggtaagagccccacccccacccacgtcttgccacacgaccagactgtctgaaggggtccttccacttggcccctgctggggccagatgttacagcttgtcctccctgccctgtgcccccacctcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggtaaggagatggggaagggcagaagacactataactcccagccagggagaatggaggagaagggagggaggccgggaaagtggtccatgaggcagggccttctgcccgggatgttctacccccatctcccctaaagttttgggcacaaggggctgcttagagagaggtttcaggtatagcaccttgaaaaggttgggtctcttgcccttgggtatctgtgtctctggactctctttcctcttctcctctttccaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggtaaggagggtcagcatgcgagcgaggcgggaaagagggcagtggggagcacgggctgtggtactgagctcggggtgtggacagatctccagggagggcagccagccttccatctctaagctggcccgatctccaaggggaggagcatggcttatcccgggggaaagaaagggcccaacgcattttagggaggcaggtctgaccatccttttgacatcctcaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtgagtcccaggcagggggtacactctgttagagggagcctggactctcctaatcctaagcctagcccctttctccttcctcttgcgttcagctcacccctggccagatagggtgctagtactgtgaactgtattctcttttagcttccgaaccctgcaggtaccgggggagtcttatttaaagcttcttggagttagcatctactgattgtctatgaaatatatattgttagggagtgggtgcctttcctggtaggatggagcatataggggttatggttacgtttctgagataaggaaatctcagcataaactctacatttagtgagactgaagactgctatttctagaatgttacccctgcccctccacaactccagggataacagactcttcaggctatctaagtggaaggtctcaaatgtgggttttgggggaaaatgtaatgtttcattctccaggaacaaataatcttttaggctgctattgctggggcatagaggagactagatctgggatggcaagggggtcaaatcctagaagttcccatctgtatttggtgtacctgttaatgaagctctcctggaacaggggtaaggaaaatggagagctagtcccttggatgagagcattcatttgttttgatctacaggtcagtctcctgagtcaaaaccccagacaccctctcaaaccaaagtggagaacagcaacacagtgaggaccccagaggaaaatgggaatttgggcaaggtcggggcaaaagccaagggggaggataatctcagaggagggtacggcggttggtggcacaaatgttcctctgtctttgcagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacaggtgagccagggtacctcgatgccacaggctgtattccagagtcctaggcctgccagccctatgtccgtgagctggacaaggggatttcttaggtagctgaagcctcattcatatggttgtcctagaatcatagaggtgtctttcagcctttgattcaagggcagttttgtgacactgagcatgttagagcttttggtgggtcagatgtgaccagtccagcagggtctctgagaagacccctttcttatccacagaagagtggaagccacaggtgatcgtgctgcccatcccagtgcccatcttcgtgccagtgcctatgcatctgtactgccagaaagtcccggtgcctttctcgatgcctatcccggtgagtttccctgcccttcctggctgggtcctcctttccccttactctcatcaactgtcccccttcactcatcatctgtccccccaacttccccccaactgctggtgtggttcttggcatttagttgggattcgtgcctccaggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtggtatgccatagatggtggcgacgagggagacagggtgctaccagcatgtctctgcccgagggggtggtattggtgatcttggtgcctagtagaatgggaggatagttgggatcagtccctgaaagcttgtgagggtgctagcaggagcttgtaaccactgagccaacttctctgcttcccagatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagagtgagtaagattggagccatgcccactgagtatggtagcatttgtgccatcaggaagggagtgtcccttgtgtccctgagcatgaccctgaaaagtgttcattgtgattctaagacggaaggttctcacagggagcagtgccagagacaccaggacaggtgcactcttttagacttctgagtcatgcttttttttttttttttttttttttaatttttaagctgaaaaaaaacataaaattttaccatgttcaacatgtttacggttcagtagttcacattgctgtgttttgcgtttctgtgcctctgagcatgctttttggtatagctttactggttcctttggctcatctagtgtcaagtgggcaagtagcaggggtggggcaggagggctgcagggttgagatcttaagaaattgatttcttctttctttccttttcattagatcctctggacattaatcccagtgtagacttcctctttgattgtggcctggtagggcctgaggatgtgtctactgaacaagaccttccccgaaccatgaggaaggtagggctggggctactgtatgtacaaaagaagaatggaggcccaaaggggagatgatgcgagagccaagccagcaaccatagtttgaccttccctaacctcctttctccaacactagaagtactgagataaagccaaactttgctctccccccatctcacaaggtcatcaaagctgttcctggggctctgtgctatggaagcttgctgtgtgcttacatcagcccctgccccggccagcagtaaatatggtgctgactagctttcaccttgcctctggccttacctctgccatgcccctgctttctcttcccctccagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccgtaagtacttggggatggggggtgtggggaggcagggacagggaggaggaggggaaaggggagaaggggctgggcctgtgattcagctgaagatgtctagaagtgataagggtgtgatcccttaaggatgccctgtgaagatggggaggagttgtagattaaagggaaatgctgtctaggttccaggttaggggctctttctgtaattgttcaggagctaggcatgactaagggatggaggggttaatggtgatggagctaagtgaaattctccatgtagagtttttcttaatcctgtccctgcacaacatatcactgcagccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcaggtacctcttgtgcaccacctcacttcctgtcactcttaacacagcaggcagggtctaaacagaaatgattctgggttaggcacggtggctcacgcctgtaatcccaacactttgggaggctgaggcaggaggatcgcttcaagccaggagtttgagaccagcctgggcaacaaagtgatacccatctacccaaaaaatatttttttaatgaaaaaaaaaagcagttattctgttgcactccctgttcctcatcttgtcccctacctgaagcaggcagcttgcctttaatctcctactccaaatagaacatgagatatcaatactcttctaaaatcaaaactgcattccaggaccgttggccaaggagcagtcttcattgctatccaggtcccctttgtaatctttaagcccattctaggaggggagggatgggtggagctgggatccttgagtgctggggtaatgtttagttccccctgggagaagtcaaccatgtattacctgagaaggaggtgtgggcttctaaagaacatctcctccaagcctcctcctcttcgagcaaagcctgagtagcgcagagctgtgggtatacctgggggaaagcactcgaggccacctaatcaagcaactgtttcccatcgtctcctaatgatcaaggacaccatacctgggggcttcagcatcattatctttcttctaggacctacagtctagccttaggtgtgtctgtttttctttccccagtacttgctggaaaataaccggatggtgaacattttcacggacctttactacctgacttttgttcaagaactcaacaagtctctgagtacctggcagcccacactcctccccaacagtaaggaacagggacgtagcaacccctacccgctttctccattcttccaatccaccatcccgagagtcctgtgctgtttggtctgccactcttcacaaagggcccgagggcaggagcgtgtagctggatgcctcagggtttagagttaaaggagcacaggagcgcctgttcttgaacgtgagatggggatcaagacttaggtctgaagagctatctctaggaccagaaaaagatggcctgggtttgggtggtaagtaaagaaagaaagcaagaaatcgtgggactcctcaaggtttacatttacttgtctacaacttgagggtggtgagaggcgttccaaatgcaggtgtggaaagtatatattttttaaagcccagtcccactgtgtagtgtagcaagtgtagcgaagtgacagtgttttatatacaaaggttactcaccaaatgagaattgtgtgggaaatgagcagggcacatgggatgggaagtggttgggtttgggtagccactccctcctgactggcctctcccccttgaccattgtagatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgaggtacgaggctgccccctcccctgtgcttttgccccttctctgccttccccttccatgccctgccataacccaccatacctgccaggtcggccctctccttggcgcctagcttccctctcctgttcctgtgtgcagaaagggtagaaacagccagtcctcctacctgataggcagtagctgttgcataaataagaggtcaccctctggcctgtttcccctctttcctcatttaagacagtttacttgcttgcctgctttttctgggtggtggacaggtaggaaaccattgggtgtgtttggctgtcggggagggtagaatgacaggctttctgtgattctttgctatcgggtctaacaacaactgcaccttggtttccattttttctgtccctggacttctgtcctgtctgagtgaagtttccaaggtcctttctctggacccatgcttctacctggactaatgcacaaggggttggggtcattgctgtttctctatcccagaaggcaagcccacccttgcagtagggtctgttttatcaggtcttttgaataacttctgagatcacctcttcaagatagcaacttgggggagattttaaagagagtctttggcagtgggaactggggagggttgcataacaacagcccgacaggatgttgggttggcgtgggagagggagactgacctcttcttccacctctccatcttgatgagactgtaatttgtgtcgtgacgccttctccctgtgccctgaactgtgctcttggatgtggctcatggagcctgtgttcttaatgagtctgaatcatttccctcccctatagacacgggtcctggaaaacggaagagagaagatgaagcccctatcttagagcagcgtgagaaccgcatgaatcccctccgctgccctgtcaagttctatgaattctatctctcaaaatggtgagttggtgggttggcaggaaaagcgttagcatggggacccgagggatctactttgccttggtactgatcttctgtcctgccacccccactcccactcccacccccgatgttgcagtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcttttgtcttttctgggtgatggatatagaggagcaacactggataacttcaaatctctccaagtgtaaacaagtcaggtgtttgagaatcgttcttactttactgtcttactttggatctactgggaatgtggtgttttttttgttttttttgtttttgtttttgttttttttttataacaagtttccaaacacttaaggaaaaaaaaatactcactcactagctatgtattaaggacctattatgtttaaagacctagattacgtgcttcaaaaaatacaaaaagactggttagaccaggatccaatccccagcaggctcccaggctataggggagaccaaatagtacacaattagtcataatacaggcagaataaaatgaatagtgctatgggaggacagaggaataaataactcacttcaggtttacagggaggctgggtgcagtggcttgcgtctgtaatcccagtactttgggaggccaaggtgggaggattccttgaacccaggagttcaagactagcctgggcaacatggcaaaaccccatctctaacaaaaatacaagaattaactgggcatggtgacgcacaccagtaatcacagctattgaggaagctgaggctgaggaggatcgtttgagcctgggaggcgaggttgcaatgagcccagaccaccccaccgcacccattctgggtgacagagtgaaactttgtctagaaaacagacaacacacgtttatagggaggctatgtgagggtttaccaagggaggtggcattagacctgggcctcaaacacaaagtggaaagggttgggaggccacagatgtagaggtgggaagtgcaaggctgagatttttccaaccaaggggtggtaggctcagatctatttctttagggagacaatccccagaacaatatgaagaatagcgagtgggagtaggcctgaaagcctggagattggtggaaggagtatggctaagaggttctgtggacctcaatggggactgtggggatagggaagggaaaaaaagatagattcaaagtaaatttcaggcattttgaaggtcaagtctgcaggatctgatgaatcattagaagtaaaggttctgggggggtggctcatgcctgtaatcccagcactttgagaggcagagctggtgaatcatttgaggtcaggagttcgagaccagcctggccaacatggcgagaccccatctctaccaaaaacacaaaaattagccaggcatggtggcaggtgtctgtaatcccagctactcaggagactgaggcagaattgcttgaacgtgggaggcggaggttgtagtgagccgagaccataccactgcactccatcctgggtgacagagtgagtgagactccgtctcaaaaataataataataataataaaaggtaaaggttataaaggttaggggaaagggaagaattgagcatgaaccccaggcttctagccttgatgactgggagagtgagatgcctttaaccaagatgggtagcacagggacaagtttttttttgtttttgttttttttcagacggagtctcactctgttgccaggctggagtgcagtggcgcgatctcggctcactgcaacctccatttcccaggttcaagcaattctcctgcctcagcctcccgagtagctgcgactacaggcacgcaccaccatgcccagctaatttttgtatttttagtagagacggggtttcaccatgttggccaggatggtcttgatctcttgacctcgtgatctgcccgcctcggcctcccaaagtggtgggattacaggcatgagccaccatgcccagccaagttttttttttttttttttttcggggggtgtgtgtgtgtgtgtgtgtgtgtgtgtgtgtgtgtgtgtgctgtcagggataggagaatgttgctaataagttgagatttttatcacattggtttcaagactccattgaaacacccttgtggtgcaccatgcaacatgg

SEQ ID NO: 17560 - DNA, 18601 bp, Human
  misc_feature (1)...(18601): n = A,T,C or G
aaaataatcatgaaaaactttgaaatattgcaagaattaccaaaatgtggcacagagacacaaaatgaacacacagtattggaaaaatggtgctgatagacttgcttgacacaggtttgccacaaaccttcaattaaaaaaaaaaagcagtatctgcaaagtgcagtaaagcagagtgcagtacaacaagtatatctgtaccttattttgtttgtttaatcctccttaaaaacccattgatgtaggtaaggtatttggcagatgacaaaactaaggtatgtggtgaataagcagttacgggcaaaacatggcagagtttactgccaaaatgaatgatctccacttctagccacttctgactcaagctgcccttctaggtttagaccactctccccagtgaaagatcaacaagacgggctcctgggaaatgccaaagaggctttgttgccttgggttcaggggtcaaaggtctaggctgttccttaagtctttttgatgtctttttttaacatttttggacccaagggtgggtttggcttagctccatactccacgtttgcttgccatttgaacttcagagatgaaaggcagatcccatagcacttaagagattttccagaacactagctggtcagggcagagctaaacctaaacgcaggccatctacttcctactgctgagctagtgccctctggaagcattggcatatggtggtggcctctgctgccctggctaacttgagtcagggtcagggtcttcctacctgtaaccccttcatccccaccccaggcactgaagccccaccatctgtttatgaggcgggtggccacagagataggctgatggtgagggggtttcacacactgcggtaactaaggccctggagccccacccactctccacccctgcgcttagtcccacttgacagatagaagatcctattgtccctgagcactgttaagggctgaactttgtcctccaaaatccatgttgatgtcctaacacctagtacctcagaacgtgactgtatttggagatagggtctttaaagaggtattaagggtaaacgcagtcattagggtgggccctactccaatatgactagcgtccttataagaagaggaaatgtggatgtggacacagccacacgctgagggaagacccatgtgaagacacagagagaaggcagccatctgcaagccaaggagagaggcctccgaagcaaccaagtctgccaacaccttgatcttggacttccagcctccagaatagtgagaaaataaatttctgttgtttaagccccctgtactttgtcatggccgctttagtagactcatgcgggcacttgctgtagacgctgacccccttgaccctccctcgctgcccctgcattctcctccacacacccctgagccccagccccagattcatcaagtccttagagtcaggagagtgggctccataaatctgcagctacattttcccatttcagggcctttgaggagtgctggtttgtgcttcaaagtgggccagggaaggataaactgcctttggagcatttgagagattgaggagagaacaggaatcacccagaaaacagactgacgaatattttgagttagaatcctgccacccatgacaagtcagctcccacccctccagagtctccagctagagcacttgcagtaagagttcagtgggcctttccaggcagccaggcatgtgctgccctccggattcattaacagggtttcttggggtcagaggaggtgccaaagccctgagagaagccaagccccagaggactcccaagttctccccgcagactcatattcctcttgtaggtgggaaagggacggagaggtgcagggggaacgccctgttccacatgccgtatttactctgggcatggctaatgactccagggccttatcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacaggtgagaagacgtccccgcactgtgttcagctgggtagtcccatgccctgcaactcagggctgctctggggtaggaaagctgatggggaggtgaagaggaggagaagctgagggcttgcgtcaatgcatggaagagactcatccagtgaccgcctgtgtatggccttaatctccagtcctcaacaagtcatcctcctgcctccacctccacggaggtgccttcccaagtcccaggggtcttcttgtgttgcaaaagagcaggaacctgcagttgtggtttgtagctcaaagcgccccaggacttccccaggggactgaccatcactgtccccaagagtttttctgtccctttaaatcagcccttcgtgatgttcatgtaaaactgtagaccgccccacatctcccattttcctagatctcaaagacctcagctccaggaggggagccatttccactctaagattctaagactctatagggcagagatgaggccgggcaggctgagtggcagagaggacgctgatcccacctgtatcctgcgtgctgtcttgcagatccccccctcccaccccatcttctctagttggcccctgagaaaatgggacgagaatggggggaagagggaggcagaagtacatctcctgcttacatgggggtttgtctccagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatgtgaggcctcctggggtcagggctggggagaggtgggagcgggaggaaggcccagcattagggcatggccagtgccacatcagtagcaccgaaggccattgtggatttcttcacttggatgatgatccatggggactgattccctgggtccccatggagttggctaagcaggcccccatgtacccaaatgtcagagttctctgcagaaggaaagggctgggagtgaaagcatcatcccacactgaaggcccctgcttctgctctcagctgggcagcttactggctgtgtacccttaggcaagttacttaacctctcccagccccagttccctggtctgtaaaacagatggttcttcctccactgcctctcctacaatgtatttataagaatcaggttagtgcaagtaaaatcaaatgaagtagccagaggcttggtttgatttcctccttcatggccatttctctgctccttttaccttttattttccagcgttgccacttcctaggctctgtaaactccagtctgtattaccccaggctctggcccctgggagctttcccctggcttcctggtgagcacccttgtccctccccaccacccacaccctctttccttctcactcttccttgcagatggaatacttcggcactatctccattggctccccaccacagaacttcactgtcatcttcgacactggctcctccaacctctgggtcccctctgtgtactgcactagcccagcctgcagtaagtggggccaggagcaccagcagagaatgtctgggggctagtcctgggaggccaagcctggtactctggggaaggggggcttaggttccagaaactggccatccctgccacaccagcttccactctccatctttgagtcagccgtggaactgcttatagcagagatagagcaaagccaaggaagaactaaaatgtggctgctgtccaagagagtaactttcatactgatcagaattaatagaaagaaagccattgaaaagagaaatctttgacataatgactcacttcctttggaacacccaaaggaatgtaggggaagtttaatttaattggttatttctgagcagggaggtgagtcgggttctagtgtagatagtctgcttgtttcaaggaggcttggtagccttatctcctggtgcacacaggtggggctggtggggcacaatggcatgggtgggtccatttgtccagaggtaactcagaagtttcagtgaggattggaaaagaagagctacagaaagatgtcttgttcgatacaggacaagtcccagagacagaatgtctctggaaaccccaaggctagagatgtccatcggttgggagaaaagttgggagtaatttcctggggcaattgtttatccctgagtttcttttgaagccaacctctgacccacaatgggtggcagggactgtggctggcgcctgataaatgacacttatcttggtgtgcctcatgaggtcattgtggacaatcaggtttgctcagggatagctatttggtccccagttaggccacatctgtagctagagggaaatgtagttgttcattagggaggggcatcaccaggcttctaggggcccccactcagtgttgagagctgagggaagagaccctgccgctgtggggctgggtggcattagggcagggatgcagccagtgagccgatggcataagcaagagcagtgcacttctttccagagacgcacagcaggttccagccttcccagtccagcacatacagccagccaggtcaatctttctccattcagtatggaaccgggagcttgtccgggatcattggagccgaccaagtctctgtgagtgcaagtccttcattttttctctcttggacagaaacttgggagacttattcagaggtcttacatttcaaatctgcctcaggaatgggtggaaacaggggttagcactaacttctaggagaaagggcaagcaacactccccacctgagatggtggcagtgggtcagtctccacagcacgctgggccctgggggagagcagcacagggggactctggcaggaagcagtgcccagtgcacaaagcctggtggcagggtgcacagctggatctccagtctctagggcattgaggagataaaaccacgtctccgtcttgaaggataaagaagtccacaccagggggagagatttggactcagtaacataagggggcaaggtctgaaatgggagtccaatcacagaggcaaggcagaagcccagttgtccaaaggccaaggtccaaactgaactcagtgctgagctcatgagctgttcctcaaactccctctgacctctgaccctctgactccctctgaagtcctatgggtcctagaactatgggaatcagacaaatgtggggacagagagccaggtactttttcaggcttatagacagcaatatatgcctgggccttgggagaaagagaggttgacctactcctggtgaacgttggtccatggggtattcccgaggccagcagggcacagccttcatcaacatcccttagagtgggtggagtaggacatattatcaactgaaagaatgccagaagcagaaaaacaccatctatgtaaaaatatcatacagataaaacaatgtactgtattttctattggaactatgtatgcgtgtgtatacacacattacatatataatatataatatataatatccatatatgaatatatgtaatatacagtatatttgtatatataatatatatccatctgtatatattatatagatacaatatgtaacatattaaagtatataataattgcataattatatcatataatacatgttatatattatataattaatataatatgtaatacattacattaatatatgttatataatatataatatattatagaatataattgatataatgtattatattaataatatagtatgtgttatataatatattaatatgttgtatgtaataatatattacataatatattatgttaatctattatataatagattaacctattatataatagattaacataatatattacataatatgttaatctattatataatagattaacacaatatatatgtaatgtgtatatattatgttatatataagattctatatatattatgacatatacatatatattatatatctaattacatataatatatatataaaagttaaaatgactattttgaaggctacatccctaactgatcatcacagtaacctctgagatgcagggaagggactgaaattagcatagaaaggggaattcaagcctatagcttgtcacgtatctgttggctcacctggctggtgtagggcagcagccaagcccacagcaatgtcagctgcattgctccttccctcagtttttctggctccaggaccaggtgtgcacttacctctaacaaatcatcagcttttgctgcataacatccccatcattgaggctggagacttggggacagtgagagaacaatgtgggttccagtccaccctcaccctcatgggttccaactggccctttttctcccacttgacatctatcttccctttctgctgtgcaaactgtagactgctgctgcagcatcaggacagaaacagtatcctaaagtacactgtttaactagcacccacagttgcatataatcaatatctatatccacatcattatagctatatctataatctatagtacctcctaatggttctgcttctcttatcaaaccctgactgacataataaagatatgacatgtgaaaatttgtagatgaagctgatgcagcccttaaagggaccatttagcctaaaatgcatgcgttgttaatagaaatgctaatgatcaattatctaagctcctatttcaagaaatgaataacaagaaaatgagcaaaccgtaaacaaacaatagcaaatcaaacccaaagaaatcaaaaggaaggaaataataaagagtagaatgggacacaaatgaaatagagaaatcacacagtacagaaaattaacaaagccaagaatgaactctttgcaaagagtaataaaattggttagcctctcacatgactaaataagaaaaaagaaagaaaatacaacttaacaatgttagaaatgagaaagagaacattagtaaagttatcaagaataattttatattgataaattttacaattttcagaaaatcaacaaatgccttgagaaatacagcataccaaaactgatgcaaaaacaaaaaatagaaaatgtgaatcttttaaagatatactctgttattaaaaaatctttccacaaagaaaactccacgaagaaaagcctcactgataaattctctcaacactaaaaaaaatcagtctttcacaaactcttccagatatttgacaaagtaaaaacactttataactcattttatgaaaccagcataactttaataatgaaacttgaaaaggacattataacaaaagaaaatataaaattacagaccaatctcttctctcatgaatatagatgcaaaagttctaaatgaaatactagcaaataaaatcttttggtatataaaaagatcataccaagggtcatctttccaggaatttatcatttaacagaataaaaggagaaaaatcatatgaccaatatgattatattagtaggttaataacattcaatatctattcatgacttcaagaaaaactcttagcaaactaggagtagaaagtaactcccttaatctgataaaaatgaaggacttcatctaaaagaagcccacagcaaactttatacttaatggtgaattgtcgagagacttctccataagatcaagaatgagacaaggacactcaatctcaccacttctattcaacattgtactgaaaatcctagccagtgcaacaaggcaagaaaaaagaaataaagaacattaagatggaaaaggaagaaataactctgtcaatattaatgtatgacaagattccataagtagaaaatccaaaaatatctacagaaaggatattgggattaatatgtgaacttagcgaagttgctggatatgaggtcaacataaaaaaaatcatctggggccaggcacagtggctcacgcctgtaatcccagcactttgggaggccgaggcaggtggatcatgaggtcaggagtttgagaccagcctgaccaacatttctctactaaaaatacaaaaattagccaggcgtggtggcacacgcctgtagtcccagctactcaggaggctgaggcagaagaactgcttgaacccaggaggtggaggttgcagtgagccaagatcatgccatggcactccagcctgagtgacagagtgagactctgtctcaaaaaaaatcatttggatttatatatacaggttatggatccttatcccaaatgcttgggaccggaagccttttagatttcaaattttttcagattttgaaatatttgcattatacttaccagtttagtatcccaaatctgaaaatccataatctgtaatgctccaatgagcattttctttgagcctcatgttggcactcaaaaagttttggattttgaagcacttcagtttcagattttcagatttgtgatgctcaacctgtagcaagtaaaacaaatggcaaatagatttttaatgacactatttataatactatcaaaaccatcagctactttgatgtaaatttaacaaaaaatgtgcgagaactctactctgataatagcaaacattactaaataaaagtaaaagacttgcataaaaatcacaaacattaatgaataaaattaaaagaagacctgtattgaaaactaaaccatgctcatagattgaatgactctgtttcattaaaaagtcaaattttttcaaattggtctatacaaccaattttattccaatcaaaacaacagcattttttcttagacattagcaaactgattctaacatttatatggatatgtaatacaccaatacaatcttgctgaagaaaaacactggtaaatattaagatttattataaagttacagtaatgtagacgtgtggtgttggcacagaatttaaaaaataaacaaatgtaacagaacagaaaatacaaaactatcaacacagtcatctgacttgcgttgaacaagatactgcagtatgtggaggaaatgatggtatatttattaaatagtgccaggtcatatgaatatccagatagaaaaaaataaatcttaattcctaccttacacattatcacatttcatataggttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttgggaatatagcaagcatctttgtgctcatttagtcaaggaaagttgggaaggagaggcattagcttcaagacagaggaaaatccaggagtcaaaccctttgccagcaatcccctgtgccattctcctgttctcctgtgggctttctcctaccaggtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcaggtaaggcccatcaagtctgtgaggttaaagtcagttataactacagggagacaacacatacacttgacttagcagtcaaaagacctggtttaggtagcttggtccattaccagctgtgtgatcttagtcaaaacatttaacctctctgaatattgaggaaatgggatttgcttcatcaagtagctgtaaaaacactttgtaaactctaccacactggcttaaatttaaggaatctctgggattggttcttcattgatgctgtcactaaatatcaagctcctattatatgctgattatgatgctcacactggggacccagtgaaacaagaaagacagtacctgcaggaggaggaggcagaaaaaaatgaaaagctgacaataaaataattgcatgctgatggatgaataaacaaaatgtggcatatccaaataatcaaatattattcagccttaaaaaggaagaaaattctgagacatgctacaacatagaagaaacttgaggacataatgctaagtgaaataagctagtcacaaaaagacaaatactgtatgattccacttaggtgaggtacctagactagtcaaattcataggcagaaagtagactgccagttgccagagcctggggaggggaagtgaggaattcttaaaccgttgttgatggcctaatgggtataaagttccagttctgtaaaatgaaaggtctggattttacaacagtgtgaacatacttaacactactgaattgtagactcaaaaatgggtaagatagtacattttatgtgacatatttttacaacaatttttaaaaattgcacattgtttttggaaaaggtcatgaggctcacctgtttctaggcactcttgcccggcatccttggagggtcatctcctcttcctccttacacaggaaggtgatttctgaccttgctgactttttccagctcagacctggcctgcgttcacactgtttcagcataagcccattcctctcattcccctctcccacatggagggtcctggattttccctatcaagctatgtttcctctccagcatgacagcactcaggaccaggcctaggaagagctgtgagtaagagaggcaagttgtctagacacctctgcttccccttgcagaacttccttctcccgtcgcctgggaaaagtgggctgtaatggagaatatcaaggcttggcagtcagactggcctggatttgaatcctgccacttacattgcttcatctcactgaggctcagtttcttccacggaccactaggttgatgtgagttaaataagtttagacagataaaatccccactacacggccttgcaccaaggtaatcaacaaatgtgagttcctttccccactccctctgtaaaaccactgtcctaaaattcctacaggtattcactcctctccctctttaccaccctgatttcagttttgtatctttctgatccttttcctcctcaaaatgaatctgtcttaggtcctatttctccagagtcctgctaggttccagaacataatctgagaaatcaataccaatgaaaataagttttcaggctctagtaagtcatgatacattcatattagcctctttgccttaacataaggagtgaataacacaaaaacgccaggcactgtcacaaccatagtggggaagatactttgggaaaaggtgtctttgggggttgcttcaagccacacagtgtatacccacccaggatggtcctggccttggttctgaatgacagacctgctggccccatttcccacctccttaacctttttatccaagaagcagaaacacattcacaaatggtcaaggggagttgtttctaaccttgtgtcaaaaaggcccagaccaattcacttgcagtagtcagagtcccggtctcaaagcccagactgatgtttctgcctacctgtgtgcttggcatgagaccaagaagcaaagggtcctagctgaggctcacccctagagttttgcagtggcccttcctggacagtttgtctttctctccatgtagtaacccagaaggtggtgcggggagcgagctgatttttggaggctacgaccactcccatttctctgggagcctgaattgggtcccagtcaccaagcaagcttactggcagattgcactggataagtgagtattccccatgaagtagtgacagtactaggggtaaactgaaaagaggcacaactcaaaccgatttaactgaaaaaccannnnnnnnnnnnnnnnnnnnaccactggtcactagcagaggatgccagaagcttactgtggttggaggtatggaggtgctgagcaagtgtgcaggaagggacctctgtaaccagggcagcagacacagcttccttccttgtacacatggcgtgcttttaactcaacatacagtcaataccagtgcacagcctgctcccctttgttcttttaacattaacacacaaggcaagggatgagtaacatggggggttgcacaggtgaattgggctcagatcttgtcctcaaaaaacttgtacagaagatgagatgcacccaaaccactatcctgtaaaatggaaggtggtcagtgctccaagagaggtgccaccaatgtggtccagcagacaggcatgaccgcttctatctgaatgctccagtgcatcatggagggggttacattgaaactgagccaggaaatatatacaatatctgggcacgaagcaattggggaagtgggactacatgcctgcctcatacctagcgccgtgctagacaatgcaggaattggaaaagtgtagttcaagtttcaattcagctaggattgagttcctgcaaggtaccaggcattaggaatgcaaaaaataaaaggcctcaatgctcactgtctattcagagtttttcaaactgtaggaattcacctatttatgggtcatgacatcattttagaagatcctgacctgaccaggtgtggtggctcacacctgtaatcccaggactttgggaggccgaggcaggtggatcacaaggtcaagagattgagacacctacattttttagacgaattggaatacagtagaaaataccagagtgcacttcaattgcatgaatgtgtgtgtgtgtgcactgggtcaagaagtaaacagatttcttcctatggatctcagtagaaaacaattgaggaacactcatatggtgggtggaaatcattgatgtgctccaggcatttgagaggccaaaaaagagtgggagtttcctaggagccgggggagggaaggtgggccgaccacaaccctgtcccctcagcatccaggtgggaggcactgttatgttctgctccgagggctgccaggccattgtggacacagggacttccctcatcactggcccttccgacaagattaagcagctgcaaaacgccattggggcagcccccgtggatggagaagtgagtgcctgcctgcgcaagggagtggtggggacaggagagccaggccttctcttgggaggtggcaaggctctaaacggatcctccgtattgggttttagtatgctgtggagtgtgccaaccttaacgtcatgccggatgtcaccttcaccattaacggagtcccctataccctcagcccaactgcctacaccctactggtaagaactgtttccttattctgcaggccacagggccctccccacatgcctgccacttccccttttcaatcgcctgcactttgcccgcctttaccctaagccccgccccacgttgttctgctctcatgtggcattccctctgggagggacacagctgcctgtggtggaaagaccacggggcttgctctaatttccagttctgccatgaagcagtagtgaacttcaggcaagccatttaaggaagtcttctgatattgccatgtagggcttttccactgacaaagtttaatctcctcaaccaccaggtcagactggagctattactatctcattttataggtgagaatatcaagactcagagagtcaaataaatggttcaagatatgagctgtttgcagggaggagtggagaataagattatatttgttctaacttcaaattaacattcctcctctagcaagaaaatgtcttttgttgcagtaaattctcaagtttgtagggtgaagtagaaagggaactcccagaccttttggacacctatgagcacctcacaccacagttggtctgaattttcagcattctaggtattcggcaccacacttcaacacactaatttttccaagagtcactcacagcatcagggtgactgcatcagaagaggggtgctaaggtatagactgagggcttcagccctacccctaagcctctattaactccttcccaaagccaccaacagacaatccaaataaaaacaaatgtttgctttaaaacacagcttcatggtaagtcccctaagctcctgccacatagggattatggagctgccactctgaacaccacactgaggaccagtgagacatttagactgagccctgttcatcagtccacatgcccatcaacaccccagcacacccacactctcaccttcccccacgtgagttgagtccctgcccaggtggaaatcactgatgtgctccaggcgctggagagcccaaaaaagagtgggagtttcctagaagccaggggaggggaggtgcgtggttctttcccggtatggtgagtggttcttttagaagatcattttagaagatcatgacctgaccgggcatggtgactcacacctgtaatcccaggactttgggaggccgaggcgggtggatcacaaggtcttgtgctggttctttcgcagtacagtgagtggttctttcccaccagcagatttcaatcagagccaccttgatccatcaaaactgctgtaaaaattttgacttttcacgtccttcctctcaagaagtctccctgagccctctgcaaattttcccacaccctcatcagcaacttcacatttcaaatcattgttggaaagaccacacttgcctggtagagcacgtctttgccaaactaaaaattagattggagaaggtgacactcttctcttgaacaaggaatgcctacttgcctcatctaaagggggtcactcaaatgtttgtttccagaacatcaacaagaaaatagcagtggatagccactaacacagttctttctctcccttaacaaaaactaagctgagcttcactagaaactaaagaaaccagaatttaaaccaaggtcttccggtgccaacccttttgctcttctagccatgcagcaagggtttcccagttgtaaaatgatggtgacaggggtaggtgggagtatataacagatgaacagttctcaaaattgtagaacatagaccccaggcccataagaatggacttgtgcagacaaacactttattaagcaacctagggtagggacatatgaagcaggaggaagaacccaccgaccaaaatggtggaacccaccagctgtccaaggccacccagtgccagccaccaccaccacacaggcagcctccaggcagtactactaccttcttcccccgtttgtcatttgcatccttctttccaacccacaggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcattttacctgatcgtttcagtggtcattgatgatcattgctgagatccacactataattaggggcggcagaacaggtgtttttctaattctgctatccctttggcatttgttagttggaattcttctataaaaaacataggccgggtacagtggctcacgcctgtaatcctagcactttcggaggccaaggcaggcagatcacgaggtcaagagatggagactatcctggccaacatggttaaaccccttctctactaaaagtacaaaaattagccaggcatggtggcacacgcctgtagtcccagctacccaggaagctgaggcaggagaatcgcttgaacccaggagacagaggctgcagtgagccaagatcacgccactgcactccagcctggcaacagagcgagactccttctcaaaataaaaaaaaaataataatctttggctgggcacgatggctcacgtctgtcccagcactctgggaagccaaggaaggaggattgcttgagcccagggtgtcaaagttgcagtgatctatgaccttgccactgtactccaatctgggtgatagagcaagaccttgtcttgaaaacaagataaaacaagataaaacctttccctcatcaaccatttgcccaggaaagaagacaattacttggggttttgtttcctttgtttaccagttttcagaatgagttggtactatattaaacaccaaagaattttaaacatatttgatgtgtttcaactcaccaattttttctttaatgccaaatcaccctatctttagccagtgggtgaccttcaaattagttcctgtgaacttttccagcccatcttgcacacttccagtcccatatgtggcatcagccattgttccacagagtcctggttcctcagtggcctcgggtaatgatgtcatgtccctaagacactcacctctcagagctgttgggaagaatcaatgatcttacctgggtggaagcacctggctaagagtggtaacttcccttctgatttgggtgtcatgctcagagtagatcacaactacacatctgcacacatacattttttgtttggtttttacttttatttttcctttttgaggaaattattgcttttaaagtcaatttagaacagcctgatacaaacgagctatgaaagcagtgtagtagaacagttaacaacactggctccggagtcaggcaggcttggatttcattcctagcatcagttgtgggacttctgcacctcagtttgttcatctgtcaaatggacatcataataggaactacagttgacccctgaacaacacaggtttggacttgcatgatttcacttattcacagattttattttttcaaccaaaggcagatcaaaaatatagcattcagccagtgctgtggctcacacctgtaatcccagcactttgggaggctgaggtgggtggatcacttgaggtcaggagttcgagaccagcccggtcaacatggtgaaaccccatctctactaaaaatacaaaaattacccgggcatagtggcaggcgcctgtaatcccagctattcgggaggatgaggcaggagaattgcttgaacccagggggtggaggttgcagtgagccaagatcgtgccactgcactccagcctcagcgacagagactccatctcaaaaaaaaaaaaaatacagtattctcgggatgcaaaacccatgtatgtggaggatggacttatcctatatgtgggttcttcggggccaaccgcaggacttgggtgtgctcaaattttagtatacttgggggtcctgaaagcagttccccacatacaccaagggacgactgtgctgcatggggttattgtgaggatgcaatgacattgcacatacgtaaacatttacctagcttacatgcctgtgctcatcaggccacagaccttcactctgcataggcgagtctcataaaaggcagaaagccctacagtaaatggctttatgatttttcatctaa

SEQ ID NO: 17561 - DNA, 113379 bp, Human
ttaagccaggtcataattagaaaacttagaaatgaaactttgcaatgcttgtgggaagtctctctcaatctcttgagagccagtgagttagaaccaatcagttaagtttctctatctggtggcaccttagagtcattcactgggggagattttttgcaaagttctgatgcctaggccttactcccagatactgtaatttatttcatctggagaggaacctgggcatcagtgttttaaacaaaatcacttcaggtgattttattgtgtagctgaagagggctactgatctaatgaatatagaattgaggatttggtagcattctcctgtacttgtttgctggtcagtttgtaaagaagagttccctgttcttaaacagttgtggccttgtaaccctgttatggctctaggagtggctggagccaaaaccttgccaaagtagagagctgagatcatctgacaaattcagttgtattggagtattatgtagtttgaaccctcttaaaattttaccagaggtttttggggggttttcagggttttttgtttgtagggggtggagagagcggggatcttaacagaaatttgttctctcacaattctgaaggccagaagtccaatatcaatgtgttggtaggtttggtttcttctctggcttgcaggtggccacctttttgctgcatctttacgtggtctttactctgtatgcgtgcacccctgatgtttctctccaaagcgtcaaagtttatgttaaaagtacttagaagctagtttaaaaaaccatttataatgccctagtatcagtgataaacgttagttgtgcggcctgccttgaaatgttttaaaaaatcactttgtactttgtctaagtacacatgttactgaaacaggagagttccctgacgccctcacaggatgtgtgacaggggtgtggctcatttattcctcttatgggaaggggagcacacaggtgagcaggtacaggagccagggtgagcgcttttgggctccggccccacagcagtgtctaggagtgttacaatgctcctttagccctgctgtcccagcataagtgttaaacagctcagagaagagtcagtgtgacagcctttttgggtttctgcatttagggcatcccgagttcttttcctgtgtctgggaagaatcaggtcacagggacttgaaggatggtgaatgtggggatgttattgagtggtggaggtggctgtcagtgggatggggagctggagaggggatggagtgggaagatgatcttctcctggagttcggctatctcacagccaatctccaacggcccccagcttgaacctcctctccacctttagacacttcctctcttctctccttctctgctgtgcttctctgccactcttctgcttttggagcctggggcttggggtttatatgggcacgggataggggtgcgtggcaggccaaaagggaacacttgggcgtgaaaacaggaatgcctgttctcatttagggctgcaggtccaggcttgagccctcaccagggaccccaccctcatacctcttgtccttattcttacagtgtaatgaatgcatcagcaaattgaaaacagatagtttttgccgtttcttaatttaattaaaatgacagttaagtactttgatatattgcctttggagtcatttccaggaggctatatttgtttgttttcttggtataatggccagtgtaccaatgatcagttttaagttaaatgtagtattaatgaaacttcagctttttactttctcttcttgtttgtatagcccctttttcctgattagattcactggtgatactaaattcgaacagttccataattcatgttttttatatctaaaaccaattactttttcccctttctatttgtaggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcaggtaggatgttgaagatactagttaaagctacagtggggctggactcagtggttcacatctgtaatcgcagcactttgggaggttgaggcaggcagatcacttgaggtcaagagtttgagaccagcctggtcaacagggtggaaccctgtctctactaaaaatacaaaaattagccgggcgtggtagcatgcacctgtaatcccagctacttgggaggctgagacaagagaattgcttgaacctgggaggccgaggttgcagtgagctgagatggcgccaccgtactccagcctgggtgacagagcgagtctctgtctcaaaaacaaaaacaaaaaacctacattggtgggtctactgttggggtactaaatgatggaacatgttctaaataatttgtgaagcaactgttattttaagttttgattaacaaaagtgaacacgttgggcgcagtggctcacatctgtaatcccagcactttgggaggctgaggcaggcggatcacaaggtaaggagttcgagaccagcctggccaatatggtgaaaccccatctctactaaaaaatagaaaaagtagctgggtgtggtggcacgtgcctatagtcccagctgctcgggaggctgaggcagaagaatcccttgaaccgggaggcagaggttgcagtgagccgagatggtgccactgcactccagcctgggtgacagagcaagactccatctccgaaaaaaaagaaaagtgaacataggtcttgcatagtaacaagaaagctcaagtggtgtagatggtaatacttgagtatgtagtccgtctttttctgatggcttatactgtcagtcattaaaattaactaagccatgtgtcaattctaagggggaaagcattaaatcattcagtgtagcctatggttagcattggacccatcataaatcatgacaccactttctaccccataaatacatacaattgtaaattgtcaatttacaataagattataaaaagaacatggacccaagtcatgttgcctagcgttcaaatttcagctttgtaccatacttgcgttatgactctgggttaattatataacctctaagcctcagtttgtttatctgtacaatgagggtaataatagtgtaactacttcatggactgttaaaaggatcaattgaattaatgctaaacatagattttggtattaaggttttatgctggccgcaaaactcatagggtgtacctctttctgttctctggatgaatttatgcgaagtttattatttcttcattaattgtttggaagattttactggtggacccatctggcctggggttttatttatggaaaagttttaattgaagatccattttttaatttggagatggggtcttgctcttttgcccaggctggagtgcagtggcgcgatcttggctcactgcaacctccacctccctggttcaagcgattctcctgcctcagcctctcgagtagctgggattacaggcacgtcccaccacactcagctaatttttgtatttttagtagagatgggatttcaccatgttggtcaggctggtctcgaactccttaccttgtgatccgcctgccttgggcctcccaaaatgctgggattacagacatgagccacggtacccggccgatccatttttttttttttaagtggaggaattttttaatttttagtgtcttttggtaaattatggttttcaaggaattggtttatttcatctggattttcaaatttgaggtaaagttgttaacgaccctttttattatcttttttgtgtcttggggcctatggtaatgcctccttatttctgatatttctgataccactaccaatgtcattaaaccttctaaaaacaactctcttggctttactccctccccccacacccctcccgccaacacacacacacacacacacacacacacacacacacacactctctctctctctctctctctctctctctctctctcgcgcacgcgcgcgcgctctctctctctctgttccttttgcttactttggatttggtttgctgttctttttctcatttcttgaaatggaaatttagataattgatttcagttgtcttttctaatatatacagttttatattgggaagtattaaattgaatggcaaaacattaaaacttacgatgtacagctcacatcacaacttaccttctatagaggtaagaggtaagttgaggtgtgtgtaaatgatcacaaacatgctgcttccaattattacatgtttatgtagagtcaggtaagtttttaggcaaaagtgttattttgaagtttttatactgttatttggggataagttcttattgtccagctattacagattagatattctatcgtaagtagtatagaaaagagcttctgtctgtctctcctttttcttctttctctgccattttagagaagtgaacaagtcgggggttttttctcccccaaataaatgtgtcagttttattccttttcctctctagttcccattttcgagacataaaatattaaagtgtatggtcacaggtcttggacagagttaagaccttcctgtgacataaatttgttagccagtattcaggtttttaaaagcgtagtcagaggtttgagttggatgctaaagatttctaattttacaccagaagctagtagttagagttccagtatctttccctcttcctttttcattttatacctgcattgtccatggaattctaaccttttttgcaatgtttctgacttgcatggctttagacaaaaatcaaacctttaatttaaccttactcttattttaaggtgtacttgatgatttttagagctcttgggtttgtgatattcaacctaatattctatgtctacattgtgttctttttcttctaaaaactttacatttttaaagatgactggtaatttaaaataacaaaggaatgaaacaaattacattatccctcactcttacattttgtttttctctactttttaatgttaggattttattttacaagatctgacacggttgtaccaagaagcagcaaccaaagtgttaatcactgttcaatttagggctcgctttttggatatgctttttatgtgctggcataaagggaatttctaaaatcagatttttcacttaattttttttaagcatgcctttaaaaaaaattctcttagagaattttaggctttagtatgtagtaaaactcgataaatgaaacagccttggcagagacaccgtgggatgaacactcttggatgtggttgctgggagggtgcaaattttctggaatgaaatttggcagtatttgtcagtggccttcaaagaaattgtttatactgttctagtaattatatatccaggatcctatcctaaggaaaagttgaagttcaacacaaaggtttatatatgagaacattaattacagctatgtttatgtttgttagcagtaaaaattaccaaatactaaacgtccccttaattttgtttaattcatgcaatattatctggccattaatatttttttaagattcttaatcaaaaaattgaatacctagatatattgaatggaaaaggacagagacttatgtataattccagttttattgaacatatatatggacagtttttatttactcttaaagattacaaggaaataaatatcggtggtgtttataggtgtggaattacaggtgttttaaattttattttttatattttctatgagcatgtgtaaactacctgtatatcagggggcaaggagttaaaaaataataaagcaggcttccaaagttacatacttcacatcagacatttttgttggacttgtaacacttgacttccgtgctgtagtttcctgtgccttgagaccagctctgtgagcacctgcacagttttactgtgttactgtgagcacctgcacagtgcaccatttagttactaattgaccatatgagttcatgtataaactttgtgagtaaaacatattaatgctggtaaactcatctgtcttcgtgcaagtgcttatttatgcaactctttattttacaactgttaaataggtgcttgaatgataaggcgaggggcccgtttctcttaaagggccatcagcctatagtgaatagaaaattcaagaacacatgaataaaaatcagtttaaaatttaggttagtttcattttgaaagagaaaataccacctgctttctgaattaagagtaaaggtcataaaagttcattcacttagttgtgaaaatattatgcactgttaaaacggggggagagaaagacatgctaaaaatgaggaatgaaagagaaaaatagccacgttagttgaaagtgatgttacttatttaagaaccataatcatgaacttctaaataattattgtttggataatggtttgggtgtagggaagttatggaataattacattttctcccttcaaataaaaaacagaagttataaattactttataatgtataaaatgtgatgtatcatatttgtggaataatttctgtcatggcttatataatgggaaatgtaagcagagaggcagtacacattatgattaagaacacaaactatttagactttgatagaaatcctgagtatagaatttgagctgtgtgatcttgggctacttactttctgagttttttttcatctattaaatggcagtaacatatttcattaggttgttgaggattagatgaaattattttaaagcacagtagtacagagatggcctgaaacatcataaactttcaattattttatcttttgtaaaaatttacaatgcagttgtcccttagtattcatggaggattggttccaagacctcttaccacttggatagcaaaattggtgtatgctcaagtccctgatataaaatggtttagtatttgaatataactcatgcacatctttctgtatatacttcacatcatctctagattacttatgatgcctaatacagtgtagatgctatataaatcattattatgctatattgtttggggaataatgacaagcaaaaaagtttgtacatattcagcacataggcaattttttctgaatattttcgatccaaggttgttggttgactttgcagatgcagaacccatggatatgtagggctatttacaaaatttttaaatctgcaatgcttgtctatgttggtgtttggattactattttacatatgttatagaaacttaaatgtggaatgtttaatttttaattaagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggtgagttggtgtgtaacacccaagaaagagagcagacaggaaagtaaccccactgcctccttaatagtctttatagcttcgtcactgccaagtgctttataacccatgattcttaatagatttaataaatgaaagggagtgacagtgttagtaaaaatttcacattaatgatgatgaccctagttgggttgtttccgaagtaaaattgtatgttcagtttccctcttggagagtttatgaagtttttttctcattggtctcttggttgctggatgactttcataatttttgggatggcctgaggtaaatcaggtcatgaggacattgagttcctcagagcctgatcctagtgaactcttgactagtttgagctatttaaccatcctagatgtttcctttttttggtcttcatctcagggaacagttcagaatataatttttcacacttatagtacaaacaaccaccctatcccaccccacacactttgattatttagaggaaacctccaagagagtgaagctttaagcttttgtgcagaggaagaaaaagatttcaagaggctagggaagagcacatcaaggaatcccatgtgactgtgatcttcaccagactgtgggctcaacaagtgagtgctaggaaggtgcgacacatttccccctcactccccaaaaggaaagtaatgaaaacacatgttcttaaaggcacttgctttactgagtttttttttaaatttcattttctaaaaataagtcaacactattaaatgcataatgtgaggggaaatagaaatcctttgcattaaaaaaagaaatctaaatacataaataatgagtatgcgttaacagaaatattttgtgtaggtaaatttctctgtaatttcccccttacatacacatattcctgccaaaaattactgttaacaatcaatacattcttcagattacctttgtgtttactatcatatatgaattgatttttctataaatagaggattcttactataattttgtaacttgctttcatttatcttgaatatttttcctattaataaattccattgtttttaattatatatttataagaatacattgtgtgattctggcaggtgcctatagtaatggtatataataaattatatttaatagtggtccctgaccattctctatagcagtgataccatagcagaaggttgtattgtttgttgcttttccatacttgtctggtggttggtgattggtaataaaatacttcttaggctaaagttgcatattattagcaagttctcaggggggagaaaaatacaaatgattttttttttctttttttctttttttttttgttttttgttttttgttttttttgagatggagtctcgctctgtcaccaggctggagtgcagtggtgtgatctcggctcactgcaaccttcgcctcctgggttcaagcgattctcctgcctcagcctcccgagtagctaggactacaggcacgtgccaccatacccagctaatttttgtgttagtagagatggggtttcaccatgttggccaggatggtcttgatctcttttcttttctttttcttttttttttccttttgagacggtgtctcactctgttgcccaggctgtagtgcagtagcacaatcttggctcactgcaacctccgcctcccaggttcaagcgattctcctgcctcagcctcccgagtagctgagattacaggcatgtgccatcacacctggctaatttttgtatttttagtagagacgtcatttcaccatgttggccaggctggtctcgaacgcctgatgtcaggtgatcctcctgcctcggcctcccaaagtgctgggattagaggcgtgagccactgctcccgggcaaccctgtctcttaccaaaaaaaaaaaggggggtggcggggcaatgaagaggtttatcataatgtctcctttgatctgaatcctgaaagagcacttccctatgaattttaacaaaaatatccatgatacctaattagttaatatttgattgttataatagttttatatcctaagttatcaagataatttagttttcttccctctcttattgctgtatcttttgacagtacctgtaaaaatttgtagagacatcaggtggtgcttagtcccacaaagcagataatctgccaaccttgtcttaatattttaatgttattttaatattaatattaaatattttcatagcaagataattataattagtagctcatttgtagtgcctcttttagtgtacaaccattaagcatgtttttgtttggtaaaacttttaggcctcgatgggtggttccagttttgccgaaaggggaattagaagtgcttttagaagctgctattgatcttagtaaaaagggtaagttatatgtttttatgcttcctataatgtatgctactagatgtatttttactttatcccaaaagcggatgaagtggatttgttttcctccatcataaacacatactgcagcttgcaaggaggggctcatatcctttggacattcttaaaggatgtttgtgaactctctgaggtcacataaaatttatatttgtatttctacggagtggattcattgtttcgtcagatttgcaaagaggttgtcactcagaggttaaacatttttaattgagggtcttatctgttatgggaaatactatacaaaagaacattttacaattaagtactctataaatgatggatggtatgatggactccagacatatctgccccctgccctccttgtaattatcttgagtcatttctgtcctcaaaatattactatgtaagtctacaaattatttacacttgacctttgactgctttactgaaatgacagtgaattaggatgtgtggctctttgtactcagtaaaattttacctagtaaaatcttcattcataatccttcaggtaaaaattaccatttcattaatattgtacttctgaaataaactgtctcgcttacatatttgtaagatagggtcttgctttgtcacccaggctggagtgtggcgatgtgatcatggctcactgcagtctctacctcctatgttcaagcaatcattctgcctcagcctcttgagtgggatacaggcatgcgccaccatgcccactaatttttttttttttttttttttttttgagatggaatttcactcttgttgcccaggctggagtgcagtggcgtgatcttggctcactgcaacctccacctccccggttcaagcgattctcctgcctcagcctcccgagtagctgggattacaggcgcccaccaccatgcccggctaatttttgtattcttagtaaagacggggtttcaccatgttggccaggctagtctcgaactcctgacctcaggtgatccacccgccttggcctcccaaagtgctgggattataggcatgagccaccgcgcccagctaatcttttttctttctttctttcttttttttttgtagagacagactggttccccaggctggtcttgaactcctgggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataactttcaattcattttttaagatattgcagattaaaaagcagtaacatttcattttctgaaataggatagctatggatgtgttataactaacagtaggcactatcacaattgaaactgattattgtcaaaattaacatgtttagtactttaagttcaactccatggcaagggaaagtttgatttatcttttaataattcccctcttttgtttaaagaacgtgtccttatgcctcattaatcttgtagaaataatatcccaaagtgaaaatacaatacgcggacaggttacagttgttttcaccactcagaattttttgttcttttatacgttcactaattcatcaaaattttttaaagaaaatatctttttttattttaaaaatgttgaatttttatgggtatatagtaggtgtatatattttggggtaatgagatattttgatacaggcatacaatgcgtaataatcacatcagggtagatagagtatccattacctcaagcatttatcctttgtgtttcaaacaatccagttttactctcttagttattttaaaatgtacaattaaattattttttactgtactcaccgttttgtgctatcaagtaactaggtcttattctaatttttgtacccattaaccatcccgctattctttacgtccgtgagttcaattgtttgatttttagatcctgcaaatgagtgagcacatgtgatgtttgtctttctgtgcttggcttatttcacttaccatggtgaccttttgttccatccatgttgttggaaatgacaggatctcatttgtttttaatggctaaataatactccattgtgtatatgtaccacatttcctttatccatttatcagttaacacgtaagttggttcaaaatcttggctattgtgaacagtgctgcatcaaacatagtagtgcagatatcgcttcaatatactgattttctttcttttgggcatatcagcaaattttggaagacttctttgctaagcatgttctaagtcctgactgtaaaatgatggataaacactgattaatggtatttcatttaatagcattgacattcagtggacatgtattcctccctccaccatattttttttctgagaccacggttattttcaacaagttccaaatttttaaaagtttaaattaccatctcttttgtactatcaatcaaataatactttctgtacaaattgaatagtttttatttggtcattaagagttacagattttctttgtttggaagcacattgctctgttgcctttctaaaatgaggtgaaattaagcaaagatataaagaaacagagacactgagataattgagagaggctaataaggaagacaagacataattcattttatttgatcaaacacagaatagtataaggatattgatgctaaatgaatgatttatgaacaaaataagattttaaaaattgggaaatgcttttaaggtcaaagacttattttcagggagcaaaatactatttaaatttgcctcttcttgtggtgctgctgatcaccattttgtgtttaaggctagtgccataatttgtaacattttcagttagtgttaatattactcggttaatctacttttatgcaattaaatatttgttagctgtcggtgaagtttccagttatttattaccttttattgtatattggacaatgtaaaaacaaccagatgaacattttgtttgcattaatttttctccctttttcttaggccttgatgttaaaagtgaagcatgtcagcgatttttccgtgatgggctaacaatatcattcactaaaattcttacagatgaagcagtgagtggctggaagtttgaaattcatgtgagtcttgcatttgactttaaaggatcagatttacatagtgatgcctgtgagtgggaagaggtatatgtgtgtgtggctgtgttatatttattctgttataattgaattaaaaggtctaaaaatgaaaaacttaaaaatgtttataaattaagtctcttgaaggccgcatggtcatttagaataagcatgagatttagagttaagcttgggtttaatctctcctctgggatctcaagtgtctgtgaccttaggcaagtcatcacatttcattgaaaatgtaatgctatcaattgtaaggtacatcactgttttatggactattaaggaagaaaaacacccaagatggggcatttcatatacgtctgggacaccaaagggtcagtatagaggtaaatgagaaatgaacttgctatgcagaaagggacagcaaaaaatcctgcatatctcaaccttggcacttggtggagggagggattaaaaaaaaaagtgaaaatctaaaccacaagccagtatttaaacagtttcgtagtctgaattcaaattatagttgcaatacaaaaagcccttaagtggaaaatgtaaagtggtctcatgtcggtagtgcccccaagtgactagcagaagcaaacacaattcctctctgcaaataccttccatttaggaaaacagtaatgtattgttcattgattataagatagagtcagattccagagatcttaaaaagtgaaaaaagtatatgtctcagactgataaaatgccataactactctaagtctctgttgcttttgttttttgtgtgtccccccgcaagacggagtctcactctgtctcccaggctggagtgtagtggtgcgatctcagctcactgcaacctccgcctcccaggttgaagtgattcttctgcctcagcctcccgagtagctgggactacaggcgtgcgccaccacgcctggctaatttttgtatttttaggagagatggggtttcaccatgttggccaggctggtctcgaactcctgtcctcaagtgatccgcctgcctcagcctcccaaagtgctgggattacaggtgtgagcccccatgcccggcctctgttcttttgtatactatggaaatggtcataagttgtcaagcagataatatttttgtggcctataacctatttcccaaatatgaccatagcataaaaattccacattttctgatttaacatgtaattgtataggtgtagaaatggaaactttggaagtggcgtcagacttctgcatttgacatttagctagcaaatttatcttggatgattgacatattgtttattttatttatttttattttttgagacagagtcttgctctgttgcccaggctggagtgcagtggcgccatcttggcttccttggagcctctgcctcctgggttcgagctattctcatgcctcagcctcccgagtagctgggactacaggcacatgccagcacacgtggctaatttttgtatttttagtagagacagggtttcaccctgttggccaggctgatctcaaactcctggcctcaagtgatccgctttcctcagcctcccaaagtgttgggattaacaggcgtgagccactgtgctcagcctgacatactgtttagactctagaattgctgcctctcgtgtacaaattccacagagaaaaaatagtaacttgcatcttacctgtggacgtagagcaggaatagatatcttatggtgcctcttgtattttttaagccatagcaaatggcttttgaaagtaccatataaattatgaagtaaacaaattctaatttgtcctttgataatcagtttgatcccaatattaatgattagaaaaatggagagatcgttatttgttaggatacgattaatattggaagatatttctgtttgaaattgcagtgttttgatcttgtaaatcgcctttcccccttgtataacagaggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaaggtgtgttggtttgttattttcaaaattaaataatacaattgttttgttctgacacagaatcttcagtgatctgtatttaaagtgtgacaatgaaataacactttaaatgaaaatacacacaaccaggagcctttttcgtagctttgtcgttctagttctttgttttttctgcatgtataattatccccattgtcttctgtccagcctctttagaagtagtcataatttgggttagtaggaaacagactgtattttttctttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactgtacactttaaaaaatttttccctaaacgctgcttcttttaataaatattatataattttaaaattttagattttagggagacatttttaatattataggtcttgtacaaatttccctttttctatccagccagaaagattttaagtcatacattatggagaacttggtttattttactaataagctgaagttatcaaaaaaaggtcaaacttaagttgagattttctgatatttcctagttcatatagttgccactagatggcttatttttgcttgagtagatcaggttactatctaaataatggcagtcttcaaaatgaaaattttaatctatacctgtatttctttttaaattttactttttttttttctctatgtgccagtaatccacaacttaagagattcacagggcacaaaacttgatttaacatggctaaatgtaaaatttttagatgacttctggttgaagatagttttatatctttgaaatatagttcttgctattaaacttataaagtgtagcgattgtgagagtgttagcctttcaaagccttcaagagtacaatttttaaaaatatagcccaaaatatagttgcgaatcaaggagaagcatattctatggagttaccttcacatttacttgctattgaagtaagagaaattttatcatacagctaaacaggtcttctataagcttttaaaaatctgattaaaaggggacatgtttggcagcatcttcaaccatgtcctagttgaatgcagatgtcatgatataatgaaaaatctaagagatatgtaatagcctccatatgtttttttctcctgttctccaaaagtggtagtggcaaaattcagatcatcagacttagtcgatggagataaactttctaagctgtagattcactttcggatactgtttgtaatgagtttcatttacctttgagaaatttgagttacagagcttaaaagtgttttattcggaatatttttgagccttaatacttaatcattctctggagcttttggtaggtcttctgttctacttcaaattctctctacacctcctaccctcctgggacattgaacctctgtggcctcaacttttgacccatgacaaagctaaagctgtcaggactatctctcagagtgtttcctaatccccatcttcccccaagatgtttgaagatgtttaaatgagatcatttattcaaacatttaaaatataataaaaacttcattggttacgacaaaaggtcttaggtgaaattcaccatgctatctttgagaaaaggaacttgtagcaatagaaaactatgtggaaagcatatggtgaattgtaagctatgtggtcattttgaattttctatttagggcgactgatctttctctgccagtcttgaaaacttagagccagagaaggaaagctgttgttggcagctgctgaagctagcctattagcctcagtttgaagcactcttatctgaatattcccaattgtttaagcatacattgcagccaaagaaatacagaaagattagctttagactaattctttactgtgtccacacctgctgttttataaatattgtatgtaactatcaagtatatcaatctaatagtctcattatagttactgaagaaataaaatatattacataatgagcatgtactttcttacaattgctgaatgacaaaagggatctggtgaattaagtactcgagttttaatggttttgaattagcctttcatgactaaaaaggtaggaaaacactattaaattgaaatacgttaatgggtttattagagaaacttagttcattcatattcttttaaaaccatataaaaactagcagtaggccaggcaaggtggctcacgcctgtaatcctagcactttgggaggccaagacgggtggatcacctgaagtcaggagttcaagaccagcttggccaacatggtgaaaccccatctctactaaaaatacaaaaattagccgggtgtggtggtgtgtgcctataatcacagctacttgagaggctgaagcaggagaatcctgcttgaaccctggaggcagaggttgcagtgagccgataatcacaccattgcactctgggcgacgagagtaaaactccatctcaaaacaaaaaaacacacagaaaaaactagcattagctatcatattttctctttaaacaaacattgaacatacagccatttagcatctttactttttcctgtattttttttttaaatagctgtagaaattatttttgcttaaggcttagaagagaaattgtgtattttgctccttgttttccagtggcttctaaaacatggcctaaattttagaaggtggcaaggtgtgaaaggttttcttaggtacattaatttctacatatatttgattcttatatttatatagccttttaattcattttaggtttttacatacagacaggcttttagcctcacaactgttgtctgtgccagctgtatggtactttgagctacagctctttcttagacagttcatcctgttgcatggtgttacttctaagataaggagaactgggtgcaatttgtataagcaaaagtatcaaccagcatattctacttaggaacagtagatactagtaccagaccttagtttttaattgacaattgactctcaggctattagttactgtgtttatagggaaattttaatgttttacaactaaacaagaagtagattcaaaattcattaccaagtagcttcttcttaactctcttgaagtctttctgcctcctgaaaattattttaatataaaagactttacagtaattagaaggtattcattcttatatggtgggatatctgaaataggagcatgtcttctaattcctgttcaccacttacattggtacaaacagacagaactatgccccagtgatttaatctatacttactacgtatactgcttctgtctcacagatggaattactatgaacaaaatgcaatgttttgtggtcctttgaaagatgatttattttattgaatttactatttctagtatatttcaataaggcttttttttcgtgctttttaccctttaaagtaggaagttaacttttttcattaattgtgttacagggttggctagtggatcttctcaacaaatttggcactttaaatgggttccagattttgcatgatcgttttattaatggatcagcattaaacgttcaaataattgcagcccttattaagtaagttacatttaaaaatcaatggttagtgcaccgtagaattgctggtttttgcttcataaaaattgagtttttcaagtgtggtttcttcaactaataactgggattttttaaaagtaatataaagaatttagtcctaaattgattttaagaaattgcgtatttacaggagttttgtatctttcttatttcagaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttaggtaagatacttacctcttgaaataattgttaatgccgattttagaatcatacttatcactgaatttttcttacagattattgcaaatttcttctttcaatggaaagatgaatgcactgaatgaagttaataaggtgatatctagtgtatcatactatactcatcgacatggtaatcctgaggaggaagagtggctcacagctgaacgaatggcagtgagtctttcagttcttcttcataggaataagaatctacttaagacaagaaattagaatagctctagctaaaaaaattagtaatagtaacattttaaagtaaactgaaattgggaggtgttttgattgatttataactctgttaatcctgagaactttttgaaataacatagtttattatttggtagtgatatgggtagctttaaaacatctttgataaacttagtgatgaatgtggcgttttgaagtaattattagtttgttggagagtgggaagttggttgaaatggagtaggtagagttgatctagaaaatggattgggtagtatctagtaccttataaagtggcctattgttcatttgaccatttacagttaaacgttttaaaacaggaaataaaattactagaataagatctatacaaattgttttatcacgattttgagaattttattttgaaagcccttattttgacattgaaattttatgaaactttatgtaccatagctattttgtattatattgttttgaaatgagtaagtatgccatttaagttacagtgccaatattttttgaatgtatatgtgtaacagtcctggggaaacatctgtaggagaactgtccttgccctcaaggagccctcacttaataggggagttagtgattagagtatgttaaaatgcatgtggagactgcttagatattgccctgtgttagggggtcaggtggtagacatctggtttcatacatatgatgtacgtatctgcctcatggaaagtccagcacagagctattcaaagtgtgctctgaagactggtgctggttcttgaaccagtcctagataggacagagaatggcattaagtgtttagaaactttcattgcagtttgacattgcgacatttttattgtgttttacaaaattatctgtggctctgcagtggctcacgcatgtaatcccagcactttgggaggccgaggagagattgcttgaggccaggagtttaagaccagcctgggcaacaaagcgagaccctgtctccatattaaaaacatatgtgtatatatgtagaataacataaaaacaaatatctgcaacagattagacattaaaaactggctcattatcagctgagacatgtacttctctagcacattttgggcctaactactttttattctcagctaaatactgcaaaatcatatagtgtggattactccctgtttgtatcatgagttagcactttattctgttgctatagattaaatgaatgctagttgagcaagctagcacagtgttacagaaaaacagactgtggaagcatatgacttgattcatattccaattctagcatctgtgagcctgtttacattttgtaatagaataatgtatctcttactaggattgtttggaaaattaaagagataatggataagcaataatagtgcctagcacatgataattgttaataaataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaactacaactccttctattatcttaatgacagttttctaatcgtggatttcttgggaagcattattgagttgtagattataaagctttgtttttttagtctataaaaaccaagaaaacagctttgcctttgagtgcttaaggttccagttttgaaacaatattgttagtgtgccttatttttgtatttgcaatattaaaattgtcaaattaaataaattgtattaaaggtttgtatgaaccgccaaaatacacattagctgtatttattatatcatgaaattaagttgccaggttttagatggcagttctaaagcattttataatgttagaattttttttttttttttttgagatggagttttgttctgttgcccaggctggagtacagtggctcgataccggctcactgcaaccttggcctcctgggttcaagtgattctcctgcctcagcctcccgagtaggtgggattataggcatttgccactgtgcgggctgtgttaggaattttcttgtgttacatagttaaatgaaggagataggagtactttattaattgtcagcaagcagtatacactacttaatctattactcagattcttgtgcattgtgatttcgtttttgtttttcaataggcagggaaacatgaagccattgtgaagaatgtacatgatctcctggcaaaattggcatgggatttttctcctgaacaacttgatcatctttttgattgttttaaggtaattgttaacatagcaaaatattaccattctatttcaaatagaattgattaattagatctgtgaattacttttagccaataaatacttaaatagaaatcccattaaacagtctgtggtgtgaaggaattggcccattgttttcttttccaacaagaacttgatgttcattttcttaatagcccccataatggaaactcaggctatcactttttctttctttcccctggtagtttctattttagttacaggttcaagcaaattgtaggactacagggaaggatgattggctacaataaacagtaagatgaaagcaagagaataccaatatcttggtattctggggtcatatgtacaagcaaaatatgagttaatcaaaatgtaactgataaggtagcccaagaactcctcctacagtcatatctgcattgatgccatcatgttggtttttgaggccatgttttgtaacatctttgattagttgccagggttaggtttgtgaaagctcaagtggttagtgaatttgtggattaagaacgtaactttttggcagtttgcactaagaggtgttctgttaacaactggcattagatcaataggtcaccaacgtttcttgttaaaaataataattatactgaccagtgggaacataaattgctatagccactttggaaaatacttggtatttctggtaaagtttaagattctcataactcatcagtttgacttctgaatatacacttgagaaactcatgcttatgtacaccaggatacgtgttcagcaacacttgttagcagaattacttgtaatagtgaaaaaacctgctatgtaggatagataaaacatagaatagataaattatggaatgttcatacagtgcaatatttcacggcaatgaaagagcaactcaaccatatggatgagtctaataaacagaaggttgaagaaaggaataaagccacacagtaattaatacaccttgattacattaatgtaaagttccgaaatgggcacagctggtttctgggatgttacttgccgtgtattattttttacctgggtactagttacacaggtgttcacattgtgtactgtaataatggtatatgcttgtacttttctagatatttcacagtagaagaaaaaaataccatttttactggcttccatcacagacatgttagatcagtaggtactgaagcccaagagtctgtattttaagcaagtttcacagataagtcttagggacattaaagctttgatttatggaaaaatcgctgccttatggaaaattttattttgaagggaacaaattattgagtgaatcttttatgtggtttttatatattttgtttctatacatgtaaaagcaaaacttaaatactttttccatccattgaagtatatcaaaggcagctgaggaaataatagaattggtcatcatgggcactgcaaagataaagacttccgaaatgatgatacgtgaccagtgatgcctttgatgagagaaggaaaaaaaggggttgttattatatctgctgtatcccccctcttctcaggatagtctaaatacaataatggtctgaatataataataattcttcatgttcttccccctttggcttaacatatgtttattgagcacttgtcatttggtaacaagcactttttttccaaggtgttggtaaatctggcaattcttatggagtgttgaaagtttctgctaaagatgattttgaaaggaagcaatgaagtctgagtcaccttgtggttctttgcagattgcaaccaaatgattccaaccttctgggttagactttgctttatgtacttggcctagagcctagtttttaaacatttgagttctaagtaagtttcatatctttgccagcacttgttcttgtcagagttctgaatttttgacaatcttcttggtgtttgaaatgttacctcattgtgcttgtgcttttagtttttatatcccttgatcaataatgagattgagtatctttctgtatattttttgagctatttgccttttttttttttttttttttggtgaatgcctgttccccccctccccccaccgtggcattatttgtatattttttggattgtagttcttgatatattttgaatgctaatccttgtcagttcaagagttacaaataatttctcccaatttggttatctttttcattcacttaatggttgtactggttgaatagatgttcttaatttctccttttcatgtagtttgtatgtctaaaagatgagtacatgaaaaaattcacgataccattatctacctaaaaaacaataattccttaatatcataaaatagttttaaaacttccagttgtcttagatcatacatcttcattttagaagtgagttttaatcaggatcctggtgcagtccatgtgtatgtcttttaagtctctttgaaactagctttcttcttttttacttcccttgcaatttatttgttgaagaaactggattgtttgttgccttggtgtctgtcaatagttttgatacagaaggttttttttttttttaattttactagagcatatctcaagtggtggtgtgcttttccttgaggaggaatacctagttgtctctctttttataatgttagctagaggtttttaattgtaatctgatattttagtcttacatttttagcagttgtcatattccttttgttattttgtgtaggctggaaggaaataaaaacaggcattcacatcatctttgaagacgtaccatattaataattccattgaactaatcttctctcattaacttaatcgttgttttttttttttttttttttggagacagagtctcactctgtcacccagactggagtgcagtggcgcgatcccagctcactgcatcctccacttcctggattcaagcaattctcctgcctcagcctcccaagtagctgggattacaggcatgcgccaccacgcccagctaattttgtatatttagtagagatggggtttcaccatgttagccaggctgatcttgaactcccgacctcaggtaatctacctgcctgggtctcccaaagtgctgggattataggcgtgagccaccgtgcccggtcagcttaatcgttcttctgctgtttgacgttaagttcgtttcagtttattttctaataaacactgatcagcaacttagtgcatttgctgctgctataacagaacaccacagactgggtaatttataaagaacagaattttatttggcttatgattctggaggttgggaagtacaagaggcatggtgccagcttaaccgtgagttttgggggggacattcgaaccatagcagtaactttactcataaaacttttcccatattgcttagcagcatccctggtctctactcactaaatgccattagtaccctgcccttccccaagcatgataaccatgttgtattacaataccattttagaggttttaaaaaaatgtattttagagtttttaattgggtgtcttctaaattgaaatagtgtatcatttatttttcttttttggaatttaactctaccctataaaaaaaataccaggctaactatattttcagatctcacttgaatcattctgtgcttagctacgttgcttttgatgaatttgaatatagttaacctggtgacaatttatgaagtggtgactaaatatgtgttgttttcatgtcacttaatttttttctaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttccggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaaatcacacagtttccctacattctaatttgtggcatgtgtattttttaacacatggtaaagtgaacattgctgagtaatttctcacatgttaataaaactatttgttacactgatgaactggtatttaggtaagagccaagaaaagctcaggaaggtgtattaatgtagatactactcaggttttgactatgtttacttgtgacagttcggtaagtatttattcagcaaattaaatagtaataagggccttgagtataaattatttcattaaaccaagggtccttctgaggagtcttgaaatcagagcagtacatttgctatcagggcttttaactagtaacttcttttttaaatatctattagtatcagtgcctggcatagtgatgtacacattcattcatgaatagttactgagtttcactgaatttagtagactgttgccttttttcaacttcaactttcatttattgtttgggaaaaaatttttaaaagtcattttccaactgtcaccttttcccttctgcttgccaaaactgttgtcaaagtgtacatttgatcataaatgttttcatggccttaaaaatgtacacactattaaacccaacaattctacttagagaaatttcttctcggaaatagtgaaaaaggatacaaagaggtacccacaaggacattcattagtgtttatggacatgaacatgtggaagcctcctgaataattactttttttttttgagacggagtcttgttctgtcgcccaggctggagtacagtggcgcaatctcggctcactgcaacctccgcctcccaggttcaagcgattctcctgcctcggcctccccagtagctgggattacagacacgtgccaccacacccagctaattgttttgtacttttagtagagactgggtttcaccatgttggccaggctggtctcgaactcctgacctcaagtgatccacccgcctcggcctcccaaagtggtgggattacaggcatgagccacagctcccagctgtgaataattactaatagtttatacaaggttcgattatggcgccattaaaaggattaatatcacttaagagtatgattctaattttgctgccgaaaaaggaatatctgtgtattacaaaataaccccaaacttgaggggtttcaggaaaaaaaaaaaacaaaaaactccacaaaattgttttcctttccctgtacgcaaaagtaaaacaatccgagcttacgaaattgttaggcacacaaacttgcagttctgattactattgactttaggggaagaggtgaagtaactgaggtttgagaagtaaaataccataattgaaataattttgagtttataacatttttaatttttaagtttatatctgcctctgtcctttttctctccttgtacgtgtgtttctttattttgattttggcgattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttggagttctggtagtaagtgtgaaataaaaacaaacttaaagcttttattatttaaattaaactctttactgtaattacaacatgatgcttgtattgctaatcttaaaagaaaagcttttattttataattctcaaaataatttgaaaataaaattctcctgagtattgatctatttaaaacattgaaatcatttgtttaaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgaggtaagactttttaacatagaaaatttcaatacttaaaatttatgtactttattgaaaagaaacagcatattggctggcaaatgcaaatttttaaattagtggagtgagaagaggctatataagaagtgtttggaacaaaagaattctttattacatctacctccttttttttattaatgaggaagtaagccacagttaagtgataaatcagaatcaaggtaatattgcctttgggttcttggttcagaattattattatatacatactatatttccagcaagtatgccaagaagtttcatagcatgtctttaaagatggattagaccacaagaacatttaaattgatgaaacatgacaagataaagtttcataatttttaaacatttattttagctaaatttctttttaatagctgtctttatactatcttaggtgtcatattctggttactgaaataatttgtcctattttctggtaatacagttggaactgataacatgaaaaggaaaaataatgtgaagagaaagagagcagggtgcagtagaaggaatattcacagtggagtcaggattcctaggtgtgaatcttgtgtcaaaccagtaatttaatcttgtaaaaattctgtaaagaatcatgtttggcctggtgcggtggctcacgcctataatcccagaactttgggaggccgaggagggcggatcacctgaggccaggagttcgagaccagcctggccaacatggcgaaaccccgtctctactgaaaatacaaaaattagccgggcgtggtggcatgcgcctgtagtcccagttactcgggaagctgaggcactagaatcgcttgagcccgggaggcagaggttgcggtgagctgagattgcagcactgcattccagcttgagcaacagagtgagactgtctcaaaacaaaaacaaaacaaaaccaaaaaacatgttttctttatatgtaagattaaatgattgccaggatcctttacagctctagattactatgattatacctcagacagaaatagaaaaggtcatgtatatgtctttatttaaacagttgaactttgtctcacttttttccctaaggctagaaaaaattagcaaattggaaaagctatagagataaacactgtaagaaattgagacatatatctcgttaacaataatatttgaggagcatattttgagtatgtttggctcatcgtacatatttcggcctttctcaaatgaatgcatttatctttcgaagtagacacagtagttcacatactctcccaagaacagtggccttgtctcccctaaaatagtagtagtggatgtgaaagttgattggtttcagtgaaggtagcaaaacagattagggtttcaatgaagatagcaaaacagatgagtctttgtggtgacacctgtgggcaaacttggctacaaacagagtgtcccaggatgttttcttaaatagctaataagaagaaaatgctaagagcattttctttgattgaattcttccttacaactgtagcataatctttgtgatgctagtcttgcaaaaaatgtttctattttataattttgggaataattacataacataagtgctttggtacagttatagtatagacattagtcattgaggtatactcccatttggtgaagttggagaatagtgatggatgctttttgtgtaaaataataatgtaataaatgtcttatcttttgaagagtttaagttggttgtgatattttcattaaaagaagtaaatgtacaaaagtataatttttaagtttttacatcagtagctaagaatttagatagtacgaactcttctggttacaacagagtttaattgcctaattatattgttaagttcttctcgtttcagtcaaactcagcgaagtccccatgtgttttatcgccatgacttaatcaatcaacttcaacacaatcatgccctagttactttggtagcagaaaaccttgcaacttacatggaaagcatgagactatatgctagaggtatgtattgtaagctaaaataaactatgggaaatagcagggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcattttcaacctttatgtcctttaccaccacctttagctttttaaaaggaaacttgttttgtctaagtctgttcttactttatagttcttttataatgccaagcctatgttttgtaagtgcttcaagactccatgaatttaaaaaacataagagtagagatgagaggctggctgtaagaatctagatgtttacattggcattcaaagtgtgaaattgtttgaacatgtttaggataaagtttcctgtgatttcaacagatcctgattgtaagtcttagcctgccatgtgtggagccctgtgtcagtgctcttttgccctttgacagttatgtcagtctgtgtgtgcaagagtagggatggcttctcagtatatactgttcctcttctgtcttatgacaaattcatacccctttccccactgatactttgttgtttcaagtttgtttcccgagcagtatgtaagaaaatactgtattacgaatgttagttatagagttaaacatactgattactcaacttaccattcatttaacatgttatgtaggatctgcagaagcccatagtgtatgttaaaaatgagaatatttataatactcattatttgaggagtaggcttttgacattattgaataaaatcccctcgtgcttaagaattaccagatttttgcttaatacttatgtacatttcccaatgaaattcagataaacataaaaattaagtaactcttctgatactcccagtgatagtgttgactctttattcttccatttatcccctcggggccaatagattgttagagctagacaagcaatctaaatgttaggcagctgatgaggaacagacagtgatcttagcattttagtcttaggttccttctaagcagtgtaatagaatgatcaaggcaatacaaccatgtgatttatgttctataccaaaggtactcaaaatcagtgacataaaaaagaggtttatgtgtagtatacccaagcatttgggtttagtatattatgattataatctcttcctggtggtacacagccctcatggttgccaaggagggccttcccccagagtggagacatataattcatatgtgctttaatgctaatttttatttacttcatttgcatgtggtgtttaatttcattgtcagaggtcaggaacccggctgtctcactagggttttttctgctacattttagtacaattctacttgagttaccgcctcatctcaacttcgttatcacaggaatgattacattcttcagtttttcctccttatgttgtctgtatatctgcaaactgagagatgtgagtctgcatagttgcctaggtctgaaacatgacccaaacatattagctgtatgactgtgggcaggttatttatgctagaataatgtctggcacatagtaaattcccctctgaattttaacatcatacctttttttcctcctaaccttggtaccttttcttcttccaatttattacactactcttgattaatactgatgagtctggagatagttaaatatgggggtgggggcaaataatttttaaaaccagtaaaattcttctattaaactttttacaacgttaaatcacttctgtggtaacatccactaacatttctaaatttgcaattctaaagttaattatggtttttgcctctataataaaagtgatagacaaatcccattagctatgaggcattaggttacttggcatgataacatcaggctttcacagtttactgatattctcaatttctgataaccattttaccaatggtttgtgctgcctgtattttatcttcactagcatctttagcttttgggggaaaaacatttcctcagtaagcatgatcagctgattttacctcctataaacattatttagataaaagaatgaacttagtaaaattctctacagtatttactcatgttctcactacaagtgttttcatacactggtacttaaattattctttaaaagtttttcatatgcatacaatgaagtataaaccaccttttagttttcactcaagttttaactcattggtagaatagtcattctactgacttcaatacttaccgaaagtttaatttaccattttttcttgtttctggatagagttggatgacccaacttcactgtaggtcagatttttccactctgtttacttaggatgctaccttctgttacttcttcccggtcttttccatccaacagtaacagtttttaggaacgttttccacacaaaaagattgctttatgagtgtcattcaccaacagtgctatgttagggtgcagatcctgtgctagattttctcaggactcattccttacatcaactatgaagtactattaagtctgtgtgacttctctgtggtttaaaaataattacatactatccattttgtgaacaatttgtaccttcttggagaaacggctgtttccaggcgtggaacagggaaagtaccacatgatccttgaccatcctattccagaaagtaagaaagtgctcaacgatcatgttgacatgtcaaaaggacacaggagttggctttcactggccataattaggtcaaaattagtaatgaaaataaaatatgaaaatactcatgtagacaaaaatgccaactaacaaatgaagagtatatgatgaaaataaacccaagggggtgaggattttcacgtctggaatggcagaataaaatgttcagcagaccttaacaaaacaaccatttaaccggagaaaaatataaacaatagtcatttagagtacctgaaaattgtcctaagagggagtatagcaaatgggaaaacactcaagaaaatctattaaatctgcaaaacagcaagagtctgtagcatttgagccacagcttgttctgttctcccatgttcagatccagctttcttgtgtggaaactctactccaggcaggtgtgactaagaagcaggggctccttccctgaggctgccagtctagggctgtagtttgaccacatgaggtggtgtgggctactggcatttctgatccttttcagtcgtatgtggcagaagctctgttccaggcagtcatgtccaagaaaactgagactcccttaccccattcagtgcctgcttgtaggataaatgctttacttaaggcatggcaggctgagaatattgggctctgattatccccaacctggcttgctcacagggtggacattatatgtcagggagtgcaatctgaaaaaatcagagtttgatcccacacacccaacaccagcacctgctcttaaggcagggatataattttgggagaagttagctgctgtcctccctctatctcctgaacagtaacatagatgttctgtccagatggagagagaaggtgtgaggatgctgtgctcagcagttgtgcttgaagggaccaactttctttggaccagaccgtgctgtgcctaagggtattatcacaaatggagatttgggtgatgaagaattaggagagtgcttgtggctcccttatactggtatcagcaagtcacaggatgagcaaccagaaatttaacagaaagatctagataaagagatggccaagacaagctctcttgtgatcacagtcaaccctgggggtcaggaatgctacgtgtatgcattaggcttcacctaagcagaaacaatcagaactggacacgggacaaattgaaaacattccccaagcttcatgtcaatccgtcagcaaagggtgaaagcctcaccagtacagtggacttaaatacagctctgaccaaacaaagcattgggtgaataataagctaccccgactcaggggcaactcttaggaagccagacatgaaaattacatgtatccctggcagtctggaagacttgctgcatccttgctggagtgattgagaagggaacaagcaagctgctagtctccgaatgagcataggacaaaaacataaactttctgagtggtgtgatagcagcctccaagccacacagacatgcagtggtaaagggtaaaaatctactagtcaaggaggcttaaacacagcgtttggccaataaggggcttatactgatgcaggggcaactcctaggtaggcaggctaaaggattaaaagaaggaggaaaacatgggggcagagctgtcggaagctgtgcactgtgagggaaatagactatgaagtctatttcccagtcactatatcccatagccatagcccttatttcccatagtcatatttctgtttcccatagtcatagcccagtcactaaacaagcaagcaaacgggtgggggaagggagatcagtattcaggttgttgttgcatatctaacatgtccagattttgatgacaaaaattgaggcatgcaaacaaatgggaagatgggacctgtagactgacgcagagactgcctttgaaggaggccaaatggagggctttgcagacagacttgacagcaaagacttgaattacaaatatgctcatagaactgaagaaaaccatgtctaaagaatttttaaagtatgatgacaatgtctaatctaaattagaggatagtaaagagaaattattttttatttaaaaaatcatgtagagattttgtacttgaaaagtataataaccaaaatgaaatattcataagaggggctaaacaatagatttgagctggcagaagaatgaatcagtgaacctgaagatagattagtagaaattatgcaatctgaagaacacaggaaaagtgaacagaatctcagggaaatattgggtaccatgaaggggaccaacattaattttaatgggaataccagatgaatgagagtgacagaaagagacatagtcactgaaaacgtctctaatttgatggcagacaagaagcttaaaaaagaattgcaaatagggtaaatgcaaagagccccagactgagacacattatagtcagagagaacaattggaaggtggtgagagaaaaacgagtcttcctgcacaaggaaaccccaataaaaattaaccgctgacttctcatcagaaacattgaggccagaaggcagtaggacaacatattcaaagtgctggggttgggggacagacatgacaaccaagaattttacattcagcagcacagtctttaaaatctgaaggcaagctgaagatattcccagataaacaaagactgagagaatttgttgctctaagacttggcttacaagacaccctaaaggaagtaattaggcccaaaacaagtgacatcagacagagtgttccgaatttgcaggaaaaaaatacttgaatactataaaccagcagtccccaacctttttggcactagggactggttttgtggaagacagtttttccacggactggggggtggggggctcacctcctgctgtgcagccccgtttctaacaggccacagacctgacagacatctgtggaatactccatccaacaatagtgaaactactaaaagcacatatcatcttaatagatgcagaaaaagcatttgtccaatccagcctcttttcaatatagaaaggctcaaactaggaatagaagggaacttcctctacctgatcaagactgtcccaaaaaacccacagctaacctcatactaattaatggtaaaaaactggttgctttccccctaggaacaagaatgagacaaagatgtccactccaaccacttctatttaacattctgcttgaggcattagccaggataactaggcaagaaaaagaagtagacaacccaattaagaaatggatgcaaaggatctgaatagaaatttctgcaaagaaggcatacaaatggccaatgagcacttgaaaagatgcttagtattattagttattaggggaatgaaaatcagaaccacagtgagataatgctacttcatacctactagggtgacaaaaaagacaacagtaaatgttgatgaggctatggagaaattggagcattcatatagtccttgtgggattgtagagtggcacccaccttgcaaaatattaatcgtagaatttaccatattacccattcccagttacatacccaagtaaaatgtatacataaatctgtacaacatgaatgaactttgaaaacattatgctaagtgggaaaaagtctgtcagaaaaataccacatattgcatgattcttttttttttttctttttttttgagatgaagtcttgctctgtcgcccaggctggagtgcagtggcgccagctcggcacactgcaacctccgcgtcctgggttcaagtgattatcatgcctcaacctcccgagtacctgggattacaggcacatgccgccattcccggctaattttttttttgtagaaacggtttcgccatgttggccaggctggtctcaaactcctgccctcagatgatcagccctcctcagcctcccaaagtgctggaattacaggcatgagccactgtgctcagccatgattccatttttatatgaaatgcctcagacttaagcagggagaacaaagggagagggtggtttgtacagggtttcttcttggggtgaggaaaaatgtagacttagattgtgatgatgattatacaactgtactaaaaaaattgaattgtatttaaatggatagattttatggtactttatgactcgatgttttttttttaaatgaacttttaaaataagttctaaaatgggccctagaaaacttgctgtttatgatgacaagaaccaatttatgttagtctcagccatgattcactacctcttcctacctattttcatagacatctgagtaatttagtctcatctaattcttcctgctgttttcagcgggatatttgccacctagacaatatgagtcaaaagtggattatcctcctcatttgactgctagctaacaagtccaggtatttgttttgaactgaatatttactactaaactaccaatttatatatatacatatatatatatataaatttgtcttgacagcttggaagcttctctgtagtaagagggcctcttcattcctatttagcataaaggcatcttatttcttgacttttattgattagctgtcagctgaatgtttccaaagttctactctttgtgcagggtcccagttcttcataagtaaagtgttagcacctaaacaaaaaaagggaggtgggttgttagctaaaactagtgggcaaaagtttaacaaaatagttacatagcctcaaagtctctctctacaaattacttattaattacaaagagcaaaatagtacctttacatcagagaaacctgcctcccttctgtgttactcgccacaatgcttagactgatctaattatgacgaagtggcatggaagcccaaattgagtgacatttcaacaaaattgacctccagttttcaaaaaggtcaaagaacacaaaggatgattaattctgcagattaaagaatagaaagtcatgaaaaccaaatgcaatgtatatttaatcttgggctttgtagaaaagatgtaaaaggacgttattgggaaaattgatgaactcgaatatggaccatggattaaatcagtgctcctccgagggggtggaggtggctatttgacagtgtctggagctgtcttaaactggggttgaggggtgggtagaagcctggaatgttactaagtaacctatagtgcagtcctagacagaacagtcctgtacaacgaagattacctggccaaacgtcaataacggaaaccctgggttagatgatggtagtattttactagtgtagttttcttgttatttggaaatactcattgaagtatttaagggtaaaaggacatatgtccaactcttaaatggtttataaagattatgcacacacgtgtatgtgtgtattttttacatgtgtggcaactaatgaagcaaatggaggaagatgtaaacaattggtgaatacaggtaaagagtataagagaattcttgcctttttttttttttttttttttttttttggtgacggagtctcgttctgttacccaggctggagtgtagtggcacaatcttggctcactgcaacgtccacctcccgagttcaagcaattctcttgcctcagcctccagagtagctgggattacaggcgcctgccaccatgcctaatttttgtatttttagtagagacggggtttcaccatgttggccaagctggtctcgaactcctgacctcaggtaatccgcctgccttgccatcccaaagtgctaggattacaggcgtgagccatggcgccctgcctttttttttttttttttttttttaaagagacaaggtcttgatgttgcccaggctggagtacagtggtgcaatcatagctcactacagccttgaactcctgggctcaaaccatcctctcacttttttttttttgagacagggtcttgctatgttccccaggctggtctcgaactcctggcctgaagcaatactactgcctgggttgggcttcccaaattgctgggattacaggcatgagctaaaacttgattttctttccagtttcttaagaaaacctcttgaagtagtcctttaagtcccaatctctgatgaaatatgcattcctgaaagtagagtgtttatgcctgtttgcatattccaatatatgtggaattagaaagtagtttggtcgtaatatatggggcttttttctttaccaaagcatcaaaaccaaatatgtttccagacattatgaatgtcccatctttataacacatcaggagtttgttcagagaagaaacatcaatgttttgaagaatttgattactgatttccaaaagagcttacataattagaatctttaacaatagcttgcacataccatagggtctgggatctgatatggaaatatagtaattaatgctgaaggaaaatgacacattctggacattaacatggtaatggtgacaattgtatgataacttggtcatgtagagtagcatcttgtgttaccctcacttcttaggtgtaaattagtaatatttatttttataccaaaataattttttcttcatgaaaacacctttcaatataacaggtaagaaattgaagaaaaaaattttgtcttccttatcagttcatagaccacttaggtcagtcttaggctgcaatcatgaattgcttcattgtgtgtgaaggttgcacgaaggggttgtgctgaataattatttttgatagcatatttaacagattattttgttttggttatgtaacaggaacgtatttttgtggggaaaacaggagatggatagaaaccaccaactggtagaatttaggttgccttttaatgataaaggattagtgacattttaactggcctaatttctttggttgaagtcaaagcagtgatttgggttatccatgtgtataatgcatggttttttcttaatttgcagaccatgaagattatgacccacaaactgtgaggctgggaagtagatatagtcatgttcaagaagttcaagaacggcttaacttccttaggtttgttttatacagttagtgttgctctctttaagaaaaagataaggaatacagaatgaatagactgtatagcttggtctttgttgggtggccttttcccaagtccccaagtcatgtaagacatttccctgtatttgttactaaatactttaaaatgattcgctgagttttaactttgttgcaatattttaagagaacacattttaacctttagaattgacttcgttcttcatatctgtttatgctggaaataatgtttatttttaaagggcaaattcccatattttgacacaaccggaaggaggactatactgacttaatgatatcatagacactaaggaaacgggggcaaaaggctgctagaccagcacctcaaaagagtggttggagtcctctggtatcttgtttattctaacagtggctgacaggcaatctaaagtcatgtgttaataatatcatttctgattggcttgaggggaaaaggtttattaagataaaatgtagtctagggctggattttctctgcaatatttagcgtttggtgatcatacacttaacagatgtgcaaagtgcctttgttaaaaattttgatggtcaggcacggtggctcacacctgtaatcccaacacttggggaggccaaggcaagtggatggtttgagcccaggagttcaagaccagcctgggcagcatggcgaaatcccatctctaaaaaaaaatacaaaaatcagccaggcatggtggtgttcacctgtagtcccgggtactcgggaggctggggtgggaggatcacttcaacctcggaggcggaggttgcagtgagctgtgattgcaccactgcactccagaccctgtctcaaaaaaaaaaaaaaaattttttttttaaatgagaggttccttttgaattcaaaaaaccacatgtagcaaaagagcttgtttagattacaagtgtgctaacagaaatgcccagattatcactgcttcttgaagtctattttatttatttatcttatttttttgagacggagtctcactctgtcgccaggctgaagtgcagtggtgagatctcagctcactgcaacctccacctcccaggtacaattctcctgcctcagcctcccaagtaactgggactacaggcatgcgccaccacgcccagctaatttttgtgtttttagaagagacggggtttcaccatgttggccaggatggtctctatctcttgacctcgtgatctgcccgcctcggtcccccaaagtgctggtattaaggtgtaagccaccgtgcctggccccatttattttaataacatattctgggtagttttgtcctgggctgtgttaattatggatttctatttattgaactctgtgcttatttatggagaaaattttaagtagctatataatgattttgaggaaaaacctctaccaaattttaagaaatttggcatttgtttaaagtgcattgtttttttttttcctgtgtgttttgtttttaaccacctggatagaaggacttgcctcctccccacattgagagttactgccatagtaagcagtcgttactgattggcatgtgttatatgtctcttaggtttactagaacagaaaagtggtttcaagcctttttgccattttaaagtttggaatcagaggaactattgtagtttctactctgttagtacctctgtatgtgagctaatagcaactaactcaaggaagaggaacctgactttaatgcctgctgtgtgttgggcctgtgccagacactttatatttactccgaagcaacacagtgcagcaggtgttactcccatctgatcagtaagaaacccaagattccaatggcttaaggtagcttgtttgaaatatcacagccagtatacgatggaattgcactactcaactaggtctcttttacttaagtctgtgctcttcctattagaccggtagtttttcaaacttacgtaggagctttagggcttctgagttaagttccttgaagatttctgaacaagcagtaggaagtttcccgatttttcctttctttttcctctcccaacaactggtgcagctctactttttaaaatatatatcagattccaaatgggattttcatttgaagaagggtctatgccatctttagaaaaaaacaaaaaaatggaaaacctttgaaaagttaagcagttttaactcataaatattgatggattagttatttgtgaaagtcacttgattgaatacctcatttttcaatgatgccatataagcaggctgctaagtcttttttctggttgttgttgttggagacagggtctcacccaggattctctacttaaatatgactgttgttaattgagtgctacaattaaattagccattgccatctttaattggagtgcagcggcacagtcttggctcactgcaacctccgcctcccgggttcaattgattctcatgcctcagtttccccagtagctgggactacagacatgagccaccacacccggctaatttttatatttttagtcaagatggggttttgccatgttggccaggctggtcacaaactcctgacctcaggtgatccgcccacctcagcctcccaaagtgctggcattacaggcgtgagttactgtgcccagcctaagtcttttatttttaactcaagctactaaacatgcttctttccaaaagtctggtttcaaaaactaaaggttcatggaatgaatcttttattcctaattcagctagctgcatttcaggcacaaagtgggtgttcagtgtgtgcttgttgaattaattaatatctagtggggatttttttttagtaccagataaaagtagagaaataggttattttgaaagaatgaatatctttttatctatagttaaaatataatggtgataaatgtattttataggtaatacagattgcctttccggataaaaattacataaatctaattgccaattttcaatgttttttcaagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtaagtcaaaagtaggaactctgtaaatggtgtctgatgtactttttcatgtacgtaaggaattgtaattttgcatataaattgtgtattttactctgatgtttgtctcaggaatttggtgtagttaggaattgttcatttttattatgtcacctgtcagtgggctttttcttctctcttcctctccctcctcctgccactgatgttccttttgtcttagcttagtatctgtgtattccatagatgtgcactaaacatacaaatctttcattcctcccccgtggatattaatgttccttcccgagttttcattcagtgtcgatctgtttcctcctcttcaatgtttaacactaaaatagaggacagaagagaggacttgtgtttagtatagattatgagtatatgctttattggcactgtttaccttgtgatatttttaaatacctgggggaataaaatactatctttttaaggctaatctatttttatagtactactctattatgcctatctttaatctgacctgttatacagcagtttatattgtttggatgtctcacatattttcctgcaaaccatagataaagatgtttattgtggcatttgagtatttaaaagcttttaattaagtatgtggttttcaacattgttttaacagcagaaacacatcttaaaactcaaaatttgcaccacactacaaaagtaaactgaattgaacaaggaaaatatgttttcttacttggtctccccatgcttatcccctttcccctccccaacccttttataggggccaacactgaaacacttcctcaaagtcccctagggttctgaacatagtttggaaaccactaatgtaattagatgagtgataaagatttatagaaactgggggtagagtagtcctttatgctaaactgtgtttcatgtaatctcttatttcctgtcaactaatttgaatttcttcttgagtgtctcacttggttatcaagatattaaattatagggttaaataatagtggtcaaagcgtattttatttttacaaaaatgtacctttcattcttaaattattcagagactttcattttgcatttattaccctttcttttggtctgtgcttctcacttaattttacttgattatcaaagtcaacttaccattaaatcattgaatagtgtgtttaagataactgaggatatggtttgaatttaaatgcccaacaaaaatatatgttgaaagggatgaatacttttatcattttgaaaccaggtcgtgattcagagtaatgatgatattgccagcagagctatagatctcctcaaagagatatacacgaaccttggtccaagactacaagtcaatcaggtgaggattgatgtgcattaaaacttccatatataattctttcggcccccatttctcttatacaaaagagaaaaaatattatctaaatgaatcttgccttgttagttgtcttgaagtgattgggttatttttaatataactatttattagatgttgaaatggcaaagaaagtctatgtgaattcattttgatgctaacacctaatcctgaagttcacttttgactaatttatgtttgttaacttatgtaatgctagcttccttttaataaacatacattttattattgtatggattctctacttaaatatgactgttgttaattgagtgctacaattaaatcagccattgccatctttaattggattaatatttggtttttacattttaaagcaattttaactgtgtttatttggcctgatatttgtaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgaggtttgtgaataactaatctattggtgctaattcttaattatttgatattttcctagccatttggtaaaaggagagcagaaatttttctcgtttgaaaattgttgtctttgcccattaaaaacattttcatttcatctaattttttttaataacctcccccactctcccatctggttttgttttggttttttgggtgaggcattcttaagttgttttctagttttctttttgtctttgacattattactcattaagtgttgcagtggcattttgcagttgaagtgtttttgtttatttgtttattttgagaaaaggtcttattctgtcacccaggctggaatgccgaggtgtaatcatggctcactgcgggctcaagcgacctttccacctcagcctcccaggtagctggggctacaggcacaggctaccacacctggctaattttttttgactttttgtggaggtggggtttcactacattgcccaggctggtttcaaactcctacgctcaagcaaatcctcctgctttggcctcccaaagtgctgggattataggcgtgagctacagtgcctggcctgtaaagagctcttaaaagctgccttgcatggcatataacaaatattttcaaatggtgtttatagttttgggatgttttgtgtagtcaatgccatcattttttttaaagagttttgtttattaatcatgaaattatatacagttgcttcttgaatatgatttttattttgtattttactttaaaaaaggtactataccaatataaatagcattttggagtgaattttgatatgaaggcttttttccagaaaaaaaataaagtgcattgtggcatttttgttgatgcttttaacaaaatgtaaaacgaccttttaaatgtaaaaggtaaactctaccttctttttttgaatttttttttttattaatacaaggtctacctatgttgtcgaggctggtcttgaactcctgggctcaagggatcttctttgcttggcctcccaaagtggtaggattacaggcatgagccactgcgtccagccaaccttttacatttaaaaatagtcttagtgagttgggcttttacagcataaaaataagcgttatatcttggatttaatttcattttagtagacacctcattttctgcaaccatagatacaagactaacaacaatagaatatgattatgtttttaaatattatttatatttttagttaaaaggagcaatatttttttttcttttgcatttcactcttgttgcccaggctggagtgcagtggtgcagtctcggatcactgcaacctttgcctcccaggttcaagcgattctccagcctcagcctcccaagtagctgggattacaggcgcccaccaccaagcctggcttattttctgtatttttagtagagatggagttttaccatgttggccaggctgatctcgaactactgacctcaagtgatccacccgcctcggcctcccaaagtgctgggattataggcatgaggcaccatgcctggccttattttcaagatactgaaagtaatacaggttgagtatccctaatccaagaaatccaaaatttgtctggtcccagacatttcatataagggattctcaagctgtattaagtatctttaattcacatcctcttgtttaataagaaaatacttagtgttaaatccccagcattattttcttggcaacaaaatttcagagtctgctgaatatgatgatgtctgtctttctttttccccccagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcggtatgtatgtatagttaacagatttttcaataaaatcaaaccagagactatcgtttaatcagtaaatactaattgagcatttgttatgtttgggactgtgttaggtgttagagttatagcattaaagtatagcatgtagtctttcggattttttggttggtatatcactaagttttgtgttttgtgtaagtatttttccttgtttttgatattaacatagtatataattttcagcttattacagccaaacttacacagataagttccaatatgccttcaagccctgatagctcttctgattcctccactggatctcctggaaaccatggtaatcattacagtgatggtcccaatccagaagtggaaagctgtttgcctggagtggtgagtagatacagttttgaactactgtatgtaaggcatcatgctagggtttttgagaataaagtatatagagtggttctttcttttcttgaggagcttacagtttaatgagacaaaaaaatacagttaaccaccaacttcagaatggatccctctaaaaggtaattgtaacacagttggaatttaaaacataatttccccataggtatagtattgttacttttacataaaattaaccaattagagcttaattataacactattggatgtataaatttagaggaaaacagtcatccctcgtatacgtggagaattggttccaggacctctgcatatacccaaaatgctgcagatgaccctgtgcaaccagatatacaaaaagttagccttccatatacttgggttttgcttgctggaaatactgaattttctgtccacatttgattgggaaaaaagtctgcatgtaaatggacctgtgcagttcaaacttgtgttgttcaagagtcagctgtatcactttctaaaatttataccacaaaacggatagttcttttagaactatatatgagctgggcatggtggctcacacctgtaattccagctactggggaggctgtgaggcaggaggattgcttgagcccaggagttctaggctgcagtgagctgcgattgtgccattatgctctagcctggtcaacagagtgagaccccatctctaaaaatataaataaatgaaaacaagaactatgtaggaaaatacctgtaatctttatcagattgtcagtaacatatagccaaagaaatatttttaagctctcctttcgcccctcccgacagaaattttaatggttacaatagtagcagccactccagtgtcaggaggatttggctctctataacaactggattaagaatttggtagtgggcatggcagccttttgttatgtccagagtctaaattgtatatatgagagaaatggtttaatagaacaggagaggagctatcacaaaaaaatgactggaagtgacttgatgatgtatttgatctgcactattaaggatttgtagggattaaaagatgggaaagtcagactatttcaaagagtagaaatttcataagtaaaagtatagggattaacacagagaaacttacttgggcttttataaaacgggagtaaataatttagaggtaattattttgtgtattttatattctagataatgtcactgcatcccagatacatctcttttctttggcaagttgcagacttaggtagcagcctaaatatgccaccccttagagatggagcaagagtacttatgaaacttatgccgccaggtaagaatttttaaatgatgatcaagtacttgctggacaataaaggagtatattagcaaattctgtttctaaatggaccgtgctttttggtatagactataacaagagttgacagatgacagcccacaagccacatcaagccccctgcttgtttttgtgcatcccaagagctatatttttaagtggctacaaaaaaaaaatctagaagaataatattttgtgatacatgaaaattatatgaagtttaaattttagtgtccatgatcaaaaccaggctcatttgtttacattcagtctacatgactgcttttgtcttaaaatagcaccgcccaggagttgtggcagaggccatatggttcacaagcctaaactgcttaactttcctggccctttacagaaaatgtttgcctatacctggactataatatgggtcatgtgtcatctgcggtattgttccttttttatccttagaaacaaccacttccaacttctcgcttttactttagtatatatatgtaccattatgtctggagtgtcctcatacagctatttctttgttacttacagatatatactgattttctgctgtgtagatgaaaacttaactgttacatacccccacatcctcccagtatttgcttaaatccagattcaacatctacgtttccaagattgtttgaaatatagttctctagatcactgacaacttttatcctggatttaataatttcccttttattttcctgattgtacacctatcacttattcttcccacatacttttttttgagatattttttatctgaatgtgggcaaactatcacgtttgattaatggtttgtgtatagaatcctaggtttgaaaatatattccttctggctggtggcattgctgatgagaagaccaaagtcctcttggtttctattcctttgcatgtgaccttcgtttctggaagttttggttttatccttacgttttgaaatattatgatgtgccttagcgttaagtctgttttgtggtgcgtcacctgtgggcctggagatttcctcagttgagagagatttgtattctttgatagttttctcaccagcattttgcgttttgtgtgtctttgaaatgtctaagtgtgatggtgaatttactagatctgattttaccttttctctcttcccttctctctttaatcttattccacctttggggtggcttctttaaccttttccagctcttctgttggcttttcccctccaaatattctagtgttaaaatttcaagacctttgtctccttagtgatccttttccatatacaggattttgtttttcactaacacattcttgcatttatgttctaatatatgtgtgttcctttaaaacctaatgttcggcaaaattatgcactaaaaatagtagggcttttggggaaaaagtagagttttggcagatcattcaagcctatacaacctaaaaattttttaaatgtattttttggaaatacttacaatcttacagaaaaattagaagtataattcaagaacacttgagagtaatttactggtttttgtagtcccatcgcccaccaaatactttccctacaaacaaggatatttgtctgtataagcaaaattaagccatctataccaggaaattaatgtcgattcattactgccatctacttagcagactctattgagtgttttcagttatctccttcacagcaaaaagatatagttcaaactcagatatagtcagccctccatatacatgggttctggatctatggattcaaccaactgtggattgaaaatgtttgggggaaaaaacattgttgaaagttccaaaaagcaaaacttgaatttgccacatgctgagtactgtgttgaatccacacgaatgaagctatgtgtaagcattgtattaggtgttacctaatacaatgtacagttaggcaccagataatgacgtttcagtcagtgatagaccacatatacaatggtggttctataaaattataataccatatttttactgtaccctttctatgtttaaatacacaaataccattgtgttataattgcctacagtattcagtacagtaacatgcttgtatgggtttatagcctaggagcaataggctataccatatataacctagatatgttgtaggctgtatcatccagatttgttgtaaacacaccctatgatgttcacacaatgatgaaatcacttaatgatgcatttctcagaacatatgcaacacgtgactgtaatctggagataatttatacaggaagatgtgcatcggttgtatacaaattccacatcattttatataaggtatttgagcatccctggattttggtgttgggagggtggatcctgaaaccatccctgcacccccaccccccatggataccggggaataactgtattgcatttagttaatgtatctctttagtttccttctgaaacagttcctcatactgtctttgaccttcatgaccttgactcttaaagattacaggccagttaattatagaatgtccttcagtttagatttgttttatcatgattgtattcaggttatgcgtctttggcagaaataccacagaagcgatgttctgttcttctcaatgcttccagtcagatagtatgtaatttcaatttttcccattactgacgatgatcactgtgatcacttgagttttttccttgcttccccactgtaaaattacccttccctttgaaagtattttgggccaggcacagtgactcatgcctatcatcccatcactttgggaggccgaggtgggcagatcgcttgaggccgggagttcgagaccagcctggccaacatggcataaccccgtctctactaaaaatacaaaaattagccgggcgtgttagtgtgcacctgtaatcccagctacttgggaggctgaggcttggacctgggaggcggaggttgcgttgagccgagatcatgccactgcactccagcctgggcgacagcgagattctgtctgaagaaaaaaaaaagtattttgtgcagaggtactttgaaaatatttatactgttcctcatcagacattttattcattcgtttatatctgtatgaaatcatgatcaaggagttataatctgttactatcatttatcttgatgctgaaatgatctcgtttggccagtgggagtcctttcagactgttctgtgttactttaatatgttcccattattctttcagcacttgtgtgctctttggctcaagatgtttaagattaggtcaagtgtagtggctcacgcctataatcctaacactttgtgagggtgaggcaggaggatcactggagctcaggattcatgaccagcctgggcaacatagccagacttcatttctattaaaaatttcaaaaattagccaggtgtggtgatgcgcacctgtagtcccagctacttgggaggctgaggtgggaggatcacttgagcctgggagatggagactgcattgagctatatgatcaagccactgtactccagcctgggcaacagaacaagacgctgtctcaaaaaaaaaaaaatttaaaaaagttccagattaacatcctgtaccctctctgccccagtcctgaaattggctgtttctccaaggaggcctgtttgatttattttcctggagaatggtgtttagaaaccaagatctggacatttattgcactcattgctatcgatgtattgttgctccctggctctctaagcagttagagctaaggaatgtgtgtatgtgtatccacatttaagtctattactatatatatacacacacacacatgaatatatatatgtgtgtaagtttttacaaaaccatggggtcacacgacttcctcccatcccagcctatcacagtttcattctagttttctccctttctatatttgtaattttttttttttttgagacagagtctcgccctgtcacccaggctggagtgcagtggcgcaatctcggcttactgcaacctccgcctccctggttcaagggattctcctgcctcagcctcccagtagctgggattacaggcgtgagccaccatgcctggccaaactctcttttctgacaatgaaaaacctggcttctgttatcctctcacttattttcctatttaatcagttatctccagaccccccaccctttctttgaacgcagaaggactcttgtctctgaatgttgggtctctaccccagggacactcctcgctctgcttgagttgaatctttatgctgagctctacccacttattgggctccctcctcctccttcatggtctgtaattcccaacataggactacctttaaaacttgcacatagtttaattagagcactcataaaatgataattagtatcctcagagataatttggacagtccaggcaggtacttcagtgtggctgaaggcttcctcaggagatagtaaaaagacacaaaaccagtacagaggaaatgctgacttgacattgctgagatacagtgcaaaagagtggagctctgagatagatgggctaccattaagataggcacagggggaagtagaacctgccaaggtccatgaaagtctagtttaggattgtatctcacaagatgagcccttgatgcaagtattcactttaaattttcctttaaaaagaaacaggcttctgcttacacatctacccagctgagggggctttttgctttgctcattttaatttttttgttgaagattaacagttctgttgttctggctactgttgcctggaagaaatcacacatgaacaaactcaccttctgcattatactgacatcattatatttgccaattgattgtgagctaattggggttatagaaacgtgctatagcataacagactgtaattatttctctctaggctattactgatggatattatgttttcttctttttccagcatcatcttttactgtccttgagttttttaactagctttttatattaaaataatttcaaactgtttacaaagaatacagttggctcccaaattcagtaattaacagtttgccgtagtgatggcaaaagtttcctaacatttggagaacaagttgtagacaatcatctttttcttcctaaatagcttagtatatgtcttctaaaaacaagaatgttctcacttacattaacatagtattattcaaaataaaaaaaatttagcatatacagtaatatcatctaatctgcagaccattttcatattttgacactttcctcagtattggactttataacaatgttttctggttgaggatctaaatccaggttcatacattgcataattattcggtatctctttcagttgtctttaatctggaatagttcctcagtctttgtcttttgtgactttgtttttgaatggcacatgtcagttgcgctgaatatctctcattgggtcttatctgttctgatgattatatggaggttgtacatttgacagagtactacttgtatgttgatgtgtctaagagcatcacattgagagacacatgtcactgtgtctttggtgacattaacccagatcacttagttgatagctgccaggtttctcctctaaaggagagagatgctttgtgtagagagatgctttgagacttcgtaactatctttttcctcatcaaacatttgttttatcatctattgtgattgttgcctaaatgtttttactatgatggttgcaaaatggtaattttgttttaattttgtcatcctttctacatttattagttgacattctataaggtagtgctttgttttctcgcctttatatttgtcatatatgatcactcttatgggtttattttattcattgggttataaccattgtaatggttatttattttgatgctcaattgtcctagatatggtcagtggaagcccctataggttagacccagacatacaacctcaatttttttaaggtactttattgtactttattattttctggtatgagaagatgtttcaagcttatctatagtatttcctctgccccagctctggaatctgccattccagagtttttagaaggaagggtatttagaaatcaaaatccgaggtttaaatcttttttttttttttttttttttttttttttgagacggagattttgctctgttgcccatgctggagtagtgcagtggcgtgatttcggctcactgcaccctctgcctcctgggttcaggtgattctcctgcctcagcctcccgaatagctgtgattacaggcacctgccctcatgcccggctaattattatatttttagtagagacgaggtttcaccatgttggccaggctggtctcgaacgcttgacctcaggtgatccacccacctcggcctaccaaagtgctaggattacaggtgtgaaccacagtgcccctgccaagtcatccttatttcattctaattgtggtaaggtgatacctcattgtggtttggatttgcatttccttaatgattagttatgttgagtgtgctttcatgtacatgttggccatttggatgtcttcttttgagaaatatctattcaagtcttttgcccattttaaaaatcggattttttgctgttgagttccttatatattctggatattaaccccttgtcagatgcatagtttgcaaatattttctccaattctgtagatttgtctttttgtggtcttatttcctttgttgggtagaagctttttagtttaatgtaatttcgtttgtctgtttttgtgtttgttgcctgtgcttttgaagtcttagccaaaaagtccttgcccacactaatgacatgaaacatttcccttgtgttttcttctagtagttttatagtttctggtcttacatttaagtttttaacccatcttgagtttatttttacatatgatgaataataggggtttagtttcatttttctgcatatgtatattctgtttttgcaacaccatttttattcaagagattgccttttcccccaatgtgtgttcttggcacctttgttgaaaatcagttgtttctgattatgtggatttatttctgggttctctattctgttcaattgatctgtgtctatttttgtgtcaataccatgctgttttggttactattgctctatagtaaattttgaagtcaagtagctgatgccttcagctttgttcttcttactcaagattgattcggctatttggagtcttttgtagttccatatgaattttaggagtgttttttgtatttttttgttttaccttgcagattcacctcaaaggatgttttttctatttctgtgaagaatataattggtattttaatagagattgcatcaatctgtagattgctttgggtaatatggacattttaacaatatttgttcttccaacccatgaacatagaatatttttccatttatttgtgtcctgtgttcgttctttcatcagttttttttgtagtgatctttctcctccttgcttaaatttattcctaggcatcttatatttttgtagctattgtgagataactttcttgatttctctttcagatagtttgctattggcaaatggaaacactacttagttttgtatattgatttttgtatcctgcagttaactaacacaggttcacgcttgtaccagtccagcttcctagtcatcttccattccgtatttgtatctctacagcaatgagaaatctgaaacctgagggagttggaaaggcttcttaatcagtcttcagcctctgtctttaggccttcgaatcatttgtgccttcccaagtgtttgttgttttcatacccttggcttttctcagatttagtggggcattaatttataggcaccctcttctccttgccttcacaacaactaaaccaacttcacaacttcagctaaaccaactatctatccccatcttcactacaccgtcagtaatttgttgacagctgtttaatgtgttgcttccccttctgtttttatgttcttttgagtttatgtatttttatattcattcattctcattttagtggggtttggggatgaagtactgataaatatagtgcagtacaccatatttagttgacataatttttaaagctgtcttctgcttttattacctccattttctaaattaaacaccttgttgggcttctcatcttgctttgcaattattatgggacagaagcatttcacattagattcttagctaaggcttctctcaaaagatatatttcattcttgtctgttacatcgtttagaatttacatagtttcatttgttagtatttcagtaatagtccttgcagtgctttactgcagattcaaccttcacaacatactgtaaaaacacaaacccaccactgaatccttgatcttgtgattggcgcttaatgccaccagatggcgagcatgagctcttgtcagacagttaaggcaagaaacttgaagtgggtgctttcttcatgttttatataatgaaactagaatacctaaatttgaaacagccagcttttgaaaaagctggtaatggttgtattgcagcagaaaatcataggctttggactcaaatggacttgagttccaatcctgcttctaattgctactctatggcgttaaacataagtttcatagtttattagagcttccttatccttagaactgggataatgataacttttttgtgtaattgcagggattaaatgaaacaatgtatggaaaacccctagcctagggactggcacttagtattcattaaacattaaaccactctctgtcacttccttttcttagagctcctgcttcctttcttatttaagagtttgtgtctaaaacgtggtaatacaatcttttgtaaaagtctgttgtaagctcttagcactgataaactcaacttaaaccacacatcatctctataaggtatagttaatgactaggaaaaaagctaatgattctctctttcccctccatttaaaatacatccaagagtgcacaaatgctaaatgatcacccaaatgttacacttcttttcattctgaatctttgcctgaagccaagtgcccatgttatgatttgctgttaaacttaaaacttctgcagtcctctctatatgtaataccatcttttgtaaaagtctgttgtaagctcttagcactgataaaccacacaacatacctataaggaaattattaattttatctgtattttaaagacggagaaactgaagcacagagagattgttaattcacctgggacacatagcttaaatgctatttctcatttctttttttttttttttttttttaaagagagagggccttactctgtgtcccaggctagagtgcagcagcatgatcctagctcactgtaacctcaaactcctggcctcaagtgaggctcctgcctaagagtagctaggactacaggtacacaccaccacacctgactttttttttttttttttttttttttttttgagatacagagtctcacactgtcgcccaggctgcaatgcagtggcgcagtctctgcttactgcagcctgtgccttctgggttcaagtgattctcctgcctcagcctcccgagtagctgggattacagatggacgccaccacgcccagctaatttttgtattttttgtagagatggggtttcaccatgttggtcaggctagtcttgaactcctgacctcaagtgatccgcccacctccgcctccctgagtgctgggattacaggcatgagccactgcgcccggcccacacctggcttattttgaaaatttttttgtagtgatgggggtcttgctgtgttacgcaggctggttttgacctgggctccagtgatcctcccatcttggcttcccaaagcttaggtatcttttcaaaaggctagaaagaaaccaaaatcgtcataaactctggatgacaagattatgactggcttaaatttttctggcttccattttttataaaatgtaacatgatataatcagggatgaatatgagagctggaatggccactgagtgttaactttgattcagatctctcaaatgagtaaactataattcaagaccattaaatgatttgcttagaattcactacttctgaccgggtcacgctggtaatcccagcacttcaggaagccaaggtgggaggattgcttgagcccctggagtttgagatcagcctgggcaacatggcataactctgtctctacaaaaaaatatgcaaaaattagctgggcatggtggcacatgcctgtggttcccaactactcagaaggctgagatgggaggatcacctcagcccagggaggttgaggctgcagtcctcacgccactgcacttcagcctgggtgacagagtgagaccctgtctcaaagaagaaaaaaaaatatccaccacttccttttcttgagctcttctttttttttttttcctcctactcccctttgcctccatccttcactcagaatatttttaagccaagcaagatactatgagatacagtggttaagcatatgaattgggttgcttttagggagtaatttgacaatgtatgtcaagtctttgggcattatgttcaacttctttatgcttgcagggttttgcatggtgaaaattataaaaattcagctgctaggatctttgatgtttaaaaaggtgaggggaggtaaaaacctaaatgcccaataataggaattaaactggtaaaataatattgtcattttaataatcagataaaatgatatagatgaatattcaatgacacgagaagatatttataaatattttattataaaaactattttaattggttacattatatgtcgctatgccttcagagtagagagaagtgacagtttcaacacaaactgaaaaatttgtaagataatggctgctatttctaggcctgtaaaaattcatttacccaaagaaaatcatagtttttttttttttttctggagatggagtttcgctcttgttgcccaggctggagtgcagtggcgcaaccttggctcactgcaacgtccgcctcccaggttaaagcaattctcctgcctcagcgtcccgaatagctgggattacaggcgcatgccaccacgcccggctggtttttgtatttttagtagagatggggtttcatcatgttggtcaggctggtctcgaacacctgacctcaggtgatctgcctgcctcagcttcccagagtgctgggattacaggcgtgagccactgcgcccagacctatttttcttttctttaaaagaagcttttacttaaaaaaaaaaaaaaaaattatcaaggtatttttttaatcatagggcagttaccttagatcatcaaaatactttccaaggttgattgactattaataaagttggaatatttggtagctaatgcttaattgtattttgggattatcttatttttcccccactgtgtcttttcaccgtaatttaaaattatgttttaatattatgacaaaaggacaaaagctctgcttgctttgaggtgaatgtacataggcacttaccctttttcgatgtttgctttttagggttcattttcttggatatcactacattcctttcagtgaagcaagccagttaatatatagtgtcagggggcaaacaataaagaggttagagggaagagtttataatttttttcttgttattttcagtcagaactacttccttttgaaatgtatttttttccatctccagtggctgagaggagagtatcttgatttgaggtccctgagtagcagatgctttgtattgagagtaactgattaaagagccctgttttttgtttttgtttttgtttattttttttttcttttttaatcattccaggtcttgtcatgtcttaggaagtttgagcctatagcccaactgagtggattgttattccatattagtatggtcttcaagatatcaaaagttaaatatgtatgaacacatgaattacattttcacactgtctctttttttcctccagatagcacaacgatagaaaaattaagagctatttgtttagaccatgccaaacttggagaaagcagccttagtccatctcttgactcacttttctttggtccttcagcctcacaagtgctatatctaacagaggttagtttttggggttttttgttgttgttgttttctttgtttttccttttaaatttattctgtgttctttaaatttgacctttcatatggtaaggtgaatgatttgggtaaaattgtaatgaagtagttttgaaatgaaatattaatttgaaataaataatagtgagatggtcaagagtttcttggcactgacaatagtacaaatagaagttattttttttttaaatcttttaatacagccctctccccctcttctctatttttccaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagactttttaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagatataattggtttatcttgttgcttgtttcccttcccaccttgggcttaaacccaagttctgagcttattctgactcggtttctgccttggtggcattcttgatccatgtcacaaaaaattctcaagacatgccagaatttgatacttatttatgagagatcaaactatgcatttaattctaagtaaagttttataaacatcataaatgattgttttactaagttactgatagaaggtaaaacttcagggataaagattttcttctttagaaatggcttagttttcaattgtggagatcagaatgttgatatttatggtaatatcacatataattgttttagctatgataatactgtggttatgtttaaaaggaagagccccctatatttttgaagtgattgctaagatacttccaggtgaaattacatgatatctaggatttgcttaaaaacaatcctggggtggagaagtgatggaaagcaagggaggatagtcagattaaacaatttggttcactggcgataattcctgaagctaagtaatatgtacatgggagttaattatactactttcgacactttgatgtgtgttacgaattttctgtaaaaaatggcttaaattttatattgttttgtatcacaggtcccatctttgttaggatttttttttttttaaagtagttcttattaggtaagtaaaaagacagcttcttgttaggataaaaacagatttttgtcatgatccctgacacagatacttaatgaagtacacagaaaacaattacatgtttccactttcacctttcttcagtatttattcagagaatgtgccactatggatacagaggtacataataacctctaatctcaacgagctcacagtagggagcccaatgcaaacttagtaatatagaaatatcttaaaataatattgttgaaatatttacagtatatatatataggaggggagttacaacttgaaggcagtcagaattacctcgctaacaactacgtaatgaaattaatctgtcactgatttaacaacttgattatagcattaagtaaaaactagggtacctttcatacattagtcctcttactgctttttcagtattccttaatttttcttttttttttccaaagaaaaatgtggtaacaatggggaatacaagcagggtctgcccaaggcatgtacataaaagatgtacaatactttactgagtctctagaagggaaccagtctatttagtgtatcattatcccctgcaagttaagctgaggccagatttagagacacgagttgattgctctagaatggggatttgcagacacgtggcactacagtgcacaaggaagagaggaagcccactttgttggcagtgctttttgtgtaagttgccacaggttctataatgtgtatatgcaaggaagtcgttctgcaggagtgggtgatgaatgaagagcaattggttaggtctggttatgtacaaattatttactccaaataaaatggttaacttttttcagatcaaccaagttacccatgatcaagcagtggtgctacaaagtgcccttcagagcattcctaatccatcatccgagtgcatgcttagaaatgtgtcagttcgtcttgctcagcagatatctgatgaggttagttttatcaagacttctgtcacaattttaactttcctaggcccacttattttaatcactgtctcattctatagataatgtccccttaatatcagttttgtctactattaatattagtactttctgtttttaatcaactttatgtataataaacagcatccttttaaagtatacagatggggtgattttttttttttttgagacggagtctcactctgttgcccaggctggagtgctgtggtgctatctcggctcactgcaacctccacctcccaggttcaagtgattattctgcctcagcctccacagtagctgggattacaggtgccacacccacccccccatgcccggctatttttttatttttagtagagatggggtttcatgatgttggccaggctggtctcgaactcctgacctctggtgatctgcctgcctcagcctcccagagtgctgggattacaggcatgagccaccatgcccggcccagattcggtgaattttgacatatatgtgtgaaaccactgctgcggtcgaaaccgaatgttttcatcactctttatgcacttttgcagtttattctttccccaggtaactactgctctttttgtccctagagagtattttttgtcttctggagttttatataggtggattatagtgtgtgttcttttgtgtctggcttctttcactaagaataatgactgagaattacctgtgttgtgtggattagtagttcattcctttttattgctaactagtacccattatgaatattccacattttgtttatccatatacttggtgaaggacagttggatcattttccctttttggctgtgaataaagctgatgtaaacattgtgtacaagtgtttgtgtagacataaattttcatttttcttggataagaaactacgagtggaaaggttgtcatctttgtagtagtaaaatgtaatagtaaagagctagagaacttggggagcgtactttgttgtattgctgtttaaaggcaggaggtggggaataagccaggtgcagtggcagatgcctggacttccacctacttgggagcatgaggtaggaggatctcttgagcccaggagttcaaggctgtagtgagctatgatcacaccactgtactctagactgggtgacagagccagagggccctccgcccccacctttttttttttttttttttaagacaaaggcaacttgggaatttaaaaacaatggtactacacagtaattcctatttcctttacaaagtgaaacatttttgtttttctaaacataatttcactctcattctatcaacagttctatttactcgttatcttgcaggcttcaagatatatgcctgatatttgtgtaattagagctatacaaaaaattatctgggcatcaggatgtgggtcgttacagctagtatttagcccaaatgaagaaatcactaaaatttatgagaaggtaagaattatcacagaactatattccttgtaaacaaatgtttcttaattgtgcatgtggtttgatttttattagctttgctatttttaaaaattgaatcacttgcatcttaatggttgaaaattaattgatagctatgttgagaatatggtaaaattttactttgaaaatgaagtacttaagaatcgtgccatgtggctgctttttaaatgaaattgccttttgctgcttcttgtgggggtcagatataattgtctcatactgaatttgctttatcccattctcttttttcttttatcatctttctgtcctgcgtaaattttggtttgtcagttatggtatggcatttaagtatttttatttgattgtcttaaagcagtcaaaaataagagtgttagccaattagatatcattcctgaccttctattagattaagcaaattatctacagaagagaagctgtggttggctttttgatttatcatgtgtacctgcccctgatgctacatatttagaaggagaaattgagttacaggaacttccctgacttggtagagcttcttttacatggccaacatcaccctgatttgcccaggatatatgttgatgttccatagtatctgtctggcacagccctgggtattcattcagcttattaactgaatacttattctgtttcaggcatgtactgtagttactactttttgattaataaagtcagattagaattcattaggtacctccccaggcatattttaggttgtaagcctttgaaacccttcctgaatagttgtcagacaattgattttgaataaaatggcacaataggcaagcaacataatggaactagtcaaaagtacctaagtgctatgccacagtggttcctgagaaaggattggttgttggttcagaagtaaacaactcagaaggtctcaaaaagataggtagtgtgctcagtgtgctccttcagccctcctgaagacataggaaaataatggaattagactttattttctattatagtcatttccagactattccaaaggggcctcaagagttaacatgcagccatggagaggctgaggccaggtggtttaagtgagcagatgagttttaagcactaactagaagttgtgtgagatttttcttaaatacttctttgggtaatttgttcttgattgtaattttacagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaagtaagtatcttttttaattgtaagaaacttactttttgtaaatggagtgaattaatttaggctggcaaaatgtgtccccaaaattaaatatttattgtctctatggcatattggtattgaggaaaattttattatttaagagtgttttgcttaacctaaatgtttggttttagtctctgcaaatgccaatattaattgtcaaagcatgatttttttctaatcttagaatttagttttacctgggaggtatatagattagcctatttctaaaaatctagtttgcaagatttaaatcatataggacattagcctcctatcttagattcctagatgccaggttttttttaaagccaaacagaatttgatatgaaatttgtaagacagggtcattgtaagaacttttgcagtttacactgataataaagatcagttataaagctcatgttttcatttcaagagcatttaatcagtggcagtaattttgttttgggtttctttttctgcaagtcagtcagatttatagaaaatgttggtttccatcctcttgtatcagtctgatcctgatcttcgtatatggtaactttattaacttgggctctaatttgtgtcactgttgtatgtaattaacttgttttatctgtattttgtgaaaagacacagaaaatgtttactttcatcattccatcacatgccattcaataatgacaaaattcattgatgaaaggttgatgtaaattcacaataagtcatttgttgaaatgaaacatagtaataattaaagttttaaaaatgtacatgctgtggggggtagggttcaacttgcccactcgagaggatgtagagtctgaagtgggaatgtcactttagagtctaaagtgatttagtgggtttaaagtgtgaatatcacctattttaagaaggtccttgggtaagttctttgaagaaatccagtccagcctattcagaaactcttaacaggatccccacaaatcgggttgggcgtgctacctccttgagaagacaatcctgcacgttggaaaagataaataggtttagtaagtctaattccatttaatgatgcatacgtgtgggaatggtgaggataggaaagatgattagccaacagttttaatgatgtcaaacctggagggtagcaagtttgttattctatgttgaatttttaaaatcttaaattaggaacttatttcatctcttagtctactaactattaaggaacttgatttaacagggttttttgccctctaccctttatgaaaattacccttatataagtcagaaccattttgcccctctcttccctgaaacttgcatgcagtgcggtaatgtactgtagaaagcatgttatctcattatgtcaccatattgtctgcaataatagggagggcgttctaagttaggatctttttgagttttaagtacctgattttttataaatatctgaatacctatgtaggttcaaaatccattatttcccgttagtaagaatttgtcagcaagtccgacttggacattaattattggcattaatattctaaaatctgaatccccaggccgggcacggtggctcatgcttgtaatccctgcactttgggaggctgaggcaggtggatcacctgaggtcaggagttccagaccagcgtggccaacatggtgaaacctcgactctactaaaaatacaaaaaattagttggacattgtggtgggcgcctgtaatcccagctacttgggagactgaggcaggagaattgcttgaacccggaaggcggatgttgcagtgagctgagatcgcgccattgtactccagcctgggcaataagagtgaaactccatgtcaaaaaaaaaaaaaaaaaaaattgaatccccaaatacatactggccccaggggtttcaaataagggattgtgagctgtgtacaaatctgcccctcagatggagtttataatcctatagtaacgtttaagcatagttatttacaaggtacttctcacttaatccgtatagcaactcagaagtagactttgctgatggagaggcacaaggactgtagaaattaaatgactaacaagggcataatgatcactaaatgctaacactaagactgaaggttttctgcttcttgagttctgacatttctgccacacaaattgggctctgggtgtaattataatccaccagcaaatatgtgaatccctacctatgtgcttggcaattaaaaccaaagtcaaataaggcagttcttgcactcaaggaactttgagagagaaattggtgccataaaaggtaaaatactttgagaattggaaaggccataacttactttctacctggaaggagcaaaagtgaaggttttgtgcaggatgtagcatgtgagctcatgtttgggcaggatttatatgtgcataaaagtagaagatggtcattgccagtgcgctctctctctccctttctcactcccagttatgtggcttttacttcatgtgtctttgaactccatacactttcctcctcatggtctaccctgatctaagcagtctggacccattgcctggacaatcatagtatccttgatcttcccacctgtagtgttgtactcttctaatctgttgactacacggcaagcagagtgatctctagaaaatatgagcatgttgctttcctgcttaaaatctttccatgtcttcccgttatctttgaattaagttcaaacttttaaatttggcttataagcactccataatttggtccctgcttctactcattcagaagtttcaacttaaatgccacatattctagtaacttttccttatccctaatctaggaaaggtttcctagacctctgttcctgttagatggtctgcttccacatcatgacactgactttattttattgtagttagttgcaatggatttaaattcttttagataaacgatatttttttctgctgtttccacagcctgttgttttattccctgcctagttaactcacttatgttacctctctgatccgagaaagcatttgactttgccactcctgggatagtgctttcagagcagagctgagtatttggttaaatgtttagaaaaggagtcaaggataatactgtacaggaggttagtgggagtcagtttgacagaaggcctatggtgctaaggtctaagcagtgtttgatgttaatgtggtgtaggcagtctcatgtatatgtttggtaaatattgatcaaatacctattgtctacaagacactacccactgtggatatggcaaaacagacaaaatcttagccttctaggagcttacatgccaaaagggatgggggaagagaaggcatacgagaagtatatcagataggaataagtgctatgggggtgaaataaagcaggaaaaggggctgtgtagtacggggcatgagtggagttcatttttttatagggtagttgaagaagacttcacaaaggtgatagctttgtttagaggtcaccttttatcattacctttcagagcaaagtaataatccatgtgactcatggagaaagtatattttaagcagaaaaaacaacagatgtatatgtccaggcatgtcaggaacatgcctgacatgtgaaagaacagcagggaaactggagtggatggaacagaggcggtaggggacggggacagttgtagggagtaaagtcagagaggataacaaacaccctgtgagggtttttataggtcattgtgaagacattgaccctaagtgagatgggaatctttcagagggttttaagcagagaaatgatgtgctccaccttaactttgtaagtttattctggttaagaatagtatgtaggatagcaggaaaagcaagctattttatgaatttaaataaaagatgacagtgggctgcatgcagtggtggctcatggttgtaatcccagcactttgggaggccaagacaggaggatcacttgaggccaggagtttgagaccagcctgggcaacatagtgggaccttgtctctaaagaaaatagaaaaaataagccgggtatggtgaacatgcctgtagtcccaactactcaggaggctaaagtgggcagatcacctgagcccggagaggatgaggctactgtgagccctgatcgtgccactgcactctagcctgggtgacagaacgagacccagtctcaaaaaaaatttttttttagctggatgtggtagcatgcacatgtagtcctaactagtcaggaggctgaggtgggaagattgcttgaacccaagagtttgaggttacagtgagctaggatgatgccactaaacagcctgggtgacagagggaaaccctgtctaaagtaaaagggactgactgttgtgaagatagaggcaacaggattagttgacagaaatgtgtttcttttgaagcactctagaagtctgcatttgctcagggaagttctatcgggtattcacgagcatcaactttttattgcccctcatatttgggctgtatacctagcttattgaaaaattagtaaaccaaagcagtgggaatagcatacctttgaaaatctgattaagttatgggcttgctcccagaaaagtagatacgcctgactttggtttacttgggttccccccaaattctacctccaaaaattttaggggcttctgaatccctctgatttataggcctatggactgttttcagaaacctaagataccctctagggagggaggttagtacacagaatgtatgctgtcaggtcctttacacttgtactttaaattaagttctgagggctgggctcagtgactcacgcctgtaatcccagcactttgggaggccgaggcgggcggatcacctgaggttgggagttcgagaccagcctgaccaacatggaaaaacgccgtctctactaaaaatacaaaattagccaggtgtggtggcatatacctataatcccaactactcgggaggctgaggcaggagaatcgcttgaacctgggaggcggaggttgcagtgagccgagatgttgccattgcacaccagcctgggcaacaagagcgaaactctgtgtcaataaataaataaaaataaatttggttctgagttatctagtaactagcacaaagacagaaatgtagttatccatgaaatgcagtttgtgatgtctataagatattcacaaatgcttagcaggtacttgttgagcatcttccatgtgtcatacattgttctaggtgccaggacctttggcatcaagaaagcccctacccttaaagagcttactttgtaatggagatagactacacatttgataactggttcttgaggtcctcttatacgccagacactattctaggttccaatggcacagttttaattaaaggtagatgatgtctctgccctcttggagcattttattctagtgagatctatatagtacataacagtttttaaaaaagatagatccatgattcccagatctgagaatcatgagacaaggttttcccaagggtcatcagagagaaaatatggtattgtgattctcaatctttcttttttctttcttttttttggagatggattcttgctctgtcaccaggctggagtgcagtggcgtgatctcagctcactgcaacctccgccttccgggttcaagcaattgtcctgcctcagcctcccaagtagctgggattacaggcacccaccaccacgcctggctaatttttgtatttttagtagaaacggggtttcaccatgttggctaggatggtcttgacctcttgacctcctgatccgtccgcctcaccctcccaaagtgctggggttacaggtgtgagccaccgcacccagcctgtggttctcaatgtttagtgcacatcagattgacctaaagagtttattaacacattgctgggccccacctccagtatttctgattcaggaggtctgcattggagcctgagagttggcatttctaacaagttcccagataatgctgatgttgctgctctggggaccgtgcttttggaactgccagtacggtatacggcagcagtccccaacccttttggcaccagggcccagtttcatggaagacaatttttccgtggatcagggaggtagtgggggatggtttcgggatgaaaggattccacctcagatcatgaggcattagttagattctcataaggggcacataagctagaacccttgcatgtgtagttcaatagggtttgcgctcctatgagaatctaatgccaccgctgatctgacaggaggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcatttaatgaggcaaacctctgttttgtaagaatgcatcttgtatatctttaatgagttttttcatacatgtagtaacacaaggaaacaaagtttcatttttgtacattttatttctattcaaaatgggtttaatttgctatacacttgattaaaggagcaaacatttaaaataaaaattttgataagtactatattcagttctttcttaatatttacaaatttatttaacctgcgaaattaggtatgttagtgatagtaaatagtgttttgaaggaagatctttttattagaaaatctgagttttctgagatgtaatgagatcttaaattccaatgagtaattttaaaatgatttacttacaagagaactttttttttctaaaaatatatagcattgctaatatgtaatccctttttcaactttttaggaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactagtaagtatttttaatagaatgtgataattgatcatttcaatgtttcaaagttgttttcctgtttttctttcagaaaatatttccaacttacgtatttctttcagtaactagtttaacatttttagtgagtgaatgaacagttaagaccattataggccgggcacggtggctcaggcctgtaatcccagcactttgggaggccaaggtgggtggatcacctgaggtcaggagtttgagaccagcctgaccatggtgaaaccctgtctctacaaaaaatacaaaaattagctgggcattgtggtgcacacctgtaatcccagctactcaggaggctgagacaggagaattgcttgaacccaggaggtggaggttgcagtgagccgagatcgcgccactgcactccatcctgggtgacagagcaagactccatctcagaaaaaaaagaaaagaaaagaaaagaaaaaagaaaaataagaccattataagcagaccaccttgtatagaaaaaaattcaaacatttgttaagtggcatcctataagtggtgtcgccatttggcaagataaatttcatctcatgaaacctgtcataaaattcaaactccagattaaaaggtagccaaagtaaatgccgtagagtatagacgtaaaactttattttatttatttatttttttgagacggagtttcactcttgttgcccaggctggagtgcagtggcgcgatctcggctcactgcaacctctcgggttcaagtgattctcctgcctcagcctcccaagtagctgggcttacaggcgcctgccaccatgcctggctaattttgtattgccaccatgcctggctaatattgtatttttagtagagatagggtttcaccatgttggccaggctagtcttgaactcctggcctcaggtgatccacctgcctcggcctcccaaagtgctggaattacaggtgtgagccaccgcacctggcccagacttaaaactttaagttgcatgtattggaaaacctttcaggtcttcacttagaagttccgtaacgttatgagttcgaagaaaatctggctttgaagattagaacgtgagaagttaccattttggtgcaccttatttatgttctcatttaatgcccacaccaggcgcatgaataggctgcagatttcagaccttacagataaggaattgaagctcaaaagggcaagggcaatataaaatattaataacagaaaaagcagaaataagcataattgatgctgttttaagagaaaatcgctatttagaacacttaagaatataattgattatagtaaatctttaagaacatgtcaaattactttttgatgtgtttcagaatgtttggaagttttaaataacatctcaggaatttctgaataaattgattgcttaaaaggttagacctttagctgtcctatcaaatctatgtattgtgagaattcttgtattttttttttaacttaatgggggttaattttttaatcacagattggagtatagtacaacgttgtttgcatccttccctatctgccattgttccctgtcaacacagaaatatttacctaattccatttttggccatgcagtttggtatgatataattaactggccccctagacaatgatacttaatgttgtttccaggtttatactaggtggagggagataggaagatgtacagtgatttacaattatcacaaatctgctgtcttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaacatagtatagttctcactacctaccagaatttaaactgcagataatttttagaatggtttgtacatttctaaagcaacagttggctgggcatggtagctcacacctataatctcagcactttgggaagctgaggcaggtggatcacctgaggtcaggagttcaagaccagcctggccaacatagtgaaaccccatgtctactaaaaatacaaaaattagctgggtgtggtggcacatgcctgtagtcctagctactcggaaggctgaggcaggagaatcacttgaacccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttatacagtatctgccaatttcactgtctgtgcttacttttaggttattctttgaatttcccttagatcatagctcttcttgattaggaaacaaactttccctactttaaatagtctcacgtagtcttgtggcaaaatttaggctgcctactgagtatccagtgcagtataaagcagtgaagaagttgagttgtagtggcgaatcagaattgacataactgtaagatagctctttaaagaagagcatatggcaagaagacttaagttgtggtcatgtttgtgcttaccatgtaatatttccttggttttacttttcctgtttatagtgatagtgggaactgaagagagaagccagagtatattctaattgtagtaaatggttcttttcattccctcccttcagttgccagaactgattttgctctgaagaagtagtttatcaattggagcttctgaaacatctacttgcctcaactcttccctagacctgctgtgccagatggtctagggattgggttctgagcactttcactttataaaaaaaagcttcataaaggacacttatacccatacctgattaaaaaccactgctctgggaaaaaaatgtaattcaaattccagttctggagcccatcatatacctgggatattgagttaaacacaagtagatataggtaattgtactggcaagaagtaaatgaggcatagaaaatataacacaatttcaaataaggtgtaccacttttactctcatggtatcctctgctccatgttgtctctgcaccccagtgtactgtgggagtttttgtggggttttttgggttttggtttttttggcttatgtttttgtttccatccctagagtataagtttctcatgggcagggactggttgttgtctatttctatatcagagttatcagatacaactcagagaatactgaaagatagttaaatgtaaaaacacattcttctttgtagctgccatatgattatgacctttaggaattctgtcttcatgttacatcttacaccactacttctgttgttttttaaaattgtggtaaaatacatataacatgaaacttaccatctgtttttaaatgtgcagttgtcctattaaatacatttacattgttgtacaccatcaccaccacccatctccaaaactcttcatattgcaaaactcaaactgtagtcattaagctactccccattctccctccccacagcctctggcaactactattctttttgtctctatgattgactactctacatacctcatataagtgattatataagtgaaatcatacagtgtttgcctttgcatagctggcttatttcattttaaagtctaagtaatattccattatatgtatataccacattttccttatccattcatttgtcgatggacatttgggttgcttccccatttgagctattgtgaataaggctgccatgaacatggatatacaaatagctgtttgaggtcctgctttcaatatttccaggcatatgctcagaagtggaagtactagatcatttggtgatgctatttttattttattatttattatttttttcagacagagtctcactctgtcacacaggctggagtgcagtggtgctatctcagctcactgcaacctctgcctcctgggttcaagcgattctcctgcctcagcctcccgagtagctgggactacaggcacgcaccaccataccccgctaatttttgtatttttagtagagatgggatttcaccatattggccaggctggtctcgaactcctgatttcaggtgatccacccaccttggcctcccaaagtgctgggattataggcatgagccaccatatgcggccaaattttttgaggaactgttttctagagtgactgcaccattttacattcctaccagcattgcacaagagctccaatttctccatatccttgccaacacttgttatactcactcgttctggtagttgacaccctaattgagtgtgaggtagtatctcatggttttgatttgcatttaccaaatggttaacgattttgagcatctttagctgtgcttattattggccacttgttgatcttctttgtctatttttaaattgagttgtgttgttgagttttaagagttctctgtatgttctagatattaactccatatcagatatgtgatttgcagatactttcttttgttgcctgtacctctgatgtcatatccaagaaatcactgccaaatccagtgtcttgaagcttttgccctatgttttttttttttttttaacagttctgtggttttagctcttacatttaggattttgatccattttgagttaatttttgtatgtagtgtttcataagggctcaactttattcttttgcatgtggattatccagtttacccagcaccatttgtggaagagtactagtcatgcaccacataacaacgtttcagacaattacagaccatatatatgacagtagtccaatgagattataatgtcgtatttttactgtaccttttctatttttagatgcacagattcaccgttggtttgcagttgtctacagtatgtagtacaataacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttgctcttgttgcccaggctggagtgcagtggtgtgatcttggctcactgcaacatccgcctcccagattcaagtgattctcctgcctcagcctcccaagtagctgggattacaggcacccaccaccacgcctagctgattttttgtatttttagtggagacggggttttaccatgttggcccagactggtctcgaactcctgacctcaggtgattcccatctcagcctcccaaagtgctgggattacaggcgtgagccactgtgcccggcccctacctatttctttctagattgttttgaagcaaatcttagttccatctgtaaatacttaagtatgtgtctgtagtgtctgtctcaaaacatgatcatgataccattatgtttttttaaaattgcttaatatcaaatatctctgtcagtgtttgaatttaccgagttatctcataactggtttttactgatattttttaaaaataagattcagttgaggtccatttaccacaaatggttggtaatgatcttgattattcatctgtttcttttttccctttacaattatgggggaatcggaggacaaatagtttagcatgtaaattttcccacagtctgaattttgttgatggaatccctgtggtcgtttattattttctgtttttcttggtcacctgcatcttctataaacaccttatgagatctagaggcttgatcagattgtggtattatttttctttttgtggaatggataggcaacgctacttcataggggataatgtttatctccatgaggagtgacattataatgtctgtcttcttatgatgttaacagcaattttttattattattattatatatatacaatttttttttttcccctgagatggagtctttgctctgtcgcccaggctagagtacagtggcgtgatctcagctcactgcaacctccgcctcctgggttcaagcaattctgcctcagcctcctgagtagctagggttaacaggggttacaggcgtgggccaaccatgcccggccaagttttgtatttttagtagagacggggtttcaccatgttggccagtctggtctcgaactcctgacctcaggtgatctgcctgcctcccaaagtgctggattataggcatgagctactgctccctggcctttttttttttttttttttttttttggagatagagtcttgctctgttgcccaggctgaagtgcaatggctcgatctcagctcactgcaacctctgcctcccaggttcaagcaattcttcagcctcagcctctcaagtagctaggacgacaggcccaccacaccccgctaattttttgtagttttagtagagatagggtttcgccgtgttggccaggctggtctcaaattcctgacgtcaggtgatccacccgcctcggcctcccaaagtgctgggattacaggcgtgagccactgcacctggccaattatcattatcttaatacagtatttcttcagggttataaaataacaatattttattttttcatttaatagctagaaaagatctataaagggaaaattgccctcaccattttctttttaagttagaaaactcagattacatttttatcttgtttcctttgactttaagtcagtactacgtcatgcactgtgctaaaataactacagtacaaccacgtaactcttactgtgtatgaaaaggggtataattctttatagcagtgaggtttggtttgttttgttttgtaagtaatcctccttggaatcccttcaaggtgcttcccggccagctgagaggagcggggaacgaagggtcacctgatactctgatccgccttcccttcttctgacaaagcagtataaatttcttttcctcccctaactaggccctctacttactctgtactagtgtcttgcgtggaccaccctccctcccatctctcattttgcttttagtcccgtcacccagcataccattctccctcctctctgactatttcagttctgtcttctttccctaggttattccaattccatctctgccttaaggctattttagcatttctgtttatgctcttccaaactgaagaacacaaacagaggcttatactgggttttttttttttttgagacagagtctcactctgtggcccaggctagagtgcagtggtgtgatctcggctcacggtaacctctgcccgctgggttcaagcaattctcctgtcttggtagctgggattacaggcgcctgccaccatgcccagctaatttttgtatttttagtagagactgggtttcaccatattcatcaggctggtcttgaactcctgacttcaggtgatccacccgcctcagcctcccaaagtgctgggattacaggcgagagccactgcgcccagctgaggcttacactttttaaactttcgtcttgtcattcagttacaattttttctcttgtaatgcctttgcttttttgacttttcagttactcgctgtgctagtggagctcggtttgtatagactagcactttggattatccacactttagacacataatctactcttgacacaagcgggttagttaactacacttcctcaccccactcttttattttgaaaagtttcaaacctacagaaaagatgaagaagaggtataattatcacctttatgttatattctttatgcggttttactaattaacattttgccatatttgcttatcttgccatatgtgtgcttggtttttggtttattttttttttaagttttgtttgtttgtttgtttgttttttgtttttttgagatggagtctcgctctgtcgcccaggctggagtgcagtggcgtgatctcggctcactgcaagctccccttcctgggttcacaccattctcctgcctcagcctcccgagtagctgggactacaggcgcctgccaccaatgcccagctaattttttgtatttttagtagagacagagtttcattgtgttagccagggtggtctcgaactcctgacctcgtgatccacccggctcggcctcccaaaatgctaggattacaggcgtgagccaccgcgcccggccttttttcttaagttgatagtgaagttgcaaacaggacgcttcaccccttcatacttcaacatatatcttataagagatcatatatcagaataaggcaattttcctacttatgtatgatacagttatatccaagtaatataataacgatttttaatctctaatattcatcagtatatattccgatttcccaaaagtggtctttataacttatctctctatcccaatctgatactcatgaaggaatcacaaggatttggctgttagctctttagttgccttttatgtaaaataatctccctaacttgtgacttgtatcgcactgaaatttttaaagaatccaggccagttgtcttgcagaatgtgttttttgatttgtgtgattgtttcctgatgattagctttatgttaaatgttgagggggtgggggcaataaaactacataattgatgttttgtgtttctcactgcactgtattgggaggcatgtgttatccacttaattattaagtgatattaattttgatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatttaagagtaactagatctgatctttttactatttataatccaaaatttaagcaaaatgaaagaaataaaatagtgattgtaacatccacataagagtgagatccaccacctcatcttaatagtatctttaattggattcaaaatgcatgcatgtgtcataccacctgaagcaaccatccttcctggagccgtactatccatcaattacaccactagttttgtggcagttctttgccgctagagtactagttttactatgaggctcactctcttaccccactacattctacagggaaagcacattctttttttcctactttttccatgtaattgaggaataaaatctcggttttatatactgttgtttgtggtcttgttgcttttttttcccctgaaaaatatagttgtacatattgttctgtgaatgttacatgttacatgttttatttcattcatttcttaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtaagtactaattacacattgaaagtatatgttgtaccatgtatatactaacagaaataaaatttttactagtacttaacatacaaaagtggagtatatcactgattactaaatacctgaaacagaatgatttatatactttgcataccttactgctgtggggcttttttttgtttttgtcagttaacttttagttccttctactctgcctgatctcttagccattttattatattatactcttacagtctctttcttcctttcctttcctttcctttctcctttttcttttcctttctctttttttttctttctttcttttttgaaagagacaaggtttctctttgttgcctaggctggagttcagtggcatggtcgtaactcatagtaactttgaacttgtgggctcaagcaatcctgctgcctcagcctctcaaatagctgggactacaggcatgtgccaccacacctggctaatttgtaaatttttttagagatcgaatctcttgttgcccaagctggtctcaaaactgctgacctcaaaatcagtcgtcacacctcaacttcccaaagtgttgagatgacaggcgtgagccactgcgcctggcctactcttacattcttttacagaagattattcctgaggaaataaaatggcattttgcatatagctacaggtgttatttataaatttgccctttatcttagaacttgagtgattataatagtgtaaatacagtaagtttagaagatgacaaagctatggtagtatttcctatacaaatgaaataatgacttttaaaatagcattgattattgtcattatctttaaggtatatttgtatacaaaacatatcaaacctattgtaaaaaaagattttacccccgtccgggaggtgaggggtgcctctgcccggctgcccctactgggaagtgaggagcccctctgcccggccagccgccccgtccgggaaggaggtgatggggtcagccccccacccggccagccgccccgtccgggagggaggtaggggggtcagccccccgcccagccagctgccccatccgggaggtgaggggtgcctctgcccggccgcccctactgggaagtgaggagcccctctgcccggacagccgccccgtccgggagggaggtgggggggtcagccccccgcccggccagccgccccatccgggaggtgaggggtgcctctgcccggccgcccctactgggaagtgaggagcccctctgcccggccaccaccccgtctgggaggtgtactcaacagctcattgagaacaggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttaggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcaagaaacacccaagaatgatcaattaaaaaaaaaaaaaaaagcctaaaaaaataaaaataaaaaaagattttacaagaaaaacattgacaaaacaaattgtttgacttgaaaattgattaagggcttctattagaaatagttaatgagttcattactgataaatatacatgcctgtcatatggaagttttactttgggacttgttataatatggattaatgttgatttgcaatcgtttttcaccaaaatgtcacagtaagatagtattttctacaatccaaactgtattaaatatagtcatgggttgagtacacatgtggtttgtgggggtgttttgtttttgattaccaggaaatgattgggtgagaggtaatactatataaatgagaaatttctagcaagttatagtcttaccactcattcataattagggaatatacttattcacttagcctaggcaacttttagtccttttgaaaggccttttatattaggtgaacaataaaataaaattttaaccttgtttttaattagtgataaaaacagccaactttggggtcatttgttcatgttactcctccttagttttagacaattttctaaattatttggaaatcactggttttctttggcaagtgaaatgtcaaaagattatggtcttgaaatcagatccttatacctgatcaacagctaaactagtcttatttttttaactagctgggcatgggggtggactcctgtagtcccagctgcttgggaggctgagtcaggaggatcgcttgagcccaggagttagaagttccagtgaactgtgatcatgccactacattccagcctgggtgacagagtgagacctcacctcattaaaaacaaaaaagaaagaaactctactttgagtgcccatacaaccattctgtttttcactctcagtacagtattcattgaattacatgaatctttgtgttacaagattttgcccaactgtaggctaatataagtgttctgaacacatttagggtaagctaggctaaagctatgatgtttggtaggttgggtgtattaaatgcattttcagcttatgatattttcaatttatgatgggtttattgggctgtagccatttcataagcaaagagcgtccgtacttgctgcagagaccatatgcttcacaaagcctaagataaatttactatctggccctttacagaaagactttgctgtcctctaatgttagaacaccttctttttatagatgttgaagaatatcctacttttgaagtgtagtctaagatctaacttttttccctctatgggctgttccctgattatatagtaaaaatttgcttaatacctgctttatattccattcatataatttataaatgcctttgtgtaccttttttccggagtttaaaattccttaaataagggactatcttaaacagtgaatatccctcagtacttttacacatagaaagcactctcagtctatccattggatgaattaatggttaataatgtattcctcacatcccttgttttgcatttatgcatgtgtctcaccagaaattggaaagtctctttggtagaaaatgaccataaactgggattctagctccttctcaggttgctaatcctgtactcatttgtgtgtgcaaacttttgctttactaaggcttccattacagaaaaggaagaatatataaaaatttagcttattcgtagtttatcattttcagaacttaataaattcatgctttggcttcagcatgaattactatctaaacagataacactagaagcagcatcgtatactacaaagagattaagctgtgagcccagacagattcaactttaaaataccatttcacctaataatcttgatcaagttaacttttttattgctaacattctatgacttacgggtttcgcattataaaaatggcaaatgtatgggtgcagcaaaccaacatggcacatgtatacatatgtaacaaacctgcacgttgtggacatgtaccctagaacttaaagtataatttaaaaaaaaaaggcaaatgtagtttacattaagtccataactaaaatgtttacaaaactaagggataaatcctttttttaaatcgtttttaggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggtacgggctgtccagttttgtttaattttgattacatttaatggatttagaagaaattggtttttttggttcatcctcacaagtcaccctatttttattttctcctactttggtatagtggtagcagagaagtagtcaatatgataactaatagaaggtttggcaaggaaggaaaaaaagtagtgccaaaggggctaggtaaataagataaaaataggtaaataagagtgaataattttaaaagtcataacgtgatagcacattctcttatataagttacacagacactttccatctctaccgagaaacaaattgccattgaacccctcaaagatacagagctgatagaggaaaacatttctcctgtcatgtccaggattacttgtcaagaccaaaacatttgctgaaaccattaattactttattgaaccacataagatttcttttagactagtcaagtggcccataagatttcttttatcacctatgttataaaaccatttattttggaaacttattagcagttctttgagagagatgattcacacgcattatagtaatgaataaggtgtatctttgggagctcccaaaccctttcaccctcaagtcacttgtgttgttttggccttatgcaccacttagagaagtcctgaagtttaaagattgagattgtgggctgtaaagccatactgcctgccacctgcagctcctgagacctgaggcaagttacttgacctctctgtgattactagttttcatcttttaaggttcagtagtacacacttgagaaggttgtaaggattcggtatgtttttacttgtgcggcacttagtatatattacctggcatctgaattacccaacaaatattagctactcttattgttattgtagttctttggtttgtgcataggaaaccaccttcgtgggaacaacagtaaacatcaaacaggtaataatggctagataacaatgacagaaaccagtcaacaatttaccatttgcatattattaatttcagcatttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccggtgagtatcaagagagtttagcttcttagtaataaagaataatttatagtaggcgtcaacatgtttaagttcataaaattaatgttttcactttaaatgagtctaatttgctgggtgtggtggttcacgcctgtaatcccagcactttgggaggccgaggtaggtggatcacctgaggtcaagagttcaataccagcctgaccaacatggtgaaaccccatctctactaaaaatataaaaattagccaggcatggtggcatgcacctgtagtcccagctactccctgtagtcccagctactccggaggctgaggcaggagaatcgcttgaacctgggaggtggaggttgcagtgacccaaattgatggccactgcactccagcctgggtgacagtgagtctccatctcaaaaaaataaaataaaaaaataaatgggtctaaattaaagtagcctgagaagggttcttaacaaatttaggacttctcaaaattaatggaaacacagacttgtttgaaaatggggttggaaaataaaaatgtgtttttatatctgcattttatttatagggcaagatcacctgttgcctgaagcagaagaaatcactatgatcagtattcaacttgctgctaggttcctctttactacaggatttcacacaaagaaagtagtccgtggctctgccagtgattggtacattgctttggattttcattcctattatactaatgtttggtttgcttctttaatagattgctttatgtttttctaaaccaagagaattttgtttgaagtttggaatatagaataaaaactctgggtcacaatagagaaatcatattaaaatagttacttagtctaaacatggccttttgttattcagaagctgacttctgcttctattaccttgtatcatatctttgacatccctgcaccaaagactacaagctgagactgggggacagtgactcacacctgtaatgccagcactttgggaagccagggtgggaggattgcttgagctcgggagttcaggaccagcctaggcaacatagtgagacccccatctcttcaaagaagattttaaaaattacccaagtatggtggcgcacacctgtaatcccagctactcggaaggctgaggtgggaggatcgctggagcctgggaggttgaagctgcagtgagccatgactgtgccactgcactccagcctgggcagcagagcaagaccctgtctcaaacaaaaccaaagattacaagatgagactgaaaagtgtaagctacttatgaaatttattaggttttagcttacctagattgaattctgacaccgattaaaagggtaaaaaattaaaatggttttcttaagtttctaattgtgaaagtatagaggccattatgatacattgatttaataatttttacttactcatttcaggaatatgtcaagataagggggtggtattttgtcattgaatctaggaagagtttgttaatggatttttagaggacaagctttcacctgtttggtaactctgagagaatagaccaagtcatagtatttatctattgttttaatattagaagcaacctttgctggttctctccagcagtagaggaagatctttgtcttttttttttggttcaatgagactcatccttttactatagagaacaagttattgacttaatagtcataggtttttttgttttattttaggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggtaattgcacagctttctttctaaatgatgagatgtttacaaataaattgtgtttcctggaagtcgaagtcacaagcatatgtgcatccacttgatatgtttacctaacagaaacacacaatatgatgtcagtgagttccatttaatattactgcatggcaatgaatagtaattattggctctttaaaaatgtaagagaattttctctgttcggttacatgcagtagcttaattataagtttactgttaagtagattttttcctattttgaaggttttttaaatagtcttagatttttttaaaaaattacaagtgtaaaaaattataatgaaatccgcctctgatcttcattccctttcccaagaagcaaaatagtttagtttgtgtgatcagtccttccataaatgtatgcctgtatcagcatatgtgcatgtcctttttatgcaagtagaagtatacatataccttgttgctgtaaaacaggtaatgttttatcctttacaggcttatgacaacttaagcttgagtgatcacttactaagagcagtactaaatctcttgagaagggaagtttcagagcatgggcgtcatttacagcagtatttcaacctgtttgtaatgtatgccaatttaggtaagaatttaagtttttcagaattctgttttgatgtatcatattaaattgtgaagtcatttaggtcaagtgatgaaatataatctgatctgaagtagaaacaatttcccataaaacctgttgtgaattttatctgaacatggcactttcaccttttactttgtttatgcatgtgtctttgtggtagacacaggtcagaatctgtgttttgatttttttttttttttaatctcctaatgcagtggtgccaaatctggctgcttttggaaaatactggtttctaggcctcttctcacactgattgaatcagcatccccaaagctaatgtcagggaatccatgttttcaaaggggtccccaaatggttgtgatactcaccaaatttagatagcagacttggtctgtacataagtttttgtttaagtaaactacaattatggataatataaatactcgcttaaaatattaatttaggggccgggcacaatggcttatgcctgtactcccagcactttgggaggccaaggcaagaggattgcttgagcccaggagactaacctaggcaccatagggagaccctatctctacaaaataaaattttaaaattagctggatgtagtggcatatgcctgtagtcctagctacttgggaggctgaggtgggagaatcacttgagctaaggaggttgaggctgcagtgacccgtgattgcaccactgcactccagcctgggcaacagaatgagaccctgtctccaaaaagcaaacaaaccaaaaagtcatatatccaaaatgaagttctatatccaggcgtacctgtcgtttcaggttttttttctgtgatcttacttaatcaccattggatccatggcccttttaacataagggagattgtacttttcatttgtctatttagtttgtcttcttttcccttgtcttttccgtaattgcagatatttgggtatttgtagatgagaaagagaatatttattacacagacaagcataagtggaatctgtatttcaaacttaaaaatgccaaatttagacattcagaagaatcctattctgttcaactcttttagatattgcctgttcacaaagcacacatcattgttccataatgtaacctacttgtaaaattttcctgctgaaaacaaatactgtagggcctgtaaaccttaatatgaagtccttaagatcagatatgcattgggattgagaattgtttggatttaagaaaagcaaggcagtgcatataccaacatctctatagcagggtctgagacaacaacttacaattgaacacattaatatttctacagtaaaatatgaatatttatactgaagggagaaataaagactataagtagcctttagtcagtttgggctaggttatcccaccaaccacattttgacagcaacttaatgaaaaactttgttgggctgggcgaggtggctcatgcctgtaatcccagcactttgggaggccgaggcaggcggatcacctgaggtatggagttcaagaccagcctggcaaacatggcgaaaccccatctctacttaaaaatacaaaaattagcagggcgtggtggcgggcatctgtagtcccagctattcgggaggctgaggcttgaatctgggaggcagaggttgcaatgagccaagatcgcgccactgcactccagcctgggcaacagggcaagactccgtctcaaaaaaaaaaaaaaaacttgttataataatagcttttgggccaggcgcggtggctcacgtctgtaatcccagcactttgggaggccgaggcaggcagatcacaaggtcaggagttcaagaccagcctgaccaacatggtgaaaccccgtctctactaaatatacaaaaattagccgggcgtggtggcacatgcgtgtaatcccagctactcaggaggctgaggcagaagaatcgcttgaacccagaaggcggaggttgcagtgagctgagatcacaccactgcactccagcctgggagacaaagcgagactccatcttaaaaaaaattaaaaattaaaatagcttttggaatcttaggatttcagataagaggttgtggacctgtttttattatgtttttgggaatatggcaataaataagattgtctaatgggatatagaagcaaataatgtagttgccataaaatatgttaatagctataatagggaaaatgcaaagtgcatcacggggggcatggtacctgaagggatttggggagtgcagaagacttaatggggaatgtaacgtgggaattggttagttgagctttccatctagagtgtgaacagcagatgcaaagacttgataaacttggcgtggcttattggatgggatgaaaattgtccagtctgactagaattgatgtaagatgggaatggcaggagtttctgatcatgcagttctaataggccttgtgagagagactgaggcattggatgagccattgtagggttttgaacagataataccatctagaaagagcactgtggccacagtgtggaatgtattgcagtggagtaagatcccagagagtgttaaaatgatctatagacataagatcattgtgacctgtactggagaactggcagtgagggagatacaagtggacagatagatatatggtgctttttataagaagtggaatcagtggatttggtgatgggatattcagagaaggaggggacagggaagagatgtgaagaatgatgcccaaaattctaacatgaacaactgtgagtggatagtggtaccatttactgaggggaaacacaggaggagaaacatgtatgtatgggaagaaaggggtgagttcagtttgggtagattgagtttgagcctgtgtgacacccaaatggagatatacagtagaacagtaagtaatttgtcttgaaatgtttttgaatcatctgaatgaagatatctagaacattaaagccgtgagcgtgggctagatcatccagggaaatcagtgtgagaagatagcctggcatgggaacttggagaaacatcagtttttaagagacaaggaggagtcgcaaataagaacaaaaagaggtagaaagaaaatcaggaatccagggaggaagaagtggttatggtttgagaactgctccttagcttattactgtgaagaggggccaaaaccaaattggcatgagttgaggaatagaaaatgagaaagtagagagaccaaatgtaggtatctttttcaagaagtttggctgtagaggaaagaagagaggcaggcaatttataaaagagtttttgcttctcatttaatgtagttattttgttgttttcatcctccttacaaatgagggttgcagtgttggttagtccctttagactctccaggctgtagaaagtgttcgtcttctggtcgggcgtggtggctcataatcccagcactgtggaaggccaaggcgggcagatcatgaggtcaagatatcgagaccacccaggccaacatggtgaaaccccgtctctactaaaaatacaaaaattagctgggcatggtacgtgcctgtagtccagctactggggaggctcaggcaggagaattgcttgaacccgggaggcagaggttgcagtgagctgagatcatgctactgcactccatcctggcgagagagcgagactgtctcaaaaaagaaagaaagtgttcatcttccttacagtgagccggtgtgattggaatgtcatagtcatagtcactgttgaacaatgttaatacttatactcaatgggtgagttttcttttctagtaaaataattctctgaatgctaagtaaaagtgataaaattacaaatcaaaatttttctgatcataaaaattatagacaagatattttgtataactacttgttttattcatgaagcccttgccatcttaattttttcctcatatttttctccctctctttcttctccccttcactcctttttgttgtaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaaatttgaatgctccattctttacactagttttgtttgtttgtttgttttgagacagagttttgctgttgttgcccaggctggagtgcaatggcgtgatctcggctcactgtaacctccgcctccctggtttaagccattctcctgcctcagcctcccaagtagctgggattacaggtgcccaccaccacgcccggctaattttgtatttttagcagagacggggtttcgccatgttggtcatgctggtctcgaactcctgacctcaggtgatctgccgtcctcggcctcccaaagtgctgggattacaggtgtgagccaccatgcccagccctctttacggtagtttttaaatgctgctgggcatatatagtactaagagtctggaggaagatttttgctttggaatattttagccctgtaccttttttacgtgtttaatgggggtcttttttctgtctccttgtgactgaggttgataccatgtttatgaaatagtttaagaattaactttttaggctgggctcagtggctcatgcctgtaatccctatgctttgggggaggccaaggcaggagaatcacttgagctgaagagtttgagcctgggcaacatagcgagacttcatctctactaaaaattaacaacaaaaaagttggctgggtgtggtggtgtgcacctgttgtcccagctactcaggagactgaagtgggagaatcacttcagcccaggagatcaaggctgcagtgagctgtggtcatgccactgcactccagcctaggtgacacagtgagaccctgtgtccaaaaaaaaaattaactttttatatttagattttgtatttttatatcttggtatatctatctgatcattataatgcataatgttactttcttcgttgtgcttaggtaacttgatttaaaatgttatttctctaaaataaaacatttggccagacatagtggctcatgcctgtaatcctagcattttgggaggccgaggtgggtgggtcacttgaggtcaagagttcaagaccagcctggcaaacatggcaaaaccccgtctctacaaaaatacaaaaaaattagccaggcgtggtgacgtgcacctgtagtcccagctactcggaaggctgaggcaggagaatcacttgaacctgggaggtggcggttgcagtgagctgagatcgccccattgcactccagcctgggcgacagagcgagactccatcttaaaaaaaataaaaaaaaattataggctattttctatcgtgaaagttgtgtattattattgtgaagaagcttattagttttttattggtgacaaatctgtattctaggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggtaaaaggaaaataacatttgtatgtttataatttgatttgttattcctttcattaagttactcaccatgtcttacttgtttttaggttgcatattcctatacctatgaactgcggccctatttggatctgcttttgcaaatcttactgattgaggactcctggcaaactcacaggtggatactctttttgtgactggaaacaattaggcttgcccaggtgttagagttaactgaaattgacagtcaccacattttttttaacctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgcccgaggattattttatgattatattacatttgttttagaattagtcacttgaagcaacttagtcattagtcacatgaagtataatagtatatgtaaaaagtcttcaggtaagtacggtttccatttttcatggtacttatattctgtaaagtcaccacagacactgagttagcaaatactgaaccattactcctaggaggaaatacagaattaggtttctataagcctctgtttacatttttatcaaccagtcaatacataaccttgttgtatgtgtgtttctacttaaagtcatttaatatattttgttgactcataaagttcacagccaacagctctgtaacttaagcctgaacttaagcttctcaatgcattctgcataaggcacatcacagccttcttgtggttaggaacattagatagcacttcaacattatatacttgggtcattttaaacataaaaataaccagcaaaagcacaaatatgtggaaaatgtggcactaaatacaccatgaagaaggacacttgtttacagtttaagctgaaacaagagagaatgacactcttctggacttcagctaggaacgtttgtgttggacaacttgatatttttgctgctctgtatatgtccacagatgacgaagaaagcaccttgatgattgattttgcagttataaataaagtttaggaagtaagcgaattcacaaatgtggaattcatgaataatgaggggatcaattataattagtttttatgagaacttttagaatgttaacttttttcccccgtaaaaactaaggttatccagcttaactggccctcaaactttcactagaatttttctatttgtttttgggggtttttttgtagtaaaagttgaatatattatctttaatcccaagagttatataatagatgataaattatggtattagttgacagcactgccaggttttagaacttcccttcccacatggaagatagtataatagtttgtttgggaaaacaattcaaagtctatgtcgcagtttgcctcccatctgccaaggtaataaaacaaacttaaaaacaagttctgtaacaacaaaatgcttaaagagaagtaacaatctggagttttagtggggattgcgaaagccagaatttgcaacttagtattttcaaattatctccaaatttaccataatagatttcaaacaaatactgtaaaaatagcattaaaccaaaaatcaattttcgtgagacacaaaagatagtagctcagaattatagtcgtttattcaggcagtattcagtgcccttctaaatatgttcataggatttgaaagcttccttcagagtagattttaatgaaatctaacttttactattttcttttttaaaaatgctgtatttctgggcacagtggcttacccctgtaataagcactttgggaggccaaggcaggagaattgcttgagaccaggagttcaaggccagcttgaccaacatagcaagatcttgcctctatttttttaaaaaagaaagtactgtaagcacttacagttttaaaccagttaatcacatcttagctcttgtttgattagagcaagtgataatggcaaagacatacgtgctagattaaatgtgggaattacacttttgtgtaatgagattagtaagatactgttaaatgaatcactggcccaaacgtgaaaataattttctcataatgagcttttagttcattcagtaaacaatgttcaaatatttatagagtgtctaccatgtgcccagcactgcttggcatcaggtaataaggcaagtgaagatagtattaataaaaatggcatttgagagcagttgatgctaatggggagaaaatatgatatggcagaaataatgatttagcacttcattgttacttgaaaaaactgaaggtaaaagcaatttatatgtagtgtttcagatgaaacagcaagagggcctgaacatggttgatttgtctgaaatgattaagctttgcaaaattgttgaagtaatctgttttgtttggaaatcatgaatgcatttgatggaggaaaaaaatcttactttgactttaaacatactgttaagtaaaatacatagtgtatattagaatctttaaattctcagtgtccaggttatgttttctaattgaggtaaaatttacataacaaaactcaccatttcaaagtatacaattcagtgacttttagtacattcacaatgttgtatagccattaccactatctgattccagaacttttttttttttgagagggagtctcactctgtcacccaggctggagtgcagtggcgcgatctcggctcactgcaagctccgcctcccgggtttacgccattctcctgtctcagcctcccgagtagctgggactacaggtgcccgccaccatgcctggctaattatttgtatttttagtagagacggggtttcaccgtgttagtcaggatggtctcgatctcctgacctcgtgatccgcccacctcggcctcccgaagtgctgggattacagatgtgagccaccgtgcccatcccagaacatttttttttattaccccaaaaggaaacccctacccaattaagcagtcactcaccattccttctaaccctggcaaccactaatctgttctctgtctctgtggatttgcctcttccagacatttggtaaaaacgaaatcatgcaatttgtgtgtctgacttctttcacttagcttaatgttttcagagtccatccatgttatagcatgtatcattactttatagctgaataatattttgttttatggatatatatacaccacattttatttactggcacataatctttttaacacaaaagaaacaaggcatgtttgtgcccctacaatcatgttttaagttagttagttcagggaaagacaggactagttggctttgtattattactctgttgtagtttgggagaaactgaaatgaaatcctgtgttattggcaaatcagccaaattgtactattgcctgtcaaaatgctttgcctgccatgtattctcattattagaattcaaatactgtacctccaaattatgtcactgaatcctaacttgccttcagagatgcagttttataaaaggtattgatgtgtagcaaattaccctcaactacagcagtcataaacttagttataacttttttaaagtttgcattactctcgagtgtcctgaattcacttcaggtaatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatcccagcactttgggaggccgaggcaggcggatcacgaggtcaggagattgagaccatcctggctaacacggtgaaaccccgtctctactaaaaatacaaaaaattagctgggcgtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaagacattattgagtggcacatagtaggcactcagtatatattagctattagattttagatgtttttattttatatctggttctctttcagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcaggtgaggatttttttcttataattttgtagaaatcttaatcagaattaaggattctgttttaaaagaagagaatcatgagaacttggggttgtcattttaagttaactttgaagtattccaaatcctcttatctatatggttttattttcttttgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagtaattctttattttataggccagtgtttatgtattaatgatattattaaaagattatgttgaagttttgggttttgaaaaatgtttattcggctgggcatggtggctcacgcctgtaatcccaacactttgggaggccgaggcaggcggatcacctgaggtcaggagttcaagaccagcctggccaacaaggtgaaatcccatctccactaaaaatagaaaaattagtcgggcgtggtggcaggcgcctgtaatctcagctacttgggaggctgaggctggagaatgacttgaacccaggaggcacagattgcagtgagcggagatcgtgccagtgggctccagcttgggtgacaagagtgaaactccatctcaaaaaaagaaaagaaaagaatgtttattctatgtcattttaagctaatgaagggagctttcttttggagaaatttctgtgaaattgcctgaaatgtagtagttctgagagaatgcaaatcaggttttttgttttgtttttttttttttgttttttccccaagttctttatctgcagtaaaagaaaagttgctaatgggtcagttttgtagatttttaaaatttatttcaaatagaaaaagttaaaagtaaacttgagtttgcctacgtaattttttatcttgaaatattcaaaattaggagccagatgaccaagatgctccagatgaacatgagtcgcctccacctgaagatgccccattgtacccccattcacctggatctcagtatcaacaggtaaacaggagtcagtttatgcttttatcccctagaactgggttttatgcttaattttagaggatggctcaattgtttgttgtgactacaaagtaagaagtaggattatctagactagctttgggagcatgatccagaagagggatggtttggagtgggggtcatggtgtaacatgtttgaacttaaccactgtagggttttccttgtcaagaaggtgtccttcttgtgctagtagttaataaaactgtatgagaatttatatcaacataaaatgatcattgtttagtgcaaaggattgtggtgacatttccggtgaggtaaaatcttcacctggattccaaaaacattattaagatatggcaatgaagtaagaagtccttggttacttagccacaggtttcagtgatggtaaaaatcactggaaaaaaaaggatttgggtagatttccataggtgattaaagtaaataaactagtaaatagcaaaagaaatgagatgaagaaacattctaaatgataactttttctttctgaaaccaaaatgtgactaaatcagctcttgtgaggcagtggtactcaaacttgcacaggcgtgagtctccctggaagggttgctccagcagagagctagatgctaccctaaagtgtcttatttcataggtcttcaaggggctggaaaatgtacatttctagcaagttcccaagtgatgctgctggtggtccaggaaccatacttggagaaacatttcaggcattctttcttacatttcactgtgtacatagaagcaaactgaatagttaggaagtacacattcagcgtacttattttcatctatagaaagtaaagcctggccaggcgcggtagctcatgcctgtaatcccaacactttggaaggctgaggcaggtggatcacctgaggtcaggagtttgagaccagcctgaccaacatggagaagccctgtctctactaaaaatacaaaattagccgggtatggtggtggcgcatgcctgtaatcccagctactcaggaggctgaggcaagagaatctcttgaacccaggaggcagaggtggtggtgagtcgagatagcaccattgcactccagcctgggcaacaagagcgaaactcccatctcaaaaaaaaaaaaaaaaaagttaagcctaaaatcttggcttggctgatggagcatgtacagaaaaatgagagcactgtagggttcagacattttaaaaggttaaggaaccaaatccacaaggaaggttaacttcctttgaccctgagaaagctcttatgttaatcatgcctggttactttatcatcttgaacattgttctgtttttaatcagcattattgtgagttcagggttactgctcctatatatcttacatcatggttagtcaatcggatttagcatgtggaagagtcaatagatgctcatagatcattctctgaaaattttttaccaagagcaacagtgggttaatcctttatttgccagacttgagtctaaataatttttggcactaaaaatcactttggccaaagatttatgtggacctacacaatcactgctcttattcagggttttggggtttgcatttacactacgtttttcaagcctttttttgtttttgtttttgtttttgtttttgttttgcactatagtagtccaagggtatttacagagtaagtcccaagaataagagtatacatttccagagacttcagaccatgattttgaagttgttttactatgtgaaaagttttaacatacagatcttttctcctttcccagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaagaggactgcatattaaaattcattctgtgcatagcatgcctaggcatgacactgattcaggatttcagtcacatcaagtttttgtgcacagaaagatttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaagctttgggtatcttatttgtagtactgtatagtcaacctgtgcttctaggtgttcctgtaggacattttgacaccgatactttgagtgaaagtcacacacggtgtttgcaattccaactgatttttgttttgtttttatttttttgttgttttcttctttgagatggagtcttgctctgtcacccaggctggagtgcagtggcacaatcttggctcactgcaacgtcgcctcctgggttcaagcgattcttccgcctcagcctcccgagtagctgggattagaggtgcccaccaccacgcccagctaatttttgtatttttgtagagacagggtttcaccacgttggccaggctggtcttgaactcctgacctcaggtgatctggccgcctcggcctcccaaagtgctgggattgcaggtgtgagccaccgcgcctggccccagttgatagtttttttaatttaaaagttcctcaattccaagctctttaaacgagtgaaataggttaactttatttggatgagt

SEQ ID NO: 17562 - DNA, 113379 bp, Human; identical to SEQ ID NO: 17561

SEQ ID NO: 17563 - DNA, 71278 bp, Human; identical to SEQ ID NO: 11851
  misc_feature (1)...(71278): n = A,T,C or G

SEQ ID NO: 17564 - DNA, 10586 bp, Human
acacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagagtgagtgcaaggttttatgagtggaattagccctcagcagatgggggagccagaaggcagttggagtgggaaggtgattttcccctggagtcgggctgctgagcagcctgggctctcctctgaccgcccctgccaaactcatggttccatcagttgatggcctgctggtgcctgttggtgtgctttccacgtcctcttgacgtccagcggcttgtgtctctgcccactataaaaaaccactggggtttttttataggcacaggacggggacgtggcgggctcgggaaatgcaacatttgggcaaaaaaacagaaatgcctgtcctcacccaggtccctgggcacaggcctgggggtggagccctggccagagaccacgccctcctctacccagcacttccctgcccccttccttatcatctggtcccttttctcagacaccacaacttccaagaaggatcactggtcctgaaccctgtgtcttgtccaggtgtggaccccagaaaagttggtcctggctgggcgcagtggctcacgcctgtaatctcagcactttgggaggctgaggtgggtggatcgcttgagctcaggagttcgtgaccagcctgggcaacgtgacaaaaccccatctctactaaaaatacagaaattagctgggtgtggcggctcatgcctgtggtcccagctatgtgggatgctgaggcaggaggatggcttcagccagggaggcggaggttacagtgaaccgcgatcacgccactctcctccagcctgggcaacagagcaggatcttgtctcaaaataaataaaggaaagttggtcctggccctccagcatttctccagggtccttttttcagcagggacctggcggaggcatcgccctcagagtcctctggacctggacctgcacacctatgggagcaggaaggacccttgtgacttccagtggcccccctgggtgccaggtcccacagtagccacagcaggagcagagtgggtggggtataaactcctatcacaggagggaggactagccgggcctggctgggtggacctgtgtctacagccacacatttcctgggaatctggaagcctgctacagagaggccaggtcccactagactgaaagaagttcctgttaatccaaaggcctgacctgaggaccacaggataaactgcgtggttattttggtgccaatcaggcacggggactgttgttcctcactgtgtgcctataagcagggggttcctgggggtagacgcaggagcaagagcacgctctggaaaggtgatgttgtcctctgcacctgagtactgacttgtggagaaggaaggtagcgccggcctctgctctgcttgatcagccctgctgaccactgggttctgtttctaccccagaaaatcactggttcaatggcagttttccacctgccacaagggaagccacacgtggcagggctggggagttacagcatacccccccgccccccactgcctcccagagcacgtccccttcctcctggcccctggcacgtgcttcctccacgcacgtcatggctgactctgccctctcaccttcctttcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggaggtaaggatggggcaggtctggccatagaaccggctttcccagggcacagggattcgggctgtagggccacacccttggtttcaccactaagagctaagtgacctggagcagggggttaagcgtgagcctcagtgtcttcatctcagaatgaagaacagtccgcagcccttcggactcttgtgaagataaaatgaggaaatgaactcgaaggacttagaacggtgcgcggtgtgcggtgcgtgctgagtgcgtgttagctgttgtggtgcggtggtgctgggggctgcagggcgtatctggaagcctctgtgcagcagcttgaattgaaccctcccagcaccctcactgttgccgaagggctcgtcagtcacttggttcctctgtctgttcagtggagctgatgatcgctttcatctcacactcgctgtgcacaaagcctcactgcatcctcaacacagccagcttcacctaggaaggaactgaagcccagagaggttgagccgtttacccaagatcacacagtcctccagacgcccctcaaccctcacagggtaaatgagatcatctgtgtaaacatcgctgcacagacgttagcccccgttcgtgtttttgttctgagaaaggtaggccagcttgcctggagaggagaactacagagtaaagagggtcctggcacggaggaaagccaggacgctgcagcctagtggctttccaattttttcatcacaacctgcagtaagaaatacgttttgtactctgatagagtgtacacactcaggtgtgcaggtacagctaaagtaagttgcagtagccgcccttattacataaaagggggctctacttttccgattcatttctctttttttctccagaggtgggatctcacccatggcacactcttggctcactgcagcctcaaactcttgggctcaaacgatcctcctgcctcagcctcacgaacagctgggaccacaggcacatgccaccacgctcagttcgttttttaattctttgtagagatggtgtctcattaactcccaggctcaagcgatcctccctcccgggcctcccagagtgctgagattgcaggtgtgggccactggcttgacccttttttttttttcaattgcaatccactaagccgatttcccggggtacatgggtcccaaccctcagtttggagagccctgtgtgtgcttcccctccaaggcttgggaccccagaccgcagccacacggacacgttcgatcagtcactgtggcaggtgccagtgcgacaggctctgtgctgggggccgcagctggggaggaggaccactgggtgtgagtcgggcatacagcgtgtccctgccaggagtgtgtgcagagcgaccacagcacaggaaacaggaaaggtggccccgggggttctctgcccagccctttgtctttgatctgctaagactgcccatcagctcatggatttctgtagcgctgctctgtgtggggcctggggacatgaggaggaacaggtcagtccctgcctctgtggagctctcgtgtcatctggctgccgggttcaggagacctgcagaaggaggtctggtccatacctcgtggccaggggcctccaggagaaaggaagggagaataactgggcaccaggaaaatgctctgagggcctgacgttggctgggagagtgtggaaggagggaggaaggagacatttgcagaagcacagagggctggaggagcgccagctgtgcagagaagtggtgggtgtgagtggagcaggcagcggtgctgaggaggctggatggaggaactccaggtggctggatttccgcttctcgtcctgctggtgacaagcaaagcacaggccccctcggcagccctgctttattttcttctgaactttgtcacggtcgaaggaactttcctcctaccctctgtaaatattacacaaacagagggaccatcactccagaccctcaaagctgaatacagcggtggcttgctgtcagaccagggtttgagggggggaactgaggcacagagccggaagcctgtgacttccatcctcgggtgtaacctggagacgggggtttcaccatgttggccaggctggtcttgaacacctgacctcacgggatccacccgcctcggcttcccaaagtgctgtgattacaggcgtgagccaccgtgcccagccgagaccctgtcttaaagaaagaaagaaaaaaatccttcgttggggagcatctgcaagcatgaggaatgggggacactggagccagacaggctggtgcttaggggtcccagggccccgggaacccagcagcaaacagcctcgccctcaggggatgacgtaccatcagccacaggccaccagcacggccctgggcttcagtacctgcgagtctgaatggatttgctcctggggcaaccccaggcccgtgctgctcaggagggggaggcagggaggagcgtcggcagcccggtctctggggaggctggttcctgctttatccacgcaatacccagtcctattctatcaggaggaccccaagatgggccctaactcccaggccaagagccggtttaggcaccctccccgcttgcctgcagggggcaggcctgagcgcctaaccccagtccagagggctggactcagaccctcctctgtggggcaggggacaggcacgtagggagtactgaattgtgggggtgtgcagatttgggcttcaggcgcacggtgtgagccgacctttctagacagcatccctgatccccaaagactagcgaggccggggacacaggagcagcgatgggaagcaggcccgccggaacctccgactcccacctccccacgccacggacgctgcaccaccctgtgtttttgtttcatgtatttctcaccctgttccccgtgttccgcctggggaaccgagtgccatggacagagcagacacttgggcagaactgaacagcgtcatcttcgcctgcctggcgctccctgcctgggaaatggagcttcagctctgtctcccggcggattcttgatgcttcctacgctgccatgtgctagggaagattaactaaaatcagtcacaatatcccactgggaggtgacgctttttaagacgagcaacagccggccgccaagaggcgggtgaggccccactgagcacttctattgcatctaactggggagccatttgtacccaagtagaagcacacgttcactttgtagctcaagcccaactttaattagccatctgtatgaataaatgctgattccaggtccgtttcctctccagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaacatagcaagaccctgtctctacagaaaaacacacacacagaaaaattagccgtgcatggtaagaggaggagactgaggtgcccagcggctgcagcccgtgcatccccagggtcccagcacagagtgggtgttcagaagtgtctgctgagggactgagcaagaacccgactgagcacagcaagcaaacgctcagaacgggaggtcagcagcaccgctgtgcccaacacgggtttccaccataacccgaagttggaacgttttattcttccataccaaacaggagttgagaaggcggctgggttccttgaggtgtggaatgtcatgcactcctcctttcttgcgtggaaagcccgaggtataaagtgtgtatgatgtttgcttttttttttttttttttttttaagacagggtctagctcggttgcccaggctggagtgcagtggagtaatcccagctcactgcagcctccaactcctgggctcaagcattcctcccatctcagtctcctgaggagctgggactacaggcgagtgccaccatgcccagctaatttctgtcctttttgtagaaacagggttttgccatattgcccaagctggtctcaaactccggagctcaagcaatcaatcctcccaccttggcctccaaaaatgctgggattacaggcatgagccaccctgcacccaacctgtttgcatttttattttttaactttaagctattaagggttaatgtttgcatttcttaagggaaaaacagaggagaaagagccaaaggaaaaacactgaaatggtagcattcctgggtgatgagtttatggcgttttgtttcctggttgtctataacaaatatgtaatttttaaattagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtcccgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaagacatttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacggtgagtctcacagggcctgctccccctccccactatgcgggtcccatctcctggctgggagaaaggccatccgcccaaaccatctctgagtgccagggaccgggcagcctgcgtccccctccaccccacagtgccagcgtggggcccatgagccgtggtctctgcaccgaggctccagtagcgtacctgcccctgctctgcgcccaccctaaaatgagaaacacggtcatgaggatgaaatataaacgatcgtcaggttcctcacaatcactcagtgaactcctcagagagtcagtgtacgtttgggctggccagacgcagtggctcacccctgtaatcccagcactgtggactgtgggaggccgaggcaggaggatcgttgagcccaggagttcaagaccagtctgggcaacacagtgagaccccatctctacaaaaaaacatggttttgttgttgttgctgttgttgttttgagacgaagtctcgctctgtcgcccaggctggagtgcagtggcgcaatctcggctcactgcaagctccacctcccaggttcacaccattctcctgcctcagcctcccaagtagctgggactacaggcgcccgccaccacgcccggctaatttttttgtatttttagtagagacggggtttcaccgtgttagccaggatggtcttgagctctgaccttgtgatccgcccgcctcggcctcccaaagtgctgggattacaggtgtgagccaccgcgcccggccaaaaaaaacatgttttttaagcatgaagtttgggttgcacctcagtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtggttttttttttttttttttggagatggagtctctctctgttgcccaggctggagtgcaatggcacgatctcggctcacgtcaacctccgcctcccaggttcaagcgatcctcccatctcagcctcccgaagaggtgggattacaggcgcacattgccacacccaactaatatttgtctgtttagtagagatggggtttcaccatgttgaccaggctggtcttgaactcctgacctcaggtgatccacctgcctcagcctcccaaagtgctgggattccaggcgtgagccactgcacccggccggtctctaacctttcaaacgttcttctccagacaccagcacagcctgccaggtcccgtccacaggaagctaccagatgtgctgggcttcagcccgcactgctgcacagaggtgggagaggatggagactctgtccccgaggtgggcagctggcccagggcagagacacacatgctcagtgccacaagctggggatgtgtcctcttaaaacccccctgcacagtgtgggaagctgaggctcggccaagggctctgggctaaaacccaggttgaacgcctcataggctagtcccctcccctgcccaactttcatacacatttaataacagttgttcacacatgtttattgataaaccgtccaaaatgtaggtcatgtgtaaacaattccagttgttgggtatattgggtattgatccctgcagcctcctaaagtgctttggacatgaactgacccgcaaagcaagggcaaaggcctcagatgcacagagctgccctgacatcccttggctcggagtccctgtgccccatgtcagagccctaaacctgtctcccctgcctgcactgtgtccggcagacaaagggcagctgtctgcacggtgaccccgagtacccaggacacggaccacgaggacccaatgaaaatgtcccctttcaccatgatcggcagcccccttcccacagccccgccagcccacaacccccctcccacggccccgccagccgtcctcacagggcaggcggcatctggcatctccaccagcatcacacgcagctgtccctgccagctaggcaaggccgtaatgaccggcacaagcttgggcttgggccgtgggcagcaggagggctggagaggcatgggggaaaccccgctctccctccggcatggggcctccacctgcagcagtaagcagcctctcagcccctgagcctggggacctgcccgggcagcacagggccagggccaagaagtatttgtgagaaggaaggtggcctccgccacccctgcctagcaggcctctttctgctgccctttagaaggcactgggtggcagaggaggaaggggagggaggtgttccaaagccagtgcccacccctccacagagccaaccccagggcacacaggaagcagccaccacacgtgggagacaggctgccctcgtcaccgctgccctccagcccccccttcaccctgccctcctgaccctcccacccctgccttcctgcccccccaccgccctcctgccttcccacccctgccctcttgctctcctcacccctgccctcttgctctctcctcacccctgccctcctgctccccctcacccctgccctcccttacccgttctcctgctccctcctcacccctgccctcctattccccatcacccctactctcctgctctcctcacccctgctctcctgctctctcacccctgcccccttgctctcacccctgccctcctgtcccaacgcctgccctcctgctccccctcatccctcttctgctccccctcacccctgccctcccttacccctgttctcctgttctcctgacccctgccctcctgctcccccaactcctgccctcctgctccctcctcacccctgccctccagccttccacctccatcctcagcctctggacatgaggaccctgagaccctgctcttgaagtttccaacacagggagatgccgcca

SEQ ID NO: 17565 - DNA, 116955 bp, Human
ggtttttgttttgttttgtttctgaaacagggtcttgctccgttgtccaggctggagtacagtggcacgatcgtaggtcactgcacccttgacctcctgggctcaagtgatcctcccacctcagcatctcaaactgctgggactgtagttgtgagtcaccgtgcccagccttctggggagtttagatctgtgactaagcaaaaagaacaaatctggaggcatcactttacctgacttcaaactatactataaggctatcgtcacaaaaacagcatggtactaatataaaaataggcacagagaccaatggaacataatagagaacccagaaatgaagccaaatacttacagccaactgatcttcaacaaagcaaatgaaaacaaagtggggaaaggacagcctattcagcaaatggtgctgagataattggcaagccacatgtagaagaataaaactggatcctcgtctctcacgttatacaaaaatcaactcaggatagatcaaagacttaaatctacaacgtgaaaccataaacattctagaagataacatcggaaacatccttctagacgttggcttaggcaaagactttgtgaccaagaacccaaaagcaaatgcaacaaaaacaaagataaatagatgggacttaattaaactaaaaagcttcggcaccgcaaaagaaataatcagcagagttaacagacactgcacagagattggactttggggactcagggtaaaaggtggggggtggcgagagataaaagactacacactgggccaggcgcggcggctcacgcctgtaatcttaagggatacctgagctccttctaggaggttctgattcagtagatctgggagagtcaagaatctgtaatcagctgatctctatcaagagctgattttgggctagctcacgtgctaagtgtttggtaagttcatgttctcagtttatatcttcatgacgatttgagcaatgtcaagccataaccaatgtcgtcaatgacacccccgttttacagatgaggaaacggaagctaagaacatccaaaagggtttgttgggggggtgggggaagctgctaaaaaaagttatgcaactagtacacctagtaactggtcgactggagattccaactcaggcccagcaactccagaccccactctctcaatcactgtgagacataagacttttgggggagcttctggtgattttagtgattagtcagcttttcgcaaagcctcctagaagcccatgccactctcaaagggtgcatgtgtttgaaatttatggcccatccccctccagtgtttctggaaggaaaatagtgtagaaacaagatcatcggagggaatacgacgggcagctgaacctcttatcagcatttcccagcctttgggctactccgcgaggtcctggtctcacaggcggacccaatctgggaaccaagggagaatctttctgtacacctggcacttctcgtcacgccccgtcccccgaacacccaatcccaagcccgttgggcacgtctgatgtccactcagagcaattataattggccatggcggacgatcgctccgcctcccgggcgaccccgcctccctttcattctgaaagaaagaacctcagcctgggcgtccaatgagaagcgccttcacctcaaagatcccgcctctttaggcgtcgaccccgccccgaggccggaagggatgcccgcctcccttggcgagatgagccaatcgaagggctctcacggccagatggacggcagccggcccaatccgccgggcctcacgcggcgccgcccgcccctccgccgggcccgagtggcggccgggcgacgagtgcgggcctcggagcgactgcagcggcggcggcggacgcggcctgaggcgagcggcggggcgtggggcggtgcctcggcccgggctcgccctcgccggcgggagcgtccatggcccccgggcgccggcggggcgcggccgcggcctgaggggccatgtccggggtggtgcggaccctcagccgctgcctgctgccggccgaggccggcggggcccgcgagcgcagggcgggcagcggcgcgcgcgacgcggagcgcgaggcccggaggcgtagccgcgacatcgacgcgctgctggcccgcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaaggtgacgcgcgccccccgcccagcacctgcacccaggtgggccggggcgctaacccccgccccgggcccctccgtggtccgccgccgcgggcggggacccctggggcgaggatgctggatccagccccgcctgcaccccactcccccccgacccattccccgaggcctgctggcgtcgtctctgccccaccccgtctcgccctttttgagatggggtctcgctgtgtttcccaggcttgagtgcagtggcgccctcacagctcactgcagcctcgacctcccaggctcaagccctactccctccttagcctcccgaagtagtgggattacaggcgcgcaccaccagcccagctaatttttaagtttttttttgtagagatggggtcttgctgtgttgcccaggctggtctcagtctcctggcctcaagtgatcctcctgccttggtctccctcaagtgctgggattataggcatgagtcatggcgcccggtctgcctctgccctctctagggtgcctggggaccgtgggagtgggaactcgggccagcttctggggatggggagtgggggcttggcacttagccccctcctggatgtgccctagcagaatggtatctgtccatttcccactggaagatttgtgggataggagcccaaccggccgtgccctccggctgagcttagaagaagagcagtggagactggacgggaaccagccatgagtctctttttacttttctgtttttttagaaaggctctcactctcttgcccaggctggtctcaagccatcctcccacctgggcctcccaaagtgctgagattacaggtgtgagccacactttctaatacgaaaacttcaaatgtacacaaaagtagagaaaatagtagattgactgtaaagtacctacagcccaactaaagcagtcatcaattctgtgccaatcctattcacctgtgccctccccatggtctccaagcaaatccaactttgtgtagttggattaggaaacgttttaggatgtatatgagtggctaaaagatgaggcctccatgtaaaaacacaactgcagtaccattagcaaacctaaacattagtaatagctcattatcaccagatatccagtgttcagaattcctccattgtggcataattgttttgtgtgactcgacatgcattgcaatgaatctccagattctcctgtctcttgcttccttttttctctttgccatatttgtgaaagaagctgtagaagtcggccaggtgtgatggctcgtgcctgtaatccctgcactttgggaagctgaggcaggaggatcacttgaggccagaagtttgagaccaacctgggcaacacagcaagacctcagtgccacaaaaatgaacacattagttgggcatggtggaatgcacctgtagtcccagttgcttgagcggctgaggtaggagaattggttgagcctgggaggttgaggctgcagtgagccatgtttgggccactgcactccagcctgagtggcagtgaaaaaaaataaaagaaccatagagttgataaagtcggggttccagtccctcagtaccgtgagcctgtgttaaagggcctcaaggaagatctggaggaaactgatgatgagggaacagtgcagccttgcttacacctagatagcgtcctttgtcctccctccctttttccttccttcctttccttcttttctttccttcctttcttttcttcctcccttcccttccttcctttccttcctttccttcccgccttccttttcttcctttctttctaccttccttccttttttcttttcttccttcctcccttcctttctccctccctccctacctctctaccctttccttgtcccctcaccactttttccccagcccattttggggaaaccaagttagaggcgaggacaatcatctcaaagcagagtcggagagaagtttgccatgccagaaaacctgcctggagactaggttttatggtgcctgggagattttaaatttagcaaagccccgtagaaacctatcgggtacatttgtatcacttacccataaggactcctgcctcagccctagagatgaagtgactccttcctggggtctctgtgctggaatcctggcctccagacttccaggccagtattcgcacttgacatacttctcatggaaatgtttcattttaatagagctcctttaggattgtgaagggaagaaaataatttgataaaacaccctttttcattttacctctttccaagcctctcggtgcgtcagagctctggtcagatacttcgtgaactttgaagactaggtgcccagcttagctcactgggagcgtctgtgttcaagtgcatttggctgtctcagggcctgccctgtaacttctctgttaaagatcctgattttattgttgctgcttgcccagacctcagaaccaggcaggcataaaagtatagcagtttgactgtctctagtttcttccaactcagtagatggagaaagtatttggaaacatagaatctgaaatctaaatccgtgtatgaagtgcgtgttagaaaactcaacctcctggcaggagaatggggtgaacccgggaggcggagcttgcagtgagccgagatcgcaccactgcactttagcctgggcaactcagcgagactccgtctcaaaaaaaagaaaaagaaaaaaagaaaactcaacctcctgatgcatagaaacactaacttccactgactttcttatcagcagaaacaaaatgtgttaactggtatcctagttcttctttccagctttgttttttactaattatagttccatattaaactcacttcatgtgtcgtgaccatttcaataacaagttagaaattcatctttcaatttaaaaccaaaaatcgtttcctcctcttcagcccccacccccgcatttttattcgaacagatcactttgagaagagactattttatttttttatttttattttttgagacagagtctcattctgtcacccaggctggagtgcagtggcaggattatggctcactgtggccttgcgtcgcctcgtgggctcaagcaatcctcccacctcagcctcccaagtagctgggactgtaggtgtgtaccaccacacccagctcatttttgtagagatggggtctcactatgttgcccaggctggtcttgagctcttgaactcaagcgaaccacctgcctcagcctcccaaagtgctgggattacatgtgtgaaatactaaacttggccagggaagggactttaaataaattgctctgcagtgcctttagtactggacatttgaatgataccatttagaataatacttgtggctatatagagggttagtgttgacaggctccttctagagcacggactgtgtgctgtacacatcgtgcctgatcctttcaaatatggtgttgaattttcataatgcttcagatggtattacctcatttagtgaatgaggaaattgaggatagagacattaaaatctgttcaaagtcagctacctaattagcagatggcagagctaggaactaaacatgccttttttaaaaattaaacttttgattttgagataattctggagtcctatgcagttgtaagaaatagtagagatcccacataccctctgccagctttccctcagtgattatgttctgtagaactagatagcacaatcttacaaccaggatattgacgtcgatacagtcacgatacagagcctttccatcagagaaggacccttcatgttgctcttttgtagccactctctccccttcctgtcccagaccctggcagtgaataatctattctgttgttgttttgagacagtcttgctctgtcgcccaggctggagtgcagtggcacaatctcagctcactgcaacctccgccccggggttcaagcgattctcctgtcccagcctcccaggtagctgggattacaggcgcccaccaccacgtccagctaatttttgtgtatttagtagagacggggtttcaccatgttggccaggctgatccccaactcctgacctcgtgatccacccgcctcggcctcccaaagtgccagatgtgagacgccgtgccccgcctctgttctttaattcgataattttgtcatttcatacatgtcatggccaggtgcaatggctcatgcctgtaatcccagcactttgggaggccaagacaggcagattgcttgaacccaggagttcaagaccaacctgggcaatatggtgaaaccccatctctacaaaaaatacaaaaattggctgggtgcagtagcaggtgcctgtaatcccagctactcagtaggctgaggcaggagaatcacttgaacctaggaggcataggttgcagtgcacagagagcacgccactgtactccagcctgggcgacagagcaagactccatttcaaaaacaaacaaattagccgggtgtggtggtgcacacttgaacctgggaggcgggtgggaggatcacttgaacctgggaggcaaaggttgcagtgagccaacatcgtgccactgcactttatcctgggcgacagagtaagatcctgcctcaaaaaaaaaagaaaagattttcctgttgtctctcttttgttgatttctggttcgactccactatggacagagagtatactgtgtatggtttcacttcttttaaatgtgttggtttgttttctggcctaggatacggtctatttggcagatgttctgtggtcttttgttggtgaacatcctgtaagtacatgataaacgcgtatgctcgtttggcggaatgttctacatgtgtcagatcttgattgatagtggtgttgagttctatatgcttgctgattgttcagtagttctgtcagttaagagtcctcaactataattgtggatttgtctatttcttctttagctctatcagtttttgtttcctgtattttgaggtcctgttgtgtggtgcataaatgtttaggattattatatcttgatagattaaccttttttattatgtaatgtccttcttttttctccagtaattttctttgaagtctccattatcagatattttaatatagccacttatgtttttattaatgctttcataatatatatttctccattcttttaatacccttgttttgaagtgagtttcatatagacagcatattgttgcatcatattttttaatccactctttacatttagggtaaagtcattattatgactgttactatcttagagacaaggtcttttgctattgcctaggctgaagcgcagtggcacgatcatggctcactgtagtcttgacctcctggacccaaaccatcctcccacctcagcctccctagtagctgggactacagatgtgcaccaccacacccagctaatttttaatctatatttattttttgtagatagggttccactatgttacttaggctgctcttgaattgctagcctcaaagccatcctcctgcctcagccaaagtgccgagattataggcatgagcgatcctccctggctgatttttttttttttttttaagtataatgctttgtattattttcttggtagttcccctaggtttacagtatacatatgtaacttatcccagtctcctggccaaagtgccgagattacaggcatgaactgtcctccctggctgattgatttttttttttaagtataatgctttgtattattttcttggtagttgccttaggtttgcagtatacatgtgtaactgatcccagtctcctggccctgatgttttacagctttaagtgtagaaactttacttctgcttgggcccatttacccaccccacttcactataaatgtcttagcacttaacagactttgaatgccacatcaggtggtttacttcagtcatcaactgtgattttaaaaactcattaggagtaggagattatattatcttttccccccttttgactgaataaaattgtcccttttttttttattacctattctgatggtcttctttctgaggctctaagccttcttctgttgtcatttcctttctgtttagagaacttcctttagccattctttaacgatcagtttgcttgcaacagattctcttagctttcctttgtccaagaatgcctgtatttcctcttcattcctgaaggataccttcacattgtttcagaagagaaatctactgtcgtttgagttggtctcctctccgagttcatgcattgctcctctctggctgctttgaagagttttatgtttagttttcagaagtttcattatgatttgtcttggcacaggcttcatcccatttattatatttggggtttgcttggcttcttgaatctgtacatttatgtctcttgccaaatgtgggaagttttcagccattatttcttgaatgactatttcagtccctctctctcatctccttctgggactctgacatacggctgttagcacttttgttaatgacctccgggtctctgagaccctgtggccttgttgagtggggttggaacatcagctcccctctgggcgttgctgattctagggaatgggagggggtagcaaagcgacagctaatccagccttcccccctcccaccctcccatcccctctttctgcctcgtggtgggggtgcacttccccactgggccctgctgacaccaccctggtgagggaattggagcacctcctgcttcttccaggcagagaatgggaggtgagatccctgcttggccctgccagcactatttgacatgccacttggagcatgtcacctggttccttgagggtagaagatcaatttccccctcaattccactgaaacctcagtgggtggtatatgtggtttctctgctgatgttttctcttgtatttgttttttgttgttgttgagatggagtttcgctcttgttgcccgggctggagtgcagtggcgcaatcctggctcactgcaacctccgccacccaggttcaagcgattctcctgcctcagcctcccaagtagctgggactacaggcacgcaccaccatgcccagctaatttttgtatttttagtagaaatgggacttcaccatgttggccaggctggtctcgaactcctgacctcaggtgatccacccgcctcggcctcccaaagtgctgggattacaggtgtgggccaccgcacctggccttctcttgttatttggaataggacgggcattgccaaaaaggtctgctgttgtaagagcatccttttctgggtcctttggccaagaacaggctcttcttggagttctttttctctgtaccttttggctgttccagcttggaggcttctgcagcgcccatcctgggtaagtaggaggcagtaaggacacccagagaactcactgccttgtcatccctcaagtcctgaggtcgctgggtagcctgccgccttctttccacctgctttctgcacttgctggttgtgttacattcagaactttctttttagctgtaagggggcagacctgggaggagtagagctgttactttgtggaagtctccatcatcctggtctttttactcagtgtctggggcttttccatcttgatcacagttgtgcctgaatttgcacataggatttctgttagatagtgcgaggacttcattacctcactctatcctctgcagttcattatttgaatctactagttgctttgatttttttgtaaagattgccagtaagactttctagtttattctttttttcttaaacaataatcaagtttattaaacaaatttttttaagtattataaaatgtttaactttcatcagcttcaaggtttatgctgctcccaaattttgcatacaactgaactttcaaatctgctcacacccactgaattgcttcgactttggattctaaggcgtcagttgcttcttgcaaatttttatttgctgcttctaacatttcctgtgtttcttcttgagaatggctaatgaagacatcaccgatttgataaggcatcattaagcagtcagcatctgcaagcatggtaccgtcacgagcatcttctacgttttggagttgtttctgttttacttctatttcttccttcagctctgtgattctacttgtattccatgcaaatttgtttatcttttgttgctcttcgaaagtaacattgacatcttctgcagccgtcttcttcatggtggccaccatctcgggactggagaacagcatgagacaatgggactttgcccccaagcgcgctcttgctccctgtcggcccagaattccctggcaaatacaaccctgtctccacattccctccccttggacccatggccaatgatccctaaaagctgggacacagggaggaaatgtcacctggaaggacttggtacatgccagttaaagggaccggcaacccccgtgggccaacatcaatgggggtgtggggaacagcctagtttattctttttatttttctaattctacagatgatatctcgtcacttcctgactgggctgtccttaaagtttgtgtatttggtgttcccgaagttgtgtaataatgcctctggtggtggggtgtgcctcaggctgttggaagacatcaggccagcttagatttatctcacagtgcttccattccctgacttatgtgtgatgcgttaaatcccaagagcgttttcattactaaatttcacatccagttagaagtggataaaatgttagctgtctgaaggttccttgttatatagactagaagtcctaaccatccacatgattgcattagtgtagcctttagccaccccaaggtagacttgtcttatatgcagatgtatagtcacgcatcgcaatgtatagtcacgcatcgcgatgcatagtcacgcattgcttaacgactgggatcccgtccaggaaatgcatcattaggtgaggttcttacgcaaacatcctagagtggacctacacaaacctagataatatagctgaccgtatacctaggcctattgctcccagactgcaaacctgtaccgcatgttactatactgaatactgtgggccattgtagcacaatggcaagcatttatgtatctaaacatagaaaacgtgctgtaaaaatctggtgttataaccttatgggaccaccatcgtatatgtggttcatcttttaccaaaacatcattatgcagtgcgtgactgtttggctgattttagaaactttttgaagaattagatgattagagtgggtggtctcttgttgccactgaaacaaaaagatcaagttcaacaaaatctccacggcattgtgctaggtgctgatgcagaagggatattcagtgcatattgcagagcccctactctccactcgcactctcaagctggggagacagttgcacaagtaactttaacatacagcgtgaatggataccatggtaaatgccactggagaggtgttgcaggaggccagtgggaagattaattctggctgaggtatctaaaaaagccttattgaattgtgatttgagctggcctttgaaggttttgtaggatttcagcaagtggagaagaatacacaaatgagaaccatcttaatgcctctacatttatcagctaagacagaaaattcgaatacatagagatactaaagaatcagaactttctagtccaaaggagtggttgtaatgtggtggctttctttggactgcagtcgcagcactctagctgaaagctgtgggtcttctccctagaaaattcatgtatctgtgtagggtttcaggggagtgtttggacatccggaatcccaagagtgggcctaccagtggcccatgcactgcaggttaacagcttttgttgtggaatatcaaagattatgtaaaaattttggaaattaaattttttttttgaagaattgtttgctgtatcacatgtactttttgccaggacgtacggaactttgaagcagcctcctctgctgttctggcctttaagagtctctgtcttgggagttcagaagtgcctctttaggcttgatgctgcggcgggtttgcgtggcggcagaagcatacatctgcttctggggtctggaagcagtttggtttttatggccttgttggcaaattgcatttaacaggtttaccttatgctttgacatacggggttggtcctttcgtaataccaaaaaacaaaacaaaacaaatgcaaaaacatctttttccctcagctaactaaatccagagagactcctctggccatttttggggattcagaacacatgagtgattggtcttgtcccctggctttcgagtttacatgttgattatcttaacaaaataattagggggagcagggtttgaccttcagtcatctgtcatgtgagatttggaagccagctgtgcttgatgtgagatagtgttccgttgacagctcgtaattattttctgttcttactcagttgagagtgggttcatggatcgtaccggttttaaatggaactgaagatttaaacttcggccttatctagagatgtaattatagggtgatgttcaaaccaaagaagctgatgttgtgtaatggacctagggcttaacttgcatcacctgaagggcagtgccatcccatgatgacaggccggctcatttcatgccgtaactattatggtttgtttgtacttaaaagaaatggaggcttcaagtgggctggacagagcagctgctcaggaccaccggattgccttttaatcctaaaagccgaatgtgaatatttgttgctgaccgtgtgatgggttagtctttctctctgtgaggataaatgctcaggtgtgtccaggttttgcagaatggaaaacatgacttgtatcctgtgttagccgttagagaagctcatgcttctggttgattctgttgaccaaatgcatttggaacgtctgctttggaagtgcggcatccagaggacagagaagcagagggtgggagctcttgcaagcagctagaaaggtgctggagggcagcacatccagctgctctggacggcaaggggaagaaaacatccctgacccccactttcttaagtagagaccaagtagacggcacctctctgtgaacgtcagcatctattttactgtctagtctgaagtccacagcaccaactttgtcacatggccctgttaaatcagaccacagcagcagagaaccagctgtagtgggtatttgctggtggaagtgtgccaggcatgggtaatcaatagctacttaagccaagccgaacagaaactaagcccgaggaacactgagacccgaagaatctgtgctaattctctcgtcaccgtggtggaacgttccagtgatggtgcatggcgtggactcctcgcagccctcgagtgcctgtttggggcagtcagtggaggttgcctggtctcaactgggaaaggccaggctagatgcggggtccacgggaggacctgctctgtcgttcagagctaggctttgtgctctgctgtgtgtatggtagtgagtggaggagacacagtcctggcctcgtggagctgattcctagttcacttctctggggacaggaaacacaacgggaggacagggcatgagccggaacatcactgggaaagtcacttggaggagaggggaggccttgcctagtggaagaggcctttcgactgtccataagatggatgaacacatccacctggactagtctaacgatgtcctggggccaaaatcagggatttgggctgcggagaaatttgtgacaaaacagtttgatgctcagtcaaggtgagatactggcagtcactgacaactccacgggatgcaaattacattcattttaaggtaaaattttgcacatctttgtagacaagatacacagtattccaggcaaaacccttgtgataagggagtcattacttaaagtctcacctgccttccggtttccattacaggtaagagggaatagctggttcagatgtttacttgtataatactaagaacacttttaatgtgtgttttccactcatgctcagttttatatctacaatttttggcgcacatgaggtgactaataactatttatatttttgtgaccacttgtgttttttttaagaaaatgaagttccaggcggggcgcggtggttcatgcctgtaatcccagcactttgggaggctgaggcgggcggatcacgaggtcaggagatcgagaccatcctggctaacacggtgaaaccccgtctctactaaaaatacaaaaaaataaccgggcgtggtggcaggcgcctgtagtcccagctactcgggaggctgaggcaggagaatggcgtgaacccgggaggtgtagtttgcagtgagcagagatcgcgccactgcactccagcctgggcgacagagtgagactccatctcaaaaaaaaaaaaaaaaagaaagtgaagttccataattttagttttagggtggggagaggaactgtttttccctaaggttctgatgacttgattagatagatatggatcgaaaactctgttaaaagtatggagtgatgtggaccaggaggcaaaactccctgggagatgagctggtcagaattgagaaatagaaaaccggtcatttactttcttatcagtacttatctggtatgaccgtagcacaatgagactgtttttaaacataccaggactgctggaacgcactagttaaagcagatgcctcatgaaaagtaatcatcttgggacagcaagtcaacaaatgcctattaagtgtgtgtttatgtgctaggtactgcagaagctgaggagatgagaagatggcctggaaggaatgataccttgataccttctctgtgcattgggagcttttgttttttgttttttttcattaatttttttgagacagggtcttgctctgtcacctaggctgatgtgcagtggtgcaatcacagctcactgcagcttcgacctcctgggctcaagtgatcttccgacctcagcctcctgggtagctaggacccaggtgcacaccgccatagcccacttggcagggagcttgtgtgtttgaagcaccttatctgttatgtctttgatcctccgagtaaacctgtaaggtcaggttgggctttactctgatgggtgggattctcactttcctagcctcatgtttccttgcagagagatctcagctactgtgattctcttgcctctcctgccatcccttatccccctttgctcggggaaggagtgacttgcttgactggtggattttggggaaggcagtaagcaggtggggctcaggccctgtagattccctccaggttctctctttgggagccgccctccccacaggggacatgccttcctcctgccagagttgtagggccacctcccctgcgtttgtcccactatggcagtggtcaggagcctacttggctacaaacccaaaaccagactctttagtcagaaggccagtattttcatctccgtccacctgactcctgttttgatttccaaatggattctagactgggagcagaggaagaaatattgagactcgtatgagcatgaacacagcacccaaggcaaaaagaagattctagggtgtgtagtgcatttcctgaccccagccccagtcccttaaggtagtattgaggcaagaaagagccattgcaaccctaaacattctgacaccttcccatctagaaagaaacagacccagagtcgggaatagaagccggggaaaagttcggggagaacactcaaaaggaaagggtccttggtggagccaggaagtgtggaggcacccagagctctgtgctgaccacagctcgaggcaggagtccactggaggttgggacacttactagctagcaggagaaaatccactagccccagacaagttcccagctctcatcatctccctttcctcagacagggattgaaagcagtgtctgtctgtcaaactctagctctggtccaagaagacaaaccaggtagaaacagaatcaggaaaaactggcctcgagcacgtctgagaacaggctggtggagggctaccacagggatgctggaaagggacgacatggcagctccgaaacaccgtcccaaaagaaaagagggcgagaggaaaactagcacacaaaagtcagatgaaaaacagggtaagaagagaaactatgaaagagaagtagcctgttcaagagtgctctatattgtataagaataataagcatatagatgatataaaacaagagctccagggtatgagaaagcattaacatgagatgcacagggaaatggcagaagtaatagattgaaaactcagcatcgtcatagatctcataggtgcatcggagacaggaaggaactgaatagtaatgaacaacgatgcaaggggatgtctctgaatcctacccactgtcagcgtccccatggctgtagagttgggagtcagagagacactggactccttcaggcatttgcacaaaaaacatgaacctaaacctcagtgtttaaagaagccttagtttttcttatctctccgacagagggaaatatgggtggaggatttcccaattctaggctttctcctcctgtgtgcctgattttaaactgcctggggcagggacctgtttgtgagggccaacagcagcaaagggccttttgtacgaatagctggtctctgctctcatggaggtgagccctttgtacttcatacaatgagcagaccattttcttttctcttttctttttttttttttctgagacagggtctggctctgtcgccgaggctggagtgcagtgatgtgatcttggctcgctgcagcctccacctcctgggcccaagccatcctctcacctcagcctcccaagtagctgggactgcaggcagacaccaccacacctggctcacttttaaaaaatttttgtagagaaaaattaagatttttgtagattttgccatgttgcccaggctggtctcaaactcctgagctcaagcaacccacccaccttggcctcccaaaatgctgggattacaggcgtgagccaccgtgcctggccaagcaggccattttcatatgggtatatccactaaagaagactccattggagtagagggaaatttatttctttgaccacctgctaaactgaagtcactagagcaggaatagttttgttttccctttcctggtgttttaacgtagcgtcctaaggtaacaggagctagaggacttgggggcagccacctgcagccagcttggtagacaacactttgatctttccccagctgcgtccctggtaccatataacaataccggctggatgtggaggctcatgcctgtaatcccagcagtttgggaggccgaggcaggaggatcgcttgagcacagcagttcaagattacagtaagctaggatcgtgccacttcactccagcccgggctgttgacagagtgagaccctgtctctgaaaaaataaaaataactattgtctacagcaaacattagtttagaaactgcattggtgatagttattttatagtacaaatccttaggaatataatttagctgtccagtagtgattatttaaagccttttctccctgtattcctctgcagttttcaggaagttttcattttgaattgtaggtgttttaatttctggtttgaatcttgctttacaatttttgtaatcttgaatatttttagaatgtgtaaatatctgccaaggagaccacaacatcttcggcattttcttttttaattggaaacttgtcttgtttcttaattcttggtaacttcaggaaaagagccaccaacttgcctgagttctttcctgttatctggagcaaattagaactcttctggtaaagtaagacgccctttttctagtctttcattaattaaaaaaaaattttaaataaagtatcgggggtagggagaatgtttcaaatgtaggtgtttttgaagtaggttaaaagacttcaatcttgaattgagtcttctaaaaaaatttgcgcgatgtttttgtagttaattagcaatacctcatgatagatatacatgaatattttctttggtatgtttttataattaggtgattctttccttcattataactcctttctctgagtggttctgacattggtcctgccatctgccctattctaagtcacgtcctggtgtcactgcagtcaggagtcctgttctgtcctctgcactgctcacggaccagcccagccccactgtcctcagcgtggttatgcagaagccactgtggttcccttccagtcagtttggtggttattccctcagtttaggtgccttcagtccgggccacagtgcttgaattctcacgcgacatcacagacttcacctgaccagctgaagtttcgttaatacaacctttctgttttcactctgttttttaaaataatcgaggtaaaattcacataccatacaattaatcatctggaagtgtacattcagtagcatttagtacattcactgtgttgttcacccaccacctctatcaaattccaaaacgttccaatcactccaaaaggagatctggacacgttagtagtgactccccattccctccttctcccggcccctggcaaccactaatctgttttctgtctccatgaatttacctattctgaatatttcatataaatggaatcatataatatgtgaccttttgtgtctggcttccttcacttttttaaaattaatatactttatcacttaattttaggtttacagaaaaactgagcagaaaatacagatttcccacatactgcctgcctcccccacaccagttttcccctgtgagtaacatcttgcattagtgtgctagggttgggaaagttgtgagtgaatatgaatatattattaactgaagtccatagtttgcattagggttcactcgttgtgttgcatagttctgtgggttttgacaaatgtctccaccgttatggcatcattcaacatagtttcactgccctaaaaatcctccttgttctacctgttcatccctccttccctgtctcccctcaacccctggcagcctctgagcgtttactgtctccatcgtttttccttttccagaatgtcctgtagttggaatcaggaatatgtagccttttcacatgggcttctttcacttagcaatacatatttaaggtttctgtgtctttccgtggcatgttagtttatttcttttcattatggagttgtatacctttgtatggatataccacactttgtttatccatttacctgctgaaggacattttggtgactcctaagttttggcacttatgaataaagctgtggtaaacacctgtgtgcaggcttttgtgtagacataagtgttcaactcatttcaagtgcagttaattgctggattatatggtacaagtatttgcttttgttggtttttttttttttttttgagatggagtctcactctgtcacccaggctggagtacagtggcgtgatctcggctcactgcaacctctgcttccaggttcaagtgattttcctgtcttagcctcccaagtagctgggattacaggcatccaccaccaagcctggctaattttttgtatttttagtagagacaaagtttcaccatgttggcctggctggtttcaaactcctgacctcgtgatctgcccgcctgcgcctcccaaagtgctaggattacaggtgtgagccaccgcccccggcccgagtatgtttagttttgtaagaaactgcccaactgtcttccggagtttgcattcccagagcagggaatgagagttcctgttgctccacttcctggctaccatgtggcattgtctgttttggattttagccgccctaagaggtgaggaatggcatctcagtattttaattagcagtgccctaatgatatatggtgtggagcgtctttctatgtgctggttgtcccctgggtggtgggaatgctgggatgaacgctggaatgagcgtactctaaagacttgttctcttcagctgccgcagctgctttgtgtctgcggccccaccacagccgtttccctggcttctctgtcctgcatcctccttctttcagtgtcctggacgcaaacgccagcacacgttttctcaggcatttttcataaggctgctttcctgtttacaaaactatagcggccctcagcctcccatcagctcgataccttctcagccagaaatgaccacagtagctgtatgatggcacaaacgcacttctcctcctctctgagatagctcccttctctccagcacctccttccctagtttacatcttcttcatggcgtcttcatattatgtgaaatgaaaacacacccctttagggaaaagaggaaagcgtcttcatacactgctgggggcgcacatgctgggaagcttctgtccgccccttcccgccctctctcctgcttctgtcagctctctgctcttggggtgacctgtatagattgtagcagcgagtgttgtgctttctggcttctggttggccagtgggaagtcctggcaagagctcggagggagggaggggagagagtgaggttcagtatttcttctcccctcccacgccccaggattccttctgtcttgtttctcgggcttcccccacacctttgtgattagttcctaatttgagtgtcctgcttgtttcctgttgggtgcctggatttaggatgtaaattgttgtaacctgtcttttggtggcagtctgatgtttagatatggtcatggagtcttgggtactacccagagcgagatctaggaggaggcaagccaggtgtctgtccacccgcaggtgcagacctcaccctcacggggcctgagggagaggggcctcctcacttgtctttagtcggaaagtggttcttggacttcctgtgcctgtggtcacctggccatgctgttcaaatgcagattctattcagtaggcctgggaggtctgtgagctcctaggtgatggctgtgctgccaccggccctcagctacgctttgagcagcagggatttttttattgcggtttgatttgcattgttaaaatcctggaatgacctaatcgccacctgttggggctgactgattgaactgtggtgtgtgatgggcactacacagcttttaataagtcggtgaatcagctgatatttatcgagcaccttctgtatatcaagtgcccgggatacatcattggaaacaaatgcttgccatgtagagcttacattctagtgtgggaaacagacgatccacagggtaaacaggcacgtcttatgaaatgttagaaagcaacaagtgctgggggcaggagaaagcagggcgagagcgtgtccatgtcaggggtggcagggagccgcctgcagaggtgatggggagagcaccccaagtgcagaggcctccgcagacccagaggagccagtgtgatggctgtgtagtgagggaggagacccctggatgggcagaggcgggtgcaggccactgggaagacgcgggccttaactctgtgtgtgaggggctctttgtccctgaggatttctgcagaggagtggcaggatctgacttggacattcacggggttgccctggccaccctcactgagggagaccaggtggacgtgggggcagtgagaggctgtcatcctgatctgtgggaccagcgtgttaggagtggagatgctgggaagcggtcagatcctagaaatgttgtgaaagtgttgatgttgaaaataccatttttgagacaggcagacatgggtgtgatctgttcaactggaaaaggagtcaactatcttttaggaaccatgttttgaatgtgagcaaaaagaatggtggtggcatatggtaatgacactaacatgtaatgagcgtttctctctaattaaaggggatttatttttattgcccttatctctgttttctagaatgcgcattattttcatgggaaaaagagtcttagaaaagacattgcttctttctctaagtaattttactgcatgctctttattctatgaagtttactcatttgcattgggttttatagatattagtaggtagtttgtgctttattatgtctgcaacatgcttttttaatttttaattttttttttagcttgcctagccaactagaatgaaagatcctttgacattgaggattgcatttttatttttcctgtattccagcttgtaacagacacttcctaagtgcttattgaacgaattgttctaattcttttaagcaacgactggcctcttcccgaacagttttatttttctaaatctgcagagggttattattagcatgcttgaaagaccaaagaatgattgtctaattcttgaaggttctcatttgttcttccttatgccctctgttcctgttaccttccccaagcactcctcctgcatatgccgtcaaagtcctgaattggggctgcggttgaagttggagtgtcagaacacgcttttgcccttactgctatcagccttcagtcagataagtagcctttttatataaatagttccctcttgtctctgtaaagctggggaaggcggggtcccttgggtttgtgtgtatgctggatgaagcagacagaagggttcttcagggtatggggccgtctctggactacaccaggaagcctggaaaaggccctccaacaaagcctgccatagatgatgcctcggaccccacgtttttagttacaaataatatacaaatagttactgagaattaaagttactttcttcaaggccatcagagtggttggtaactgtaatgtccctgaaagactcagtgtctttaatctcctaaaccatgttgaattccagtaatgggaggccagggaatgggcagaggactgatagtgaatctagggagcacctttttatcacatctaggagggggctgagcagactctcttagggactgagggggttgagtgtttatctccttcaactcctttccaagtcattgtctttaaatctttcttttcttttggaaacggagtcttactctgtcgcccaggctggagtgcagtggggcgatcatagctcgctgcagcctttactttctggactcaagtgatcctctcagttcagcctcctgtgtagctgggaccacaggcacgcaccaccacgcctggctaatttttctgtagaaacaaggactcactatgttgcccagcctggtctcaaactcctgggctcaagcagtcctcctgccctgggcttgcagtcctttttctttttgttgattgaggctgatctcacgctcttgggctcaagcagccctcccaccttggcctcccaaagtgctgggattacaggcgagagccaccacgcttggcccttcaatctttatcagggtttgagaaggggacttccataagatatgtcttagattggggaggttaagagtgtgccaggtctcaggcccacctaactcagaactaccactcttagttactggactgtctacagatgctagttccagtaggtagatctctgaattctgaagaaattgcccagtgaagcctgacatgcaaaacaaccactccagtcgctgccgctgtatggttgaaaacgtacgaagaacaacatctcggaggaggcatagcttcccacagaagcttcagaatttgtaggtttagataaaaagttaaaagagaatgggaaggctaagcacattctaacgttttttagctaggtttgttaagaaatgttggtggtaatctgaatcacccttgttgatgtgtatatcacattttacatagttctagtcatcacatcctggaatgtcagcctgggcgggcatgcgagggcctggtctgattcccctgtgtccctagggcctggcaccatggcagcacatagtaggcatttgagtatttgttggatgcataaataaattcttgtaataaatacaggaaaaaggtcttagggaacttgaaagccaaattttaatattgatgatcttgtaaacaaagtatttttcatgttttagtaacatgaaggtcaggattccactaagcaggaatatggtgtaacctcatgtttcctggcaactagccctttgctactagacttgccacaggaagggaaagagcttacctagcattgttcatcactgtcttgctaaggtggaggaaaacgaggagcagggagctgagaaaatagaataactgcaggagtttctcttgtccatagggcacaccgtttggggtgaattgttttgcttggggccacccagtgagttcgtttggagttgcaagcctcgcttccttatatagagtcattgatacaattggggagtttcctgagtggatgattaaagcagttctgtattcattcttctctgtaagtgccaacacctggccgtgatttctctgcggtcagctggagactgacatccattttctcacagtatttacgagggaagggaaccctggttggtgaattcattctcatggtctttttgcccgagtcagcagcaagacagtcaccttgccacgggaggcagcgtgtccctgtgttgaacaggcggagagtctcccctcaggatacagcaggagtgattggaatgattctgtttctcagcctgtcttgcagaacatctgtaatctaagcgtcatcacaaaaattcttaagccaagaataagcagaacattaaccagagaataattgattggcatctttcacctagacaacatttttgtgaaatgggagtgattcctgtggagttttgtccatgttgatgaaaacatggatgtaggccgggcgcggtggctcacgcctgtaatcctggcactttgggagtccaaggcaggaggtttcttgaagtcagcagttcaagaccagcctgagcaacatagtgagatcccatctctatcagaaatttttagaaattagctggccatggtggtgcatgcctgtaatcccagctacatgggagtctgaggcaagaggatggcttgagtccaggagcttgaaagctgcagagagctgtgattgcaccactgcattccagcctgggtgacagagtgagatcctgtctctaaagtaaaaagttttaaaagacacagttggagtttcctctttggaagattacagggcagaggccagggtggtcagtgagtcaggagctggtgactggccggtggggcaggtctggacaacaagcagctgccacactgtgtgtcacttccgtgctctgtgctttacagcgcttgggactttctttttcaattttttagcttttttaattttattttttatttttttgtagcgataggttttgcatgtctcctgggctagtttcaagcgatcctctcacctcagcctcccaaagtgctgggattacaggcatgagccaccatgcctggcctcagcttaaaaaaaaaaaaaaaaaagctttattgagctataactcacatatcataccatgccctcatttaaagcctacaattcagtggacttcagtctatttacagagctgtgcagccatcaccacagtcaatttttaaaacattttcatcaccccagaaagaaaccctgcagccactgcacattttcctcctgccccagccccagccccgggtggccaccagcccactttcgacaccgtggatttctctcgacgctgttgatttgccttttctgaacattttatgtaaatggaatcatacagtatgttgtcttctgcgacggacttcttagcatcgtttcttcaaagttcatccatgctgtagcgtggcatcgtcatccctctaagcggccgaatagcattcccttttgctacgccccgttttgtttatccgtgcctcagtcagtggcatctaggttctttccatcttttgtgtgttatgaatgatgttgctataaacatccatgtgcgggttttggtgtgaacatgttttctcttgggtgtattcctaggagtggaattgctgagtcaaatggttgctttatgtttaacattttgacgagctacccgagtgtttctgaattggccgcaacatttctgttcccaccaatataacgtctttggggtctaaccgtgcttgtgtttatctgtcctttgaattccagccatcccgttttcggtttgcctttcctcgatggtgaatgaggtatagcatcttttcatgtgcttatgggccatttgcgtatcttctttggagatatggctatacagatcctttgcccatttttttaatttggattatttgtcttttatgcagactagggaatttcttaaggggactgcttttggttattgtgtttctcacttataaactcacctttcagtaatgagtcacatacacctccacagctgttttggttttctgttgccactgtaacaaattaccacaggcttcgggacataaaacatttatttgttagctcctagttgcttgggtcagaggtctgggcacagtgtggctcagttggttgccctgagtgtcatgagactaacaggaaggttccagccggactgtgttcctttttggaggctctgggaatgcatcggcatccaaggtcattcaggttgtggcaagggttcaggtccttgcagctgtaggactgaggtccggtttcttttctgacctccctcggctcctggaggcctccctccagtcttgcttgcagcccctgcaactcagaaccagcagcgagcggctcacaaggaacctgccagacttttccaccttccacatctgcttgtaaggactggtgactccatcaggctcgcagggtaatccagaataatcgccctattttaagctcagctgattggtagccttaattacctctgcaaagacctttcacctaggttcccaattgatgaatacccccggccatctttagaattctgcccgtgccacgggcttgtggcctgccttacagccttctagttacaggggaccatgaaagggttgtgaggctggtcagagagagtaagtgaaaacggcaagcgaaacctgtgggagaggccactttgagtcgcctccctcccttgttcgtttgtcctttgcttttttttttttttttcaagttagggtctctgtcacccacgctggagtgtagtggcgcgatctcggctcactgcaacctccacctcctgggctcgggcaattctcatgcctcagccacttgaggagctgggactacagggctccgccaccatgcccaaatattgtttgtgtttttattagagtcggggtttcaccatgttgcccaggctggtctcgaactcctgacctcaggcaatctgtgtgccttggcctcccaaagtgctgggattacaggcatgagccaccgcaccaggcttcctgttctttattataagttgtattttctttattacaagctgtagtttgtctagcctctaatcagtggttctccgttggagagactatgctccccagggggacatttggcagcgtctgcaggcgtgtttggttgtgacactgatgggtgccgccggcatctgatggttggagatgctgctgactgtcctgcagtgtgtgaggcgctccaaaacagaattccccagcccccagatgtcagtactgatgtggtaaacaaactttgttctatgtcagatggccagttttttaatggcagaattacactattatgtaaataattgatgttcttaatgatgactccccccagaacctacaaaaccctgacatgcctgttagctgtgtagggagtcattccgtgttcattgaattaattttaatacgttatagtgaactacagtcccacttgaaacattaagagcaatcttacagtgtgctagtactttttcttctttttttgtttagtttcctaactatgaaagcaggtgttctaatacatttggaactaataattcatgtgtagtgtacttatggagacttaaaaataaaactaaagggagggaaggaggaatggaaggaggagatgataattaacaaagaattccttattcacaattaatagatgacaacatttgtcataactttagatgtttcttctatgttccgttctcctccccagtcctaatactggaaccaaactgcttagaccagaatcctgagtgaccttggatcagctgcattcattcatttgttccacaaacatctgagtgccaggggctgttttcagcattgggaataacagcagtggccaaaagtcagagtccatgttgtctgcgtaatgggcaggttagggacaaataatgagtaagtgaagaaatatataatgtctccacagagagagctgaggggctggtgtgggcagagcagagtgagtgagggcgagagagcaggtggacatggggtggctggggtaagggaggatatacagtcttgcaggctgtgtaaggattctcatttaaagtggagtatgggccgggtgtggtggctcatgcctgtaatcccagcactttgggaggccgaggcaggggtgggaggaatcacctgaagtcaggagttcgagaccagcctggccaatgtggtgaaaccccgtttctactaaaaatacaaaaaatgagctgggcatggtggcgcgtgcctgtaatttcagctatcaggaggctgagacaggagaatcgcttgaaccctggaggtggaggttgcggtgagccgaggtcgcgccattgcgctacagcctgggcaatagagcgagactctgtctcaaaaataaataaataaaaataaagtggagtatgatgggaagccattggaaagtttaagtagagagttgaactgacccaactgtgtttttaaaagggtcattgtttgttaagtggggagtgtagacctcctccaggggtaggaggtggaagtgggcaagaatgagagcaggggcatcagtgaagagcagcagagacccagactgacttgatgggagcagaggaggtggtaagaagtcaccggagtgcattgcacattcctgatcatttctctagcctgagttttctcatctgtgaaatggggacagtaatcatggctgtctcctggccgctcttaagaattgaatgagttaatgtgtgctagacctgtgcctggacagagtaggtgttcagtgaatgttagcttcaatatcattctcactgtcactgctgctactgcccttcccaccgaggaaaccctggcatgagctggataattattcaatttgtgttctgtacatgttttgagtccataatcaatatgtatattacttgtttttaagaatttatggaaatggcattattttgaatatatcatttaaaaaatggatttgctaggctgggagcagtggctcacgcctgtaatcccagcactttgggaggccaagacaggtggatcacctgaggtcaggagtttgagaccagcctggtcaacatggtgaaacccatctctactaaaaaatacaaaaattagctgggcatagtggcaggcacctgtaatcccagctacttgggaggctgaggcagaagaatcgcttgaactagggaggtggtggtcgcagtgagccaagaccgtgccattgcactccagcctgggcggcgagatcaagactatctcaaaaaaaaaaaaaaaaaggatttggtgagcagcacatgtgcgtgctgtccatgggggtgcgtgaagatctggtttacttctttccaccatcacattacttaccataattgctgatccgttccctgtgaatgcgtattcaggttgtttaccgttttccctgcgaccaacagtgctgcactgtgtgtccgtgtccacgcctccgtgcgcggcggccagggtctctccgggatgtgtacttagacgcagagttgctgggtcagttccacgcaggcccagctttgccaggggctgtcaaccgttgcttctcatggaaagtctcagcaaggctattaaatgaactcaaaaactatctcccttattttcagatgaatgaaaaattcagtgtttgtgtagatggagaggagcagaggagtgatgggaaatgtctctgggattggacgtcatcaggtgtgctaagacacagacgggactgttgtgaggaaggagcttgtgctcacagatttgtagaaacaggaggcacagcacacggggccacacggggagcaccaggctccggggagcaccatgctgggtcaggaggcggagggggacttgtgggcaagagcctcgattgtggtttctgaaaagaaatgggcaaggcagcatccgcggtttaggattggctggtttgagtaatttccccagcctctgtgctatcagggtggtccctggttgtccagtgcttggccctggggtggttggcagaggcatatggctgcctgcagtgtggagcctgggccgccaatatagccctgcactccaacctgcgctgagtcatctctcctacacgctccagcctccctcatgttttctttagtgtttcaaaaatgcgaagctcagggtcttcgtgcgtgagattccttccaccaggaaagctcctcctgcccctgctgcgcagccggcccctccttaaggtcttgtaaatgcctcctcctgagccgccttccccaacagccctcatttaagcagcctccttgactgtaggtccgctgactggcttcctccttgagagcacactcacagtgccggaccgcaggcacctcgccgatgttcctgtccacttgctttttgtattgctccttctccagtgagcttggaagcctcatgcgggcaaggccttgtctgtctggttctctgttgtgtcctcggagcctgccacagtggcggcgcttggtggctttgacaggggactggattgggtggaaggggcgagattagacctggatacagtgacgtccttgtcagccatgccgagtgcagagcgcctactgtattgtaggcatttgaaatgaaacggagaatgtttcccaggccgtgcctagcaaggatgcctggcagtcgtgtgagtgagtgctgtggaggggagcagtgcacacccggtgctgtcgggagcacaggaagggtgcttgggagcagtgcggggcaggtcagggaaccctttctaggatgtgtgttggacaggctgataaactactgtggaaggccgttatatgcaaggagttcacatctggacggtgactggtccagccttttagagctccttccagctctgagattctatgccacgaaaaaaaaaaaaaaaggcaggaaaaggaaataagaaattttttggtgggagttgcggctttaaataggatggtccagtaaggccgcactgagaaggccttcccagtaaagacttcatgggtgcagaagaaatttcctcaaagtcttggtttgtgtctttgattttatttgtgagcttggagaagcttgagcagggctttattctgatgtctctaattgtctttaattcagattataggaattcttaaatgttgacttgcagggttcgggaagcataccagatggaaaccgaaagtgctgccgttttgagcacctactcattgcacaccctgggtccagggtgagtctcactccgttcaactcctcggccacagatctccctgatctcagtcaggattctccaaagaagcacagccaacaggatacatagatgtataaaaggagatttatgatggagaatttcactcacgtgattctgggagctgagaagtcccatgttctgtgtggcaagctagagacccagggaagcccgaggcgtgattcaaactcagctcatgtccgaaggcctgagaacctgggcagccgatggtggacatccagtcccagggcaagagaggatgagatgtccaagctccggcggcgaggcaggaaatgaggggtgaactcctcctccctctgccgtctgatctattcagggtcttgagggattggaaggtgcccagccacttggggagggcagtccaccttcctgaacccactgtcctaatcctaatgtcatctcgagcaccctcacagacacgcccaggaacggtgttgcatcaggcaccctgtggcccagttcagtgaaattaacatcacaatctccgtggtccacaccttctggacaaggggtctttgcagatgggcagacttaggcgtggccccagattcccagatctcctaacgaatacgctgtttcctgctcctccagctgcactctgacagctcacatggggcgattgcctccatttccattttcatttccttcacagattggtttgctcaccatccagcatgtttgtttgtttttttttccccacctgagagctctcccggaatgtccccagcctctccctctggaggtatagcagatattgtggtggcttcctgcaaggagcgctgtgctggcatcactcagtgatgtccccttacgcaagctacactgactgggaacttctgttccctctggggaaggggaggtaggaggagactctcccctggatgccccttaataaccagtgaaattggtactatgggcatggagtcatctattttttaaaataatttaaatgaaaacatgactgtggagaaagccggtttcctcaaagctcataaatatttatagtttgaaactttgtttcatcttagagcttgaaaatataaactgtaacctcttgttatagaaggggaagcaattaccttttaaaggttgctggataccaggcaggaggatcacttgaggccaggagttcaagaccagcctgggcagcatagcaagactgtgtgtctacaaataaaattagctgggtatggtggtgaatgccggtaattcccagctactcaggagactgagcctgggagtttgaggctgcaatgagccatgattgcaccacagcacagcagcctgggcgacagagcgagactctgtctctaaacataaaattttttttaaagtttgaaaagtaaaggtcactggattcttttgattttatatatgtgtttatcctttatccttaaacctaacaaaaaaggggccaaataactgctttgtttaccaactttctcattagaggtggggtttcctaggcatctagacagatgctgagttttataaatgtaacgtctgtgccttcatgtggccctggtgaagcaccatcgtagaaggtggctgtgactgacaggagcacaaagcccctgatgtgatgtgatgtgatgtgatgtgatgtgatgtgatgttatttttgagatggagtttcactcttgttgcccaggctggaatgcagtggcacaatcttgtctcactgcaacctctgcctcctgggtttaagtgattctcccacctcagcctcctgagtagctaggactacaggcatgcgccaccacacccagctaattttgtatttttagtagagacggggtttaatcatgttggtcaggctggtctcaaactcctgacctcaagtggtccgcccgcctcagcctccaaaggtgctgggattacaggcgtgagccaccgcacccagcctacaaagcctctgattttagcaaagcaccaaggcctaaggactctgcccgtgtcttagcagctttagaaggaaaagcaagccaagaaaaacattgagttatttaccataattctgaagaaaagcaaatgtgagtccttaagggaggaattctgactttcttgaaacagattagtttttttcatggaattagtaacacagggacttacttgcccggttttaaggtttttggtgaggagttgcctgaaacgcaagttctcttgagagttttttcaggtttttggagaggagtcgcgtgaaacgcgggttctcttgagtacttacagccccttcccactgcccctgggaaagctgtggtgctgcctctctagggaaacaaataagcgctgctctgtgcgtgaaaaaaacagatttcctttcgttttataagatggacggggacatgggacttttcacttggctcttaagggaggggctttttgagaagtagacactggtgtcctgcgtggcctgccggactgtcttttcagctgtcagcagaacccctctgaagggagcaccagtttcagcagcgtccgtgccgcagggaagacatggcaacatcagagaccagcacagctgtgggtgaaactggacagcagcccttgggcagcattggcggctagggtttaaccagagcctgtcaggggaagcgcttctggttttgcaatcgttctttacaaccttacgaaatctgtgccgtgtgctttcaggtaaatggatttcactttgaggtcccttctcaaatgattttttaagaagtctatatagttggcaaaaatttgataaaagttacttcattggtcatgacataaagttatctgagtaagaagaagcagcacacttattctcctgtacctctggaacatgtgagcaccctggttgttctgggctttctctgccaaggctgggaaactagagttctggcagctttgttgctcctttgtcttctgtgtgagccgcggtgtcatcagccaggtcaccccgcttgcagcacagtcgctgtgctctgggcatcggtggagcggggagctctggttgtgcacagagggccaggtgtagatgttgtgcacagaagtcagccccacccaggttaggctgagccgtcttccctgaacctgaaatggttcgcctggagcccacgtgtgcacagcctgggggctctgggccagggttccttgtagtctgtatttcctttccaattctgatctcctttttgctgctgggagatgaaatcccctcacttgacgactcaggaagcatctgtttcttctgattcttgggacttgccatctccaaaggctgagctgcgggcctgggtgtccctgttgaatgagagcactccagggcctccttccacatcttatctcattatctttttgtttttttctttctttctttctttcttttttaagacagagtttcactcttgtcacccaggctggaatgcaatggcgtaatcatggctcacggcaacctttgcctcctgggttcaagtgattctcttgcctcaacctcccacgtagctgggatcacaggcacctgccaccatgctcatacccacctaattttgtgtttttagcagagatagatagggctttaacatgttggccaggctggtctcgacctcaggtgatctgcccgcctcagcctcccaaagtgctgggattacagaagtgagccactgtgcccggacttttctcattatcttgccagtgaccgtgaggtccatcatttggaatccaactgtaaaaaaaaaattattgacaaaacccaaggagtaagttccttctaaaggctgtagcatggtttttgttagcagtattactaatactgttattattttactcatttgcagtgctatggtctgaatgtgtccatctcaaaattcctatgttgaaatcctaacccttaaggtgctggtgttagggggtggggcctttggggagtgatgagatcacaaggacagagccctcatgaatgtgattagtgtccttataaaagggaccttaatgagcttgtataccccttccaccatctgaggacacagtgagaaatcaccgtctaggagccagaaagtgggccctcaccagacaccagtctccatcttagagtcccagcctccagaactgtgagaaagaaatctctgctgttcaagccacccgcctgtgaggttttgttatagcagcccagactaacacatgcagcgaacctgaaatattcagctgcgtacttcttaagcgatcctctcccctcctggggttgacccctttctaatgtcaaaccatttccctctaagaaggtgattgtaatgatactagaagactgttccgaattcagaatgcctttaaaggagtatctgtattgtattaatcatagaaatttttactatgaatttattactaaatactatttacatagaatttattacaaagtaatatttattactaacaatacttacataattttactatgaatttattactaagtaatatttacatttacataaatatttacatatttacagatgtgtgaaaattgcttcttctattaaacgctatcagtcacttgcagttttaatttatccaccacagtaaagtaagctgttgtctttttggctgatcttttcctgtcaataggctttttcatttttattgtactgttccttggggagcagggctaccccaaaggcggtgtacccagagtagccggctttttaattttgtctttgacatacgaaaaggaggtagttttaggaggaattttcagatccattgtacaactaatttttttttcaaataaagtatggggcaatatttatgtattaatgtcaataatgagtcatcatagggtggaatttccaatgaaaaatacattgaaacgctaatgatgtttggtttgtgtattttttatcaactttggtacaagacagatctaatgactatctaatataaaacacctgttacttgagtgctcctcactgcaggtatgaggtaggactgctgcccttactttgcggatgaggacctggggtcccttagttcatcctgccaacaggtagagcctctgctctgtgccggccctggggacacgggtgtgaacagagcagagccctgtccttgtggggcttgtgctcggtggggagagaatcatacaggagatgctgagtggactctgaaggcgggtagccagccggaagtggtcaaggaagtaaagcgaggatggagcgtgggaaggatgggcctggggtgcagttttggataagatggccaagggcaggccaccctgagaagcttccctgccccagtcctcactgagcattgaggaagtgagccgtgcggctatccggggcaaagggtttcagttgtcaggaaccagaagtgcaaaggcctgaggcagaagtgaggatgtgcctctttgaggacctgagtttttgccatgaatgagatgggagccttgtagggttttgaacaaagcgggtgataagagctgacctaggcttagcaggctaacttgaccactggttttgacagtagactgaaggggacaagtgtggacacaaagcagccaattagaagacttgccataatccaggtgagagatggtggtggccggacccaagtgagagccatgggagcagcaggaagtagggaaattgtagctgtctctggaaggtagaaccacggcattggctgacaggctgggccagacctcaggatggtgcatctcccctagctgcaggccgctgctgctctgtggggagtgaggtcctcctgtgcggcccaggtccctctccatcccatccaaattcaggcccacaggatggtccagggtaacccacagcacctgggcactctcctactacagccagtggccagcctgcagggacagacagcctccaaggccacagtcagctcggcccacacccttgctgatctgcagaaggtgcagaagcagcttttcaggcagcatggtagcagggcctgggtaggccagctctggcttaacccaagtgcaggccgtaagcactgaaggcgctgctctaggtgggtgtcgggtagcactactcatgatggtcactgcttacaggagggagttgggtatgcgtgagaaggaaacatgttcacagattcccgaaagagatattgaaacttgcagaggccaactctgtaattgcaaatgaagcataaattaagattttccgtttagttgtctaaacagttacccatgcagtccatagaagagaagatggatgcctgcagagcaggacttcattaagcagcagcctgagtcctaagtggaggaagcgcccaaaatgatcacggagcttgtggtactttcacctaataattcatcgtagctcctccacggggcacagagcggtttctgcgcgaacaggtttttcatgagctcagcggctgctcttcggtcgtgtgtgtgcctaaggttggccccttaatttgaaacgctgcagcgtcttgtttagtgaggctgcctgatgctgatatttaattattgccatgtccaagtgcgtttttggtgctgttgaagttaccattgagtttattttctgcagtagtaatttactacttaaatttacttcttccagcttttttccatttggtcttatcgcaagtttgaactttcctccagatagtcttagaggcaacggatgagaacagtgagcaagctgctgtgttatcctggctaggtttttttttttttctctcttataccttattttaatgctcattaattcaaagagatttctgtttatggagacagtaattaatagtaaatctcccatcaaattcaaggctctcttgattttgaaacttctaagaactcaggctaaatgttttaaattgttctttataccttcatgaaacgttttattggaagtgttgactgagcctagttttcttactggaaacaagagactagaaattcaaacatgtttgtgaaatttaagcatttttattactaattggtactttattacttattattgtattataatgggacttagaggaaaataaagtataaaaataagtataaaagcttatttgaagtagagaagccaaatgtctattccattttttctaattttcagttgtcagtatacatacactaaattttcctcattttcagttgctagttatcctgatttctctttgagctgtggtttgaggtcatgactgcttagatattattggaggacaattttcgtgaagcaaatagatcaactaaaaaacaatttgggggaaaataaaggaaaattaaaagttattaaacataaatgtgtaaattggcagaacctttctggaaaacagtttagtaatatttatcaaaacctcaaaaatgtgtgtatacttttttgacccagcagttttataattcaacatctaggaatttgtcacaagaaaatagccatatatgtgaaaatagggatgtatcaaggagttccttgcatcgttgtttattctttccatacactggaaagaattccgatgtccagccatagggattacctcaatcttagcatgtcccacatgtcggactactctgcagccattacagatcttgaaatcttgaatgacataggaaagtgtttacgatacatcgctagaaaaattttaaagtgttacaaaatgttctgtaaagaataagacagataacattcctagatgttaataagttatttctagatagtgatatttttaaggatttaattttcttctttatgtatttctatatttcctctattttttgcactaaaaatacacttttataatcagaaaaagacaagttctttcttcttttttctttttctttttttttttttttttttttgagacagagtctcgctctatcccccaggctggagtgctgcagtggtgcaatctcagctcactgcaacctctgcctcccgagtagctgggattacaggcacctgccaccatgtgcccacacccaactaatttttgtgtttttagtagagatagggtttcaccatgttggccaggctggtctcgaactcctgacctcaggtgatctgcctgccttggcttcccaaagtgctgggattacaggcgtgagccaccgcccccgaccaagacaaattcttttagatatgttatcctacagcaatgctgtccaatagcaaatcgaatgtgagccacaaatgtaaggcacgtgtgtacttcagattttctagtagccacattaaggagaaagaacgaaagaaaaatgattttaataatagattttattgaatccaacatatccaaaatattacaattgcaacatgtaatcagtataaacaaaagaagtttacgtgttctttttgtactctttgtgatccagtatgtatttataatacctctcagttcagctgggccgcacgtccactgctcggtggccctcgtggctgggacagagccaccattagatggtctcttgctgggctgccaagatagcgtagatgagtgagtgttttcagtgtctggagatattagactcaagtagtgtctgaatgcacaaaatgtcttctaatgtagccaggcttaacagcatatcccatacttccagattttaattactatttttaaaaaatgttctagagaatttcagaagtgttgggtcctcagaggtcagctcagctctggctctagtctccgtgcctgctgtaagctgcgtgagagcaggcggcagcccaggcatcttctgcctcctgcctgttcctctgctcccttatctctccagatactcacagcagtgtagaacagagctgaaaaatctctagcttgagcccgcgcggtcaaggctgcagtgagctttgattgcgccactgcactccagcctgggggacacagtgtgaccctgtctctacaaaaaaaaagaaaatctctagcttaaactaaatcggtcaggcttgataactgtgtgattttgagcttccgctttctcatttgtaaaatgggcataatgctattcctcgcagagttatttataaagactaaatgagctaatggacagtgagtacttaacacagtgtcgttcacatggcaggcgcttagtcccatgaacgcagattgttatggcctctctgaagcagccttttggttgatagactggcatgaattttatgcatgtctgcatctgcttatttatttggcaccttggtcggtgtttaaaggctttgtggaaaggctctgggcctttatttaccacagtgtgctgaggccccagcttgaccaggttggatcaggaggagggttctaaagaacactgcctgggggtgccaccaccaccatgcgctgcacacatcatgtttgataatcaaaagcagcctttctaaaatgaacattagctgcgtatcctcttcaatatctttttttttttaatttattttaatagagatagggtctcggtaagttgtccaggctggtctccaactcctgggctcaacagatcctcccgcctcggcttcccaaagcgctaggattacaggcttaagccatcacgcccagctctcttcaacgtctttagtggtagaaaatgttgagtggtagctctgtgattcccagacctcaccatgcaatccaagatggccccaacgaatgggccaagaatatgtttaatgaaaaccaacctagtgacactgcccccagaggacaaagatttcaccattttctcacacctcctcacacagtttctttgcactcttatcagtttttcacaaaacccaacttgttactgtttggacttttgacactcagcccagtcctattggctttgaagtggtgggaccaaggaaagccagccttgtagcaggctcatctacaagagtctggcccagtggcactcagaccatagtccagaggaacccggtgtatgtacacgcgtgtgtgtttatgggtttatgggtttacgcatacacacacacccgtctatatatagctgtctctgctaaaacaaattctttgaaacacttacctttattatttgcagtctattcagttagttaccagtatattcttttcctttttaaaatgcctactaaatgatttcacaatgcagatcctgacttgaatttcgaaaacactgaattagcacatgaagctgttacctgttgatagtgtgtgcaagcttttcccccttagaatgatattttgtgtgtgtgtgttctcaagttttgctgatcttttctgtacttaagaggacgatttcgttcccccttgtactagtgtttgtcatgtagtgaaatttttagtgaagggagattccgagacttatcctgacccctggaagaacaggagaggaagaagttggtctgcccatggccatggctggcgggtgggggttggggagatgattccaggagtttccagcctgctggcttgtgagttttgaaatggagccctggattttcactttccagttcaggagatctggggaaatctggattggtttggagttgtttttttgtttgtttgttttgttttttttttttttggacttttaggaaaaccttttcaaggcagctgaaaaaagctaatgatgataatttgcttctcctatgccattcctaaacccagagttttctctgcagttccatctcctcttgagaagcttagcttggatttcccactgtccaactgaactaaatttgttgaaaacctacctaaatgtcaccccttctaagccatcccctcctgtggacctgacttgggagaactggtgggtattgtgcttacacaacagggccctcactgctctccctgctctgcaggtttggtgaattcctggttttggatctctccatcttttattgagagcacttggggtgagagcacttagggggctcctgatcactctcctgctttagctgctccttccctgcctcctgtcccacctgccacgggacctgcaggcagcctcagaccttgccattctccttttccaaagccctcgatcgtcccctttctcacacagacttcttagctctccacagcctgtctgtgagcgaggcctcaccagcggtggcgattctggctgtcctccgacggtcctgtccttccagttatggggctggcctctgtactctgcatctgagactgtcgcttatctgctcgtgctctgtcttgctgctacgcttgttttgaaagttctcccatagcaggagccaagtttaccgccttttgggtttttccccattcgttacccaccacttttcattgcctgaggtgagccctcggtatagtcactggcagagccaagagggggctttcttagagaaataataggcctgatcccgtacggcagtgcatttgttgcggaaggcaaatccgcggagttatggtggggccagggctgcgctgtgaaatggcagaggctctgatggctggtttgacggcttactgcctcccttcgtcagtttctcgctgacctttacactaaaaggtatcttgcacttcagttttcgagaggaactaagaggcgctgtctttgtttgctggattcatcaatgtaaagaaatgcatcctgtttacacttctggcagcgtttcttttatttggatggtggccaaaggcaaacaactcagccgagtgggtttttaaaaaacagagctttccaagtccacatgctgttgcccgagtgaacatccagaatcttcagtttgtcttaatggaactgtttcatcttgtagaaaaaggctcatattatcttaaagcattttatgtctatcgtagctttggtatttattgtgggaagattttactaaggaatgactaatcttaaaagatttggtttgattaggggctaaactaacataatctattttgaaatgagataacaggatttgcagtttttggtcttcatccagcaaaattgaaccccaccccccaccccccccaaaaaaatctacatccccagcagagagggaatctatactttgactagaagtttaagttgctggatttataagttgtcttaaaaatatgctgtctgaacagtttgaagtgtgacattgtattgagatgaagtcatcaaactgcttgagactttaaccgtttatatttgggtaaccaaataaaatgtatggttattcaaacaattaatacttcagtaataccattactgaaaaaaggatttttctcttagctattaaagagacttgaatgagttgtcgttcttatttattttaagtgtatgtgagttttaggattttcttggcttttgtgttttagaaaattggtctttcattggaaaaggacaggagtaagaggtttattataatatgcctcctatactagtattttacttttaagactttagcaattctatataacaatggtaaaagtgtaactatcagttctgcaaaagtacggtaaatacattattgttacaggctttaaactccagagagagcttacgtctctctctaaaaaggaagaaaaggggactcagaatttagccaaatgtccccaagtagaaaacttcgctggaactcagatgtggattttcagaacaaagttggcagagagcagtttttgactagaataaatgtaaaagggcaaaagagagacatcttttttttttaatgccttttttccttcaaaggaagggaaaatggactgtaactacaaagcttacaaaactactacttaactgttcaaagctcatcagtagtttagccacctttcttgtgttttgaaaaagggaaaggaggagtcttttcttgtggttgggtgcagttcatttggaccagctccagcttgcttgggcggattgtgcggtgggaatagactgctgttgcatgggccggttttgcgtgtgtgtgtttttaagccaaacctatgttcaccctgatagttggggaaggcctggtgtgtgcagtcctgcagtcttcgtaagtgacctttggccttccaagtcctacctggccccctgacttcgtctttgacataaaaatgaaacttcctaggggttattgatttaacttctgagtgagattgtactccttgtgaagctaaacttttcatttgtaaaaatagcacctgaatagatacctggtgggtcggacccaatttctgtatttgagttggacgagcagggccttcccggatagcgggagggttggtgacttgattgggagggcatggaggctgaaaccccatccaagccactgttgccaggctgggccgcatctgcctggatgatggagagcgtttttctgatttgtacaaaggcaccgagaccctttgcccgagacctcgccagagaaatctgtgtgctaccttctccgtgccgagatagtttttgttgtgcatagtggggaaaagaggaattgcctttgtttccttgggttcttgaacctttttggttttgtccttttggaaaggcaagagtttggtgtggtgtagtcaaaggaagtggggagatgaggacccggaggaggaatcacagtgggggagccgggaggaaggaaagtggagagtttattcaagtcacattttccctctaggtagattccagtccaccactgccactcgctcagatgaacccacccttcggaaagctccgtctgaggcccacctccagttagggttttagcaagcctcccttccctactatctctttgccttcggcctctgctaaccctccctctccacatcacatcgttggaacttacattgccgtggtcgctagttaactttttaaaaactttttattttgaaataagtataggttcacaggaggttgcaaagatagtacagagaggcaggcagtttttcccagtggttatgacagacataatttcagtatgctgttgaagtcaggagacgggctttgggacactgtgtgtggttgtgcgccctttcctcacctgtgtaggtttctgtaaccaccaccacagtccagaccacaaagatctcctcgtgttgcccctttctagtcacttctccccctgtctttcccattactaacccctggcaaccatgaatctcttgtccatctctgtaatcttgtcacctcaagaatgttattaaacagaatcgcatagtgcgtgatcttttgagactgacttttcgtttaacataacatcctagagcttcatccaagttgttgcatttccgtagtgaactcccatttgttgctgggtaatggtccatggtatggtgcaccacagcttgcttccagtttggggctatgatgaacagagctgctgtgaacattacagggttttgtgtggacttagctttcaaatttctgagataaatacccaagtacagctgctaggctgtatgggagttgcatttttagtagttataaatccacccaactgttttctagtttgtgccatttgacattcccactagcagtgtatgagaggtccggggtctccgcctcctcacctccgcttggtgttgccgctggttgtcttggtttggtggttggttttttagctgctttaacaggtgtacagcagtatcttactgaggtctcgatctgctttttcctgatggctggtgatcttgaacatctttttcacttgtgtatttgctgcctatatatgttctccagtgaaatatctcatcatgtcttgcccattttctttaaaaaattttttttttctcttcatttcattctgtgacctgctgaattttgcccattttctaactggatttgtttgctttttaaactgttgagtatgtatgtatgtatctcaggatcttgctctgtcacccaggctggagtgcagtggcactgtcatagctcactgtaacctcaaactcttgggctcaagctatcttcatgcctcagcctcctgagtagctggaactatcagcgtgtgccaccatgcctgcctaatttgtttgatatttttgtagagacgaggtctcactatgttgcccaggctggtctcgaacttctggccccaagtgatcctctcccctcagcctcacaaagtgttgggattacaggcgtgagctactgtgcctggcctaactgttgagttttgaatgtccttgtatattctaaatgagtcctttgtcagatatggcagatgtgtggttggcaaatattttctcccagttcatagcttcttttcagcctcttaagagggtctttggcggagcaaaatattttcgttttcatcaagttcaatttattgataatttttctcgtgtgaatcatgtatttggagtcacatctaagaactttgagcacaccctacatcctgaagatattctcctatgttatatatagttctacattttgatttgattttgtataagctgtgaggtttaggtcaaggttcttccccaccccctcccccgctccccccaattttctttacctgtggaagtccacttcctccaacagcgtttgttgaaaagaccaggcttcctctttttaattgcttttgcacttttacaaaaattacctagctgtatcaggggctatccctgggttctctgttatgttccattgatctgtgggtctgtcacctcaccaataccacacagtcttgattatcatagctatataataagtcttaaaatcagatagactgattgttcccacttttctttttcaaagttgctttagctaatttaatgctttttcatataaattttcaaataatcatatttatatctacaaaagatcctgctgggattttatggaaattgtgctaaacctgtttattaatttaaggatattggtaccgtgttgaatcttctaattcgtgaccgtggtatatctattagattttgaaaatttctttcctcaacattttgcagttttcagcacataagtcctacacatattttgttagatttatacctgtttcgtttttttagtgatagttagtagtagtacatctttcatttcactttccacatgttcattgctagtatatagaaagacaattgaatttcgtgtgttgacattatatcctgcaactattctggattcatttgtttattctaggagtttttttggtagattactttgggattttcaacatagatcatctttttatctgcaaatgggtttagttgtgtgttttctttttttgtgtgtctaatctatttgttttcccccctgcttttcctgagctgtgtgatcttttatttcattttcctaccttgtcgcactggctagaacttccagaaccatgttgaatagcagtagcagaagtaggcatctttgtcttttcctagtgttggagggaaagcattcagtctttcacattaattatgaggttagctgtatgtttttttgtcagtgttctttatcaagttgaagcatttctctgttcctagtttgcaaaggttttttaaaatcatgagtgggtggtaagtattttttttatccatacatttgtctttctagccagactctgagtttctgggggtcagatactgcttcttaaagtttgtttcccccacaaacaaacacactgaacaaatgtttgtggattggtagaactaggcatggtctccaacggcagacagacaaggtcctgaggggaaaatcagggagcatctctaaccagaccgtcctggtcagctgggtctggaggagactttcaactactctttggtcatcattacgtctgactcagtggttcaaggcagaagtggaagttataggcaccaaattgatgctgcaggagagagatgaaggaggcagaatggattcatctgctctgccctgggtgtcagaaatgaagatttttaggataagtgccaactaaaaatcattaagttgtacacttcaaattgatgagttatatggtacatggattatagcacagtaaaactgttatttaaaaaggaaaaaaaaaaaaaggccggatgcagtggctcacacctgtaattcctagtgctttggaaggctaaggccagaggatcagttgagctcaggagtttgagactagcctgggcaatatagtgagaccctgactctacgaaaatcttaaaattagccgggcgtaacgaggcatgcctgtggtcccagctccttgagaggctacgggcaaggatcacttgagcccagaaggtcgagattgcagtgagccctgttcatgccactgcactccagcctgggtgacagagcaagacccagtctccaaaaaaggaacatagataagtgcctagtgagcaggtgaccctggttttctctgtcctggaggatgggatgctgctctcagctggcctgagtccctcagattgctctgagatgagaaggcttttccagatggacagatgtgtacttgatagccttctcagggcccttgaccactctgtatacccccagtgtagaccataccagagagtatgcagtgtgcccctcagaagaacacagaagttctcataaacactgccttgctgatttcgaaacattagtctaaggatggtggaacagacctcctaactgctcagggggtgctgtttttgctgagagaatattttccaaaggctggctgcattccctaatactatgttagttatttcttcatccctttgaccctgttgatgaggtaagaaggggcagaacaacattaactttatttttaacaatgaggaaacaagcaaaagaatgaaaagtagtttctcatcacaaacgatggtgacgttaaatctagaacatgatcccctggctcccgttttggtgggcgggctacttggcttgtcgtattttagtcttttcctgtctcatgactgctgactgcctggatttgtatgttttcccacccgttttaagctggaagaagcagttgtatcttttggaatagaggagctgccagatttcagtgatgatgacaatagtagcgctggtagtactcttggcagtacagtcatctcccgttatccacagccagccgccaacggaaaataggcgcggacagtgataccacatttgagagacagaaggagagaccatatttacttaactttcatgacagtatattgttataattgttgtattttattattagctattattaatctcttactgtgcctaattcataaattaaattaaactttaaaaacaatacaggtagggcttggtaccgttcagacatccactgagggtcttggaacttatgccacggataaggggtggaggctactatagttgttgttaaaacattgtttttttggcggggaggctgaggcgggcggatcagctgaggtcaggagttcgagaccaggctggacaacatggtggaacccccctctctactaaaaatacaaaaattagcagtccatggtggtctgtaatctcagctaaaaataaaaaattagccgggcctggtggcaggtacctgtaatcctagctacttaggaggctgaggcaggagaattgcttgaacctgggaggcggaggttgcagtgagccgagatcactccattgcactccaggccagggcaaaaagagtgaaactccatctaagaaaaaaaaaaaaaaaaaagttgtttttttactgatacacttcattttccagtgaaattttctgaaattgttgccacctcctccccgcccagttgtcttttttccagtagctttgcaaatgaatgatagcagaaagcagacttctttctgtggtgcttatgtacatctgttttcttttttttcttttttcttttctttttttttttttgaaacagggtcttgctctgttgcccagcctagaatatagtgcagcaatcatagataaccgtagccttgacctcctgggctcaagcaatcctccccgctcagctgagactacaggtgtgccaccaccaagcccagctgtttttaatttgatttaattttttgtagaagcagggtcttgctctgttgcccaggccggtctcagactcctgtgttccagcagtcctccctctttggcctcccaaaggggaggctcacagtgtgagccactgctctcggccatgtgcgtctgtcttggtgaggttatactgctgagagttaagactttccacatcacaacaaacaaaccaagagacagactcaggctgcacagctcagagcttgtgagttttctgcgttatgacaatggatgcccattttgagcttctctagcgtggtttagtctttggaatgcaattaaatcctctcttctttcttttattttctagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctggtgagtgagtaggccttcttgctgggcacctgatagtgtgttttttacatgactattttggaccgttagttgaatttccttaaaaactgtgtaacagtccaagcaagctctaaatcaccgtaagttgtaatgatcaacaaccaaaacacgggatggaggcagatgctatataaaaggctcaagaggggaaggagcaagagccactcaggtaagatcaatagctttcttctgggaatacggagggttcttagaatcatcagcattggcacaacccgagaaatttagttttttttagagatcttgttcatagtaggaaataacaccccccacaacagcttcccactttggacctgtgggtatgggcaactcacgaacgccttcagatcagcgcctcggaagcaaatccaactcctcccagttgttcccttcagatttgttcctttcgttttaaggtctaaaaacttcacaaagcccagttatttagattcatttggggtctgaatctataaccagaaaatctggggggttttgcctgtttgctttttgtttttttctacctttcaaaattaaccgtatataaagtaaaatgtacaatttttctgataaccagcataaatgtgcacagctgatattaatacacacccagggtatccagaaatgcctctcactctcacagccgtttgcccccttagcacccagagtcaagttgaagtcatgaatcctttgccgttcttatgattttgccataatacccatttattatttgtaaacacgacagtcttgagttttactgattcttaaccttcatataagtcatttcttagtgtatagtatatatgcttctgtgacttgcctttttcactccacatgttggaatttcatcaggcgaggcacatagcagcggttcttcccttttcactgctgtctgatgctccactgtggaaagatactaggatccattccttctttcattgaggtacttttgaactgtttttcatattttgctattggaaacgtctttttttttcctttttttttttttttgagatggagtctcgcgctgttgcccaggctggagtgcagtggcgccatctcagctcactgcaacctccacctctggattcaagtgattctcccacctcagcctcccgagtagcagagactgtaggcacccaccaccacaccagctaatttttatattttttagtggagatggagttttaccatgttggccaggctggtctcgaactcctggcctcaggtgatccacccgcctcggcctcccaaagtgctgggatttcaggtgtgagccaccatgccccaccctattcatatcttttacccatccttttcctgcagagtaatttttatttttctcaatcatctgagaggtgctatatagtctgctaatagtcccctcagttcaatttccttatattcttctcccaagtccccctaatgttaacatcttaaccactatacaactattaaaactaagaagttgacatcggtatgaaagcatcaattaactgtagaccttgtctgaatgtgacccacctttcctcttgcgctcctgtccgctgcttcctctcgcgtcctgtccgctgcttcctctcgcgtcctgtccgctgcttcctctcgcgctcctgtctgctggatcctggcctggaatcccccattgtgtttagtcattgtgtccccttggtctcttgcagtccatgatagctccttgatctttccttgcctttcatgaccttgacatgtccagagcactggccaggtattgtgtagaatcttcctgtttgggtttgtctggtattttctcgtcatcaggatgaggggatgcatttttttggcacagaaaccgcaggcgtgccgttgagccctgctcagatcatctgatcaggaagtgcgtgatattgtccagtggctggtgatgcaagcctgggttgcttggttgaggcactgttggccacctttctccactgggaagtcagtattttctctgtgttgttaacacatatcttagggagatacattgagaccctgcaaatagcctgtttctcctcaggcttttgcctgtaaatgttaatgtcctccagggcatcttaaggatgacgtttttactagcccctttccatctgcacattccttctcaagttaactttaacagttaaggtaaaagaatcaaaagggagtggaagatgtggttgcggtagaaaggaaattttaatctcctaaagagcagggctggaagaaacaattgggaaatacatgtcagtatctcaatgtgaaattgaggtttacaccttttccccatacactcacagagtctgggaaagaagattctcattcatttagaacttggatggaaattgaggattttccaaagaaggaagcagaagtgtctggggctgatcgtactgagtgaggcttctgtctgggattcggcatggtgcagcagctttgacaggcttctgtctttgccctgttccgtcagtgcagggtgtcagtgctggaagggacctcccaatttaggaagtcaagcccttgtattgtcacgacatggaagtaagcccgtaccagttatgctgtgcctgaggccacatcatcttggtaatcactgtgagaaatttgggcctcaaagcccagtctgcttgtttctccccttcttcactcattcattcattcattctgcattcatggatcacctactgtgtgagacccggtgctacatgctggggatatagcagtgaagaagaccaaacatgagcctgtctccagcgagtgagcttttaatctagacgtgcacttggcgggtgattagggtaaggtggccacaggtgggtcagtagtcgtccctttggttcgatcttatgcttcagaccatgagactttgtgaagatacagaaaatatactgttgtagtcagtgatgcatttgtaaagtctgtaataatcagatgcagagatgatgatgtgaaattcttgtttattgggtggtgggtgcatgactgttattcctatactttatacatttgcccttctttttattcttcaaaaaaaatgatggagcattttattaaaatagctagatagtaggaccctaatagtcgttgttgtcaaaatacacaattacagcaaaactgaaagaccatacccatctgaagtcaccgttaccagggctccctcccccacccctgcagtagacccttgtttctcttccaatcttttcctgagtgtcaaagcttttctagggcaatgcttcatcaccttgttttttgcttgtctttcttccccagctgacagcatttgacagtccctgtgaagagctgcagctgctttgagaattgctgtcagccaggtactaggcgcctccctgttccctctgccgtcttgctttttcctgccattccagtcagagatagaaacaaaaagaggaggaaaaaaggctgtgtctggtgattaccttgtgacgaccctttctcctctgagaggagcagggtgggccggggtgggggatggaaatcttccctttccataggggaggcagcctggccgccttccccactggccccttgccatgcctggccattgctgtccactgctggtcacagacagcagacaccccatgagcatcacttctgtggctcagttaaaaggaagatgatctcgccatgttagaccttatcttccaaaacacagttaagtaagacagagcaggatgctcaacagaaagactttggtcatcggtataactaatataaatattatcttcttgtctgtcctcttttttaataaaataaaatttagcatttttaaatatagcttgctcattaactaatgtgcttataatatagtatgtggatgatattgcctacatactacaaatgtggatgaattatctacttttgagtataccatttatttctttaccttttttttttttttttaaagggacaatcttgctctgccttccaggccggagtacactagtgtggtcatagctcactgcagcctggatctcctgggctcaggcaaaccacccacctcagcctactgagtagttgggatcacaggcatgtgccaccacacctggctaatttttactttttctttttcatagcattgaggtcttactatgttgcccaggctagtctcaaactcctgggctctagcaatcctcctgccttgggcttccaaagtgctgggattacaggtgcataccaccaggcccagccttggtgtacctttgaattttaggatctagttaattagaatggtatgatatagatatatcagtgtctttggtgtgtggctcctgacctgaatgtgacctggatttgtatgtcatagtcctccttctgtgccacggaagggtattctttcagtgagtcctttctgtgtgccaggccctgtgctgaagtcaggtctcatttcctcacatagccggtaggacagacagacatgcaagcaaataattgttataaatgtggtaagaaatataattgaggttagacaaggtgttgcgcgcctgtagttccagctattcggtggctgaggtaggaggttcacttgagcccaggagttccaggctacagtgagctgagatcgcgccactgcactgattgcagcctgggcaacaaagcgagaccctgtctcaaaaaatatgtaattgaaaaataatcaggctatgttaagcataaaggaaaaaagcagacaattctatccggcaggaggaggtcagaggtgctttggaggagacttttctaaaggcaggtagaatgacccaggagacagtgcggagtgaggtggcagagggagcagacacaggcagggactgggaaagcagccggcagggcagaagcttgctcagccagaggctgccctgcagagttgagcaggctttaggcaagaagagtatgcatgcacgtggatgcaagcacagaaaccccagctcaaactggcttaaccagaggcgctttgtgagccaaaaactgacacaggcggtagctttatgtgcactgtgagctatttctctgccctttcctgggctttcctgggcttctctgtgctggttcctttttggcctggcttcctctgtggctgcaaaatgatggcagcagaatgaggcctcacacacacacatcaccaccaggagcaaggaggggacctggcacatggccagggagatgctgtgcgtggttggtttaggcatggatgaactctggatccctgtcctcaccactggagaagtaggggccgcctaactggagcagtgggtgggatgttgccacccggtctgtgtgctgtaaggtgggtgcaggcaggtctcagaggtcacagcgttctctgcggccacatgtaccaagcagtttgaactcacctatggggagtagtgaggcaccactgaggtgtcagagcagtaaatcacagatctgagttgctgtttttccagaaatcactgtgactcatgtaaaagatgcctgaaggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagatgcctgaaggggtccgggcacagtggctcacgcctgtacttcgggagcactttgggaggccaaggcaggtggatcacttgaggtcagttcaagaccaccctggccaacatggcaaaaccccgcctctactaaaaatacaaaaattagccatgcatggtggtggggcgcctgtaatcccagctactctggaggctgaggcaggagaatcgcttgagcccagggatggaggttgcagtgagcagagatcacgccactgcactccagcctgtgcaacgtgtgtgtgcaacaagaccctgtcagaaaaaaaaaggggaggtaagatggggcaaggccggctgagctctcctgggctccatagagaggcagtgtggtcatagcagggcagaggtagtcttgatccttaccctcatgtcctactgttcatcaccccatctgcttctttcctggctgcacagctctttgcttcctacctagttaatatcctcactatctaactttcctccaaacatggcctgtgagcaggccggtagcatctttaggtacagaattgcctgaataagtggaactacttattgtttttcatgacttacttttgaaattgtggccagtcaattacatgtagtaactaagttgtgaatataagttgtgtcttttcttgctcggtccagagtgtgcgctcctgtcctcagctgcatatgagccagaggagggtggggagggagagctcccctcttcttttagagtgacttcctagacgtgccgtccaacacatcctcagaagtctcctgaacgggaacacagttacctggccacagcgacaaggcaggctgtgcggcgtggactcacagccagcaaactgtcccggggaggagctgttgagcagcctgggggagcctggatggatccatggggtggccatgggagcagcttccacatattcttggctctctggttttgctggcatttgttttttttttttggagacagtctcgccctgttgcccaggctggagtgcagtggcacaatctcagctcactgcaacctctgcctcctgggttcaagcgattctccctcagcctcccacgagcagctgggattacaggcgcctgccaccatgcccggctaattttttgtatttttagtagagatagggtttcactacattggccatgctggtctccaactcttgacctcaggtgatcctcctgcctcggcttccaaagctctgggattccaggcgtgagccatggtgcccggccctggcatttgttttctctctgccgtggtaacagagttgagaagatgaccacaaatctggactacattttctgccttcttgtggtttagcatagccgtgggactgagtgctgggccttgctgtaggggcgaaatgacacttacccccggcctctcccccttcccgatgcctggccagtgtcaagaatctgagcagtcagcgtggacccacaacggaagcggccttcagcctgtcttgtttaagcctctgtgtcttggctttagctctcaccaacgtagcttcccagagtggcgtttcccggaaagctcagaagatggtgggtgcctgggggaagggagaagagtgttgtagctggaagaatggcaagcgcagaggcccctaggcgggagcaggcttcgtgctccagagtgcagcagggaggctgacgggaggtgggccagagcggtgggtgacaggcgacagctcgtggtgcctgtggaggggcgcctgagggctgccggaaggacttaggaattggtcagaggcgtgctgtggtttgactgacacttaaataggattgcgttggtagccatgttgataataaaagtgagggtcccatggaggctcttgaagtaatgtaggtgacggtgacggaggcggtgagctgccatcagtttccagacaccctagaaccgggagggattcacaggccacctcgcctattgctcacacagcttcaggattgctggtgtgtccgccctgaggaagagcgagccccagggttgttgtgttctgtctgtggatttggggtgcttactggggagcccaccgcttgtctttgtgagtacgcccaggctgcctctgtgtgtttggaccctgcccctggagggcagagcagacagagctgaaccccgtgttcatggtgtcactcacagtggcatctggtgtcttccttgccgggggcttggctctctgccaggagacatgtttcagacccagagtccccagtctccccatgaaggccatcacccatcgttccttcaggtctcgagatgggcatggtgggttggggatgcccagagtcgccatcttgaatggggcagggagaggttatagcagctcagagacacctgccccagggacagcatcagtcccggtctgtgctggtcacggactagctgacttctcaagcattcgattagtgtttaattagtgaaaactaaagtcagcaaatcgcaccagcccctaccaggtgcatgagaggattttccccatacctcagctatatggctttagacttctatatgcttagtcttccatagatagacagacagacagagatataatatgtttatacgtttagttttctgtaagttttgccagcttggtaagtcgaacttttcataatcattggttcttttcatatgtttattggccatttacatttattctcttcttagttggctattgacattctttgctgctttatttttctttgggaataagcatcttttgattcgtaccagtcttatcgccaggcgcccgttttttccaactcccttttctttttttcaatttttcattttgaactaattacagattcacatgaagttacacagatagtccttgtgtgtgtcacctggtctccccccaatgatgacatcttacaggattatagcacgggatgaaaaccaggagactggcattggtgagcgtgtgcatgtagtactgtgtcactgtattacatgtgtaacaccacagtcgaaatacagaaccatctcccaccatggcctccctcatgccgcccctttccagtgtaccttctttttaaacggaatctcgctgtgtcacccaggctggagtgcagtggtgcgatctcagctcactgcaaccttcacctcctgggttcaagcgattgtcctgcctcagcctcccgactagctgggattacaggcgtccgccaccacacctgactaattttttatttatttttttatttttcgtatttttagtagagatatggtttcgccatgttggccaggctggtcttgaactcctgaactcaggtgatccacccacctcagtctcccaaagtgctgggattacaggcatgagccattgtacctttttatttctgagtagtattccctagtatggaggtaccacagcttgtttatctgaaaaatgtgtgtgtgtatgcacatacacaatacacttacacatgaagaaaaatgtgtgtgtatatgcacatgtacaatacacttacacatgaagaccgcatcacttttcagctcataggataagtcacaatgtcagaaataagtgaataatttctagagaaaatagagttatttcagatattaaaccatcagaatttactttcttagttttggtttggtactgtatatatgtgtgaccgtttttaacctttcacgctaaattaacttccatagtgtgattcagagctttcttaactgttacagtcagaaggacctgagaaattcccctaccaaatcctatttgatattgacaccgtttgaggtctgagacttgaagaaatttgcctgacgtgacaaagctaatgaatgacccagacaggcttgagaagaatttagagtagcctgggtagtctcatgcttacttgggtgctgatcccagctctggagcgggtgggacacttgcttttcctctggggtggctcttgcctgaggatacagaagcaggaagctgaggtatttgctattcttggatcctgcactggtgagaaacttaatgtgtttctgcctgtgatgttggcctttccccttcatttcattaatcacgaagagtattatatacttataaacctctaaaaatctactcctctaggggaaaaaaatgaagtgttaagtattttaacatagatccttaagccagtacatagtggcccagggtaaaaatgtgtgatgtaatagagttaataatgaaatactttatgtgacagcaagaccagaaaccctaaaggaaaataatgatggatttgaatacataaacgtttttaacatttgtatggcaaaagtcaacataaattaagagtcaaatgacaaatttggggaaaattgcaacctataacaaaggtgttttctgtatgctaaaggagtgagagggcgcttgcgaatcagtacacaagggatgcatccccaggagaaagcgaaggaaagaaggaagagggtcatcatccatgccactcattgtggaaacataaattaaagtcatggtgaaatagctttgtcagctaggttgggagtgattttaaagaataatgctttgggctgattgggtctcaggaagtaggtactatcatacataaaaggtaggagtatacagtgaggaagttccacagtttgtgtcaaaacataaagtgttattctattctttggcagtaattcatcgtcccaggaatttatcctaatatagtaattgtaagatttccagcttggctgggcatggtggctgatacttgtaatcccagccctttggtaggtgaggcaggcatattgcttgagtccagagttcaagaccagcctgggcaacggggcaaaaccccttctctcccaaaaatacaaaaagattatccaggtgtggtggcatgtgactatagttccaactactcgggaagccgaggtgggaggatcccatgagcctgggaggttgaggctgcagtgagccatgatcacaccattgcacctcagcctcagtgacaaagcaagaccctgtgtcaaaataaaataataaaataaatgttaaattttaaattaaataaaatgagataaaaatgatttccagcttctagttatagtggactagttatctaaagacctgctgaaaataatttaaaatgctagataaaatgttaaaaataaatttattaggccaggcatggtggcttacgcctgtaatcccagcactttgggaggctgaggaaggtggatcacttgaagtcaggagtttgagaccagcctggccaatgtggtgaaaccctgtctctactaaaaatacaaaaataagccagatatggtggtgggtgcctgtaatcccacctactcgggaggctgaggcaagagaatcgcttgaatccaggaggcgcaggttgcagtgagccgagattgccccactgcactccaacctgggggacagagcaatactacatctcaaaataaataaataaataaataaataaataaataaatgtgttacagcctctaagcactgacaggattgtaaagcaccaccaggcgaaaccttacaagagcctggtgggagaagcagagcctgagctgcagtttctgacagatcttttgggggtcccgaagtggaggtggaaatgaagttgggggatctgataggagactgccgtgtaatgaatggggacctcagagggtgaggatgaatggaaaggatacgcacaaagaggggacagcagagaagcagggcagggagagggaggagacaaactaaatcccacccatgggccagctccccgggagtcctgtcacccacatacctagcaccatggcagtccaggcaacccctgtgcgatggatccagtttaaagtgacaccaaacagataacatacccaagtgcctggtagaagccaactttctctggaaagacactttaaccctaaaccatggagattccccacagatggtttcttaggggcaggggcatcacagagacagccagactcccaggtagacaacacagtgcctggaaccagaggctgcagcagacggtggggtcaggtcagacctacatgcttcagatattggactccgacaccggtctttaaacagctgccctaacttgtttaaagataaaagttagaaaactggacactatttaaagtgacatggcatatgtttaaaagaacaaactagaaattctagaattgaacatttaaaactaaaaaactcaatggctatgttaggcaacaaagtattagtaaactagaagaaataatggaagaaagtatcaagaatgtagagctgagagacaaaaagggagaatataaaaggtcaggaggaaggaggatggggtcagaaggtgtaatgcacgtttaacactgagtcacaggaagaaaagtcggggcagcaccatgtttgaagtgacggtggctggtaaatcatatcaaacagtcaagaaacccagtgaatcccaagcaagattaaaaaaaaaaaaccaaaacactatagacataataaaactgcagaaaaccaaacacaaagaggaaaatcttaaaagcagctacagaaaaaggtagacgtgaactttcaaggagtgacagtttgacagctttcttcccaaaagctacagcaggcgccagaaagagtggaatgatatctcgaggtggtgtctacaagagagcttaactctcaatctaattgagttttgtaaaatagaaggcagaacagagacatttccaaacacagagagttgatgggtagcaaatcctcccaacaggaatcataggaactacacttgaaacaggaagaatgtgatttctgatggaaggtttgaaatgtgtaagaaataatatgaagactaacatctcttttttcttttgttttcacttttggtgtcaaagctaagaatttgttgccaaatccaaggttattaagatttacacctacattttctttttatgtttaagttattttctatttaggtttttggtaaattttgagttaatttttgtatatggtttgaggtaggggtccaaatccattcttctacatgtggacactcagttgttctagcacaatttgttaaatgtctcctctttccccatttaatggcattcttgttgaaaatcaattggccatagatatgtgggtttatttctagactccaaattctattctctcaatctatacatctatgcttatgccaggaacacatcactttgattactgtagctttgtagtaagttttcaaagtgggaactgtgagtctttgagctttgttttcttttcctcattgtggttttgatttgcgttcccttgaggagtaatgatgtcaagttgtagttgttattgatgaagaataacatggacttgctctatcacagagattagcaaactttggcctgcaagctaaatttcatgtagcttatttttgtacgcccacccatgaaataagattgttctttacatttttcaaggcttgagaaaaaagaatatacagtaaagacagctacatgtctttagacccacaaagcctgaaatatttaccatttggctgtttactggaaaagtttgctagccctttctctaattatcagatattaagatttatctttttaagaacttcaatacagtggaggtgttggtgcagaattagataagtagagtagtcaaaccacataaagaacaatgaaattgtaccctacacacacacacacacacacacacacacacacacacacacacagacacttactttgaaatggattagagaccaaatttgaaaggcaaaaccatgtatttaacgtgtgcgtgtgtgtgtgtgtgtatgtatatacacatatatatgagagaatcttcatgatcttgatgtaggagagaatttcttaaagaactaaaagtacaaatccaagaggaaaagattaataatttgactcccataaaattaagaactgctgtatattttcaaagatagcaccagctgtgacagtgaagtcatttgctatctgtaacctacaaaggtgtgagtatccagaaataggcaattcagtatgagttacggctttcaataggcacttctgagaagaggagatgatattatgatatactcacagatttgcaaaaattaaaacgtgacaatgccaagaattggcaaggatgtgggatgacaggaactctcatacactgcagtgctggtgggaacacaagttggtttctctagtttggaaaacagatgggtatgatttactaaagttaagatatgtgtttccagtggctcagtaatcccaatcctaggtatgaaaagccatgtatgtaaatgttcatagcattatatataattgaaaaaatccaaatgttcctcaacagtaaaatgggtgagtaaattgtttttttttaatttctgaatgctgcaggaaaaatgagcagaggacagctctcagcaatatgatcaatctcacaaacattatgatgttggcccaaagataccagacacaaaagagtacatatagtgtgtttacattcatacataagcacatatatagtgtgattacattgagaattcaaccacattgttgaagagtgcatacacaggagataaaactactggaaaggataccagcatcaagacagtggttgcttctagaagacagagcgagtgttttgataagggtgcttctgaggtgctggttgcagtccatttgttgacctttgtgattgctattttatcggttagtgcatgtatcttttatgcatttttcctatattgttataatttacaataataattttaaaaaggaaaatcagatcaatatgcaaagattatttgcaaggatgtttattgtattgcttataaaaacaaaaaggaaacaacctaattattcactggtaggggttggttgactaaactggaatactgaccatgtgatagaatattgtccagcggttagaaaagctgagagagaactctctatgttgacatggaaagaagtccctgacgcatcaagtgaaaaagtgaggtaagtagcaaaatatatatcctgtttctgtttagaagggaaaacaggcatatatatatatatatatatatatatatatatatatatatatgtacacagaaatgtgtaaaaaactagtacgtggtgtaagtacatccactgagctacctcagttgttctatttttcttatttttatatatgtttatgaaaacattcactttctaaattatttttatttttaactgtggccaaaacatgtattattcgccaagcctgctggctcactcctgtaatcccaccactttgggaggctgaggtgggcagatcacatgaggccaggagtttgagactagcctggccaacacagcagaaccccatctctactaaaaatacaaaaattatccaggcgtggtggtacatgtctgtaatccagccactcaggaggctgcagcatgagaatcacttgaaccccggaggctgaagttgtagtgagccaagatcacaccactgcactccaacctgggtgacagagcaagactctgtcttaaaaaagttaaaaagtttttaaaaatgaagtgtttttataatcagaaaaggccatgagaacaattttagagtgaattataaaaattactgtgacaggaattttttttttttgagagtctcactctgtctcccaggctggagtgtagtagcgtgatcatagctcactgtagcctcgaactcccaggttcaagcaattctcccacttcagtctctcgagtaactagaactaccggtgtgcaccaccacacccaacttatttatttatttatgagacagggtctggctctgtcacccaagctggattatagtggcgcaatcttgtttcactgcaacctctgcctcctgggctcaagcattcctcacgtcagcctcctgagtagctgggggactacaggcatgccaccacatcaggctttttaattttttgtagagaaacagccatgttgcccaggctggggtcaaactcctgggctcaagtgattcacccgccttggcctcccagaatgctagtattacaggcaggagccaccacgcccagcctcagctaatttaattttattttttgtagagatagtctcactgtgaagcagtcttcttgcctcggcctcccataaagtttatgtattattcctgaaagaaggcttacagttgaaataattctggttaaatataacgtacccttaatctgaaagtttcaaagggtggtagtatcaaccccattccccatccacttttaccagatttcaacaaatttaatcagcttccacaagaactgagtaaagcccagggaatgagaagagccctggactctcaccattttcgctacatattattgaagcttcagtccttagctatcaaggaaggcggtattaataccctccttttagactgactctgagagatgtgaaaacatctagcaccatgcttagcaagtagtatttgtttacctacctggctctctgattttgaatttcttttgtgctcagcagtgggctatgagctataggaggaacgattttcttccattcatctccctgagagccaggggtctgaactcctgaagtaggggcctgtattacccaacttgtggagagatgatcacaatttagcctccagctctatgtaagtagggagctgttggtgtgagtgtcatggaagaaatcagactttaacttgggtggttttgaatgaaagatgaaattctcaaaagagataggagggaggtggcacagatgggctgatgcaatccataagtggtgatcggagactcagaagccagcctgctcttgtgaaaaagcaaggcctgccctattctggctgttcttaggagaggttttgtgagaattttgcgtttaagccaaatgaaatgcttgatttattaagttgttatgacttttttcttttctctttttgaaaaaattgtggcgaaatatgcttttttttaagtctcttctcactaaaccttctagcagaccagtattaacaactggacacatgtatcccagcgagtctttggaaaagactatgccgctaaggcggcatagtgtagctcgtgtttgagcatttcctcggagacattcctgtgatgtgagtgcagttgtgatttgctgtttggtaaataggagattgaaaggccctcctcttctgaagttggaagacatctttgctgggatcaccagggacacctcacaagttttagttgatctttttaaaatttccttgcttatgagttcaaggtttagaaacaaatctgagtttatttatgagcctttcacatctgagtgggcagattccccaggagtagtattttcatcatgttttctgtcttagctggagctgccataacagttccacacactgtgtggcttgaaaacagacatatatttttcacagttcagaggctgtgaacccaagatcaaggtgctggccggtggggttcctggtgagggctctcttcctgacttgcagacagccaccttcctgctgcttcctcacatggtggagagagagagaagctctgatgtctctccgtcttcttataagggcactaatcaggtcatgctcccacctatgacctcttctaaccctaatcacctcccaaagaccccacctccagataccatcccactgggaattagggataggaatttggggaggcacagccattccattcataacagtgttgtgatattgtgaagtatacatttggtcttcctttccatttccaaacatatagcttcgccctttcaggcatctggtataattgaactaagagacaatatcatctcttgttttgaagctgctttcgaggtattaatataccattggatttctatcatatggcccatttattcattccgttaccctctgctactagtcctccttttcttcatttatacccaagcgtccacgtttgaaaggagcattaggttcagtcactgtgctggtctggattgcaggcagcaataacctagccagtgtctcccctcagtccactcccattcagatagggtagggctacacaggtgcaggactagggggctgtatttaccaccaggaagtacagctgcagtcaccgtgaaccccagttctcccagatggggtaaaggcacaacccacccccatcaggtccttggaattccagtgtaaggtttattcttattttattattgagacagagtctctgtcacccaggctgaagcacagctgcacagtcacagctcactgcaggcttgaactttcaggttcaagtgatcctcccacctcagcctcccaaagtccctggattacaggcatgagccacctctcctggccccgacgtaaggtttaaaaacagtacagtttcttgcttaggaaccagctctgcttccagcactggggttgcaagacctggtcctaggatcactgcaccaagtgggagcagggtggccaagctgaggtgatgcaaggaaggaagaaaaatgtgtaatccttatgccagcctgctcctctctcggcaagaattgtgtggtcacaccagcctccttcccagcccctctttccctgatccacaaaacaggaacatcgaatggggacgtcctttagccgttgaatgtgggccagcccttcatgctttcatcgcccctgtcttagccagggttttaactccccgttccgctgctctgtcagactcactccgaggaggatgcgtctctgcccgttgttggacaccgtgggatgtacagtgtgtcccctggtctgaggaaatgacggtcggtgtccagatccgagcagtgtcttctgttctgttctttctatagcactctgagcactggcctcttccaccaggcaagcaaagcccagtccagagtcagtgttcactctggttaagacccatttgttggctgggcgcggtggctcacacctgtaatcccagcactttgggaggctgagatgggaagatcacttgagcctaggagttagagaccagcctgagcaaggattgctgaagcccaggaggttgaggctgcaatgagcggtctaacctggatgacagggtgaaacccagtctcataaaaaaaaatcaaaagacccattgttagcccccagggctatacttgccagctgtgtccagggccttcccaccaggggagctgccccatagccaccggcagtttctgtctctccagctggcaggcagaatggctgcatcaagcctagctgtacggaccttttccacagtacgggtctgggccctgtgcccctgggtaacctgtccaggtagtgtgagggatgaagggaggggaggactctgccagctctgtgggaggctccttaggtgattctgagcctggcctgtattgagagccactgatgagcctctgaggtctcttccacttgtgacgtgattcggagcctggccctctgctttaattcataggcagagtttgatggcagatatcttctcctaagaaagcccgtcacgttagaacaggctgttgggtaggacacaggcgtttagtatccaagtttcgcagatgcccatagaccaggcagctctgttttgcttctgcgtttatgaaaagagctggcagagtgcttcggctccaggccttttcgagacactgggcatgacgttcctcctgagctgctgtggctgagatagaagggatcagcaatggaggctttatttgcagatgattttcctcctctcggtttgtcgttcccactcttcgtcttccagaacctttttagaccccatgacttcaatcctcatcacccaggacattcaggctggctctgtctccttcccatcaacttaatatgaccgtatctaaccctaaatgaggctgcaaaattaaaagcagcatactagcaccagagaaaggatatcttaagcctattcaaatcaaacctcaacaccctggaagctggcgcagcggctgcctacagaaaggagagctagggagctgagacactggtttctctagcgtcctcctcccctgttacgaatttggtactctgtgcatgtattgtctatccaaaaacttgaaagatgttagtcatcctcagtagaggggaagtaactcatcacatagtgaaaagtccaaattgtttaactctttaagccacgtctggtgccaccaaattgggaagggatgtcggtaaattaaattgtgcaattcatactcttttgagaatattattaatattgactctcatatcttgactgcctgctgtgccaaccactgtgcatgagtcaacccaaccccaggtaagaaggtggctcagtaacacagatagctgcgtaaatatgtgacagtgtttaaaaggggggaaaaacaagtaccctgggctttgtacttatgtttattcttagacgtgcctgattttatttacctttgaaagaagttatataaaaaggaagacaaacctgtaagtgcaaaaggaatgaagattcagtgacacgtgttgactgtaggttctcaaaccttgtactttttttgacccttatatcattaaagcattcgacacattagcaacctggaccccccctttgcctcggcaagcccatctcctgctcccctcctctctgtcactgctgcaggcgcactggccttcctgctgctccctgcacactcagggcctcccagcgccatcagggcccttgtgcttgctgttccttctgcctggaatgcacttcctcctttatctcatcaaggttttgactcagatgttatcttcatgaaatcttacctgacaatcttgattaaagtcaaaaccgcacccaccactacctattacctttccctatttcatttaaaaaatgtttttattggagaattacatatatatacacacatatatatgcatgcatgtgtgtatatatgcatatacatgtatagaaataaaagtgcatctatattaactcagttttcacaaactgagcagattgtgtgacctgccgccagctcaggaaacaatgacctgtgccccagaacccctttcatcttcacaccaccttctgctctccagaagtaaccagttctgaccgtgaacaccagctgttctgtagaatgggtatttctgcgttgctgcttcatctgtggcctcacacggtatttactcctgtgttactggctccttctcgtcgccatttcgttttgtgcggttcttccaattctgcggcacgttcttccttgttgctgcatggtaattccattttgtgaatgtcccgcaatttagttccctgccctcctggtgatgggcgtccgggtagacgccagctcagcgtcattacaaaaatgttactgtaggtattcaagaacctgtcttttggtgaagagatgtaggcatttccctcagggctgtccaggggtggacttgctggggcatccaggtgtgcctgggttcagtgttcatggatttttcacagtgtttgtatttgtgctctaccagcagaggccaagttcccattactccacctcatcaccagtgcttgtcctctttttcaaatagccattctggtggccgtgtagaggtatctcattctggttttgtttgtttgtttatttttgagactgagtctcactctgtcgccctggctggagtgcagtggtgtgattttggctcactgcagcctctgcctcccgggttcaagcaattctcctgcctcagcctcccgagtagctgggattacagatgcccaccaccacgcctggctaatttttgtattttagtagagaaggggttttgccatgttggccaggctggtctcaaactcccaacctcaggtgatcacccatgtcggcctcccaaagtgctgggattacaggcgtgagccaccgcccccagccttgtttatttgttttaattgaagtataatttctgtgtgcaaaatgcacaaatcttaggtgtatacaacacaatgagatttacgtatgtatctactcacacagccaccacccacgtgaaagaacatttcagcatccaagaaagtccctcccgctgcttccccattgataccactcctcctggtgaccacgctagtttcacttccatcactgtagattagtgttttgcctgtttttgaagtttgtttaaatggaatcgtttagctggcttctttgcttaatgactgagagattcatctgtgttgctacgtggattggtattttcttcttttttctatatagccttccattaaatgaatacaccataatttatttcttctcctgttcacagacatggtgtttgtttctcgtttttggctactgtgagtaaagctgctttgaacattcttggacaggtctcttaatggatatatgcactgatttctcttggaaatatacctaggagtgggattgctgggtttgccaactatttctccaaactggccgtactggtttatagtctctccagcagtgtgggacagttagtccacgttctaaccaacacttggcattgtcctcttgattttaagcctcctggtgggtatcaattgatgttttactttgcatttctaagtaagaactttcctgactaaataagtttggcacctttttctttttttttttttgagatggagtctcactctgttgcccaggctggagtgcagtggtgcgatcttggctcactgcaagctccgcctcctgggttcacgccattctcctgcctcagcctcccaagtagctgggactacaggtgcccaccaccacgcccggctaattttttgcatttttagtagagacgggtttcaccattttagccaggatggtctcgagctcctgacctcgtgatccgcctgcctctgcctccccaagtgctgggattacaggcgtgagccactgcacccagcatgtttggcaccttttgtacatctgttggccagtgggatatcctcttctataacaggtttgtgcaaatcttttgccctgttgggttgttggtcattttcttgggaattctcgatatgagtcctttgtcagattatccggaatatgtaaagaactctcaaaactcaagaaaacaatttttttaaaaggacaaaagatttgaacaaagaagagattcctgaagcaaataacacatgaaaagatgctcagtcgacgtcatcagtcatgacacacatgcagttgaacaccgtggtgagacaccacatgctctcctaggaggctgccctttggaaggcgaccacccaaggcacagtgagggcgggggtgggaactcgggctctcacacacccctggtagaaatgtgaaatggtactcctgctttggaaaagcggggcactttcttaaaagttaaacatacaattatcacatgagctagcccttccacatgtagatatttaccaaagagaagtgaaaatatttgtccacacaaagacttgcacacacatgtttatggcagctgaacattgggaacgtggccatcaacaagcagatggatgaacagactggggtgcacccttctgtggggatactgctcagccaggaaagggagcacctggtaacctgcagcatatgggcgaatctggaaagaattgtgccaagtgcaggaggccacacaaagaagggagtgtcctctaagatctgacttacatgagaatctagaatatgcagaccaacatggagggatagatgccgaccacgggttgcctgggcaggaagggagtgcaggggaggggaagggctgataaggccacagtgggagttgtttgggtgtttgctcatgatcttggctgttatgatggtcccacagctgtatgcatatgtcagaagtcatcagactgggcaagttcactatgtgcggtttcgtttttttggttttttggttttttttgagtggcagggagtcttgctctgtcgcccaggctgaagtacagtggcgacatgtcagctcacggcaacctccacctcccaggttcaagcgattctcctgccccggcctcccgagtagctgggattataggtgcctgccacctcacctggctaatttttgtatttttagtagagacgaggtttcgccatgttggtcaggctggtcttgaactcctaacttcaagtgatccacccacctcagcctcccaaagtgctgggattacaggtgtgagccacggcgcctggccttttctttgattttaataatttggtttactaagtctgttccctgtccatttgctctgcaaggagtcatcagagcctggcgcttgcagtacccccaggtccacgtttagatgatcttaaaacattgccataatcttgcacgatggccttgcacttaggcagtgccagtattcctatggtatacagtgaaggggcattcggtttcagtaactctgatttgtaatcgtcctacgtggaaacacaaagcaacaagcacaggatcccattagctctgctgcccagtgaagcatccatgttgctttgtttttgtttgttctttttctttctttctttctgtgtgttgttttgttttgttttgttttgttgttgttattgttgttgagatggagtctcactatgtggcccaggctggagctcagtggcttttcacaggcacgcttatcgtagctcactgcatcctcaaactcctgggctcaagagatttcccccacttcagcctcctgggtagctgagactacaggtgtgcaccaccacgcctagctaactctaacttaatctaatgccaactccaatggacaagcattgccctgtcacaagcctagctgaactatgtcagaattgaactctttgagcttgatatggttctagaggctattgagcctcaatttgagcctaaatttaaaattgtgtgatcatttaatttaatttccaaatgggacatgtttataaataaaacaagaccctattaaacaattttgccaagatgattgactcaaattgggactctccagggcaagtggggcatatggttatcctgtttatagtatattatggcagtgaacctcagtaaagtcatacattgtaggtttgtttatttgttgctatctatgcagttgaataatgttgaggatatattttattttcctcacagtaccaggccagtctatagcttgaattgaatcttagctctgcatgtcactatgatctattttattgtaacttcctattataaacctttaattttataaaagcaattttgaaaaagtacttgcccccccatgatttaaaaaaacaaaaacacttagacttaaaatgtaatgacatatcacttttcacccatcaaattcagaaaaaaattcaattgataatatccagtgtgttaagggtataaagaagtgggtatcttaaacccttgttcattaggatataaattggtacaacctttttgggagagaatttggccagagctgtgttttttttgtttgtttgtttttgttttttctgagacagagtctcactctctcacccaggctggagtgcggtggtgcgatctcggctcactgcaagctccacctcccgggttcgtgccattgtcctgcctcagcctcctgagtagctgggactataggcgcctgccaccacgcccggctaattttttgtattttttttaatagagacggggtttcaccgtgttggccaggatggtctcaatctcctgacctcgtgatccgccgacctcggcctcccaaagtgctgggattacagacatgagccaccgtgcccagccggccagagctgttttaaaaaattaatatggatactctttgacctagctgttctatttacagatacctagcttacagacataattatacatgtcccagaagtggtgtgcatgaggatggtttctgcaatgttgatggtagtagcagaaattaaaactacgtaaatacctgccagtgatgctgtttaagtagaataccagatggctattagaaggaatgaaggtccacacagaaacagctctaaggtggctgggcatggtggctcacgcctgtaatcccagcactttgggaggccaagacggttggatcacttgaggttaggagttcgagaccagcctggctaccatggtgaaaccttgtctctactaaaaatacaaaaattagctgggtgtggtggtgcacacctgtaatcccagctactcaggaggctgaggcaggagaactgcttgaacccaggaggtggagggagccgagatcagcccggacaacagagcgagactccatctcaaagaaaaggaaatatatctaaggcatggtaagggtaaaaaccaacttggaaaacaatcaatgtgtagtagtttatcccatttatataaaccaaacaaatcattaaagtgtagatttctccacatacaatatacacatattaaatacagaaacaaaggtagaaaagtgtatgccaagttgataacagtgattaatagttgtgggaatgagtgggaatgaactctcctttatccataggtttactgtttttttgttttttttttttgtttttttttttttaccttgagagcatattcacctgttacctaattttataactgaattaattttctaaatgtacgtaactgcattataaccattttgaaagaaaacttattagcattaggttttactctaacctttgttttcctgagtgttacatccatgattttaagggcatgtctcaggactctaggatgtgatttcatttcacgcagtcctcgaatgcagttagtgtttttctgagttctctgaagcagagaaatactaggaaaaacgtagcttgctaagccaggacctcaaaaaggaaggctactgatcttcactggatgaagtgacatgactttgaagctgagagatccaggtttgaattagcaattccttagtcactacatttgctgtatttaaacttggaaaacagaaaccatttccgatcacttatttggcagcaaaacctaatctaactcaatttggacttgtttagtagcaaagcctggcctcacatacccgtggccatttatagtctccattaggtctgtaagcggtagctcatgcctgtaatcccaacactttgggaggccaaggcaggtggataacctgaggtcaggagttcgagaccagcctgaccaatatggtgaaaccctgtctctactaaaaataaaaaaattagccaggcatggtggcatgtgcccgtagtcccagctacacaagaggctgagacaggagaattgcttgaacccaggaggcggaggttgcagtgagccgagattgtaccactgcactccagcccgggtgacagagtgactccgtctcaaaaactaaaataaaataaaatatagtctccattagtacaactgttcacacacacaaatctatgttattgtagaaatattctcagattttatttacgatgaggatttggtaatgcatagcatatgtaccatgttatctttccaaaatctgaaagtttctgaattccaaaatatatctggtgctaagggtttaaaggttaggagttacaatacaaatgaagaagtaaaaaacttgaaacgcgccagccaagagttgatttttaaataagaagacagggaaacagttgttcttgtgtgtgagagagggtactataaagggtattcatgtcacagttgttgatggcagcaaaacactggaaatgcccccaggtggctatcgaaagggtcacataagtgattgtacatttattcagtggaatgcagcatagctatttttttttaagtaccacaactcttatactgtatacaaaaaataactcaaaatggcttaaagacttaaacataatcacgaaaactaaaactcctagaagaaaacatagagggaaagcttcaagatactggatttagcagtgatttcttgggtatgataccaaaagcctaggcaacaaaagaaaacatagaccaatgggagcacatcaaatgtaaacatttttgtgggtacagggacacaatcaacagagtgagaaggcagcctataaaacgggaaaaatatttgcaaatcatatatgtgaaaagagttaacattcagaatgtatgaagactcctacaactcaacaagaagcaaagttaaataacccaattaaaaaatgggcaaagggcttgaatggacagttctccagtgaggataagcaagtggccatctagcctatgcaaagtatctcagtatccctgatggtcagagaaatgcaaatcaaaatcacaatgagatactaccacacatccattagaatggctactatcagaagaaaaacaaaataacaagtgttggtgaggaatggagaaactggaacccttgtgcactgttggtgggaatgtaaaatggcacagccatatagtaggaagagacccagatgcaatccagtagtgcctcctcggggtatttatccagaagaatggaaagcagggtctcagagatatttgcacacccatgtttatagcaactttattcacaatgcctaagaggtggaagctggccaggtgcggtggctcacacctgtaatcccagcactttgggagaccgaggtgggtggattgcttgaggtcaggagttcaggaccagcctggccaacatggtgaaaccctgtctctatttaaaatacaaaaattagctgggcatggtggtgggtgcctgtaatcctagctactcaggaggctgaggcaggaaaatcgcttgaacctgggaagcggaggttgcagtgagccaagatggcaccactgcactccagcctggcgacagagcaagactccgtctcaaaaaaaaaaaaaaaaggcggaagcaacccaaatgttcatcaatggatgaacaggtaaacagcatgtagtacatacacacaatggaattttagccagccttaaaaaggaaagactgcagctaacatactagctacaacagagatgaaccttgaggatattatgctaagtgaaataagccagtcgcagaagtatgattctgcttatgtgataacctgaagtagtcaaatgcatagaaacaaaaagtagaatgctggttaccaggggctgggcagatggggggaaatgggagttgtttaattagtgcaaagtttcacatttgcaagatgaaaaagttttggagatcggtttcacaacaacgttaatatgcttaacaccactgaactgtgcattttaaaatgattaagatggtaaattttatgtcaatatgttttttactacaatttttaaaaaagtggatgtggagccgggcgcagtggctcgcgcctgtaatcccagcactttggaaacttggggggaggggaggggggccctggatcacgaggtcaggagttcgagaccagcctggccaacatggtgaaatccccatctctactaaaaaacaaaaattagctgggtgtattggcacacgcctatagtcccagctactcaggaggctaagacaggagaatcgcttgaacccaggaggcggaggttgtggtgagccaagatcatgccatcgcactccagcctgggtgacagagtgagactctgtctcaaaagcaaaaaataaaaagaagaaaaaaaaaaacaaacacaggatacagaactccctacctcgtcttgctggttttctttacctttaattgaatgttggagtcacaggattaggaagtgaagctctcaagttcacaaagcacctgctcttccctgcgcgctcattcatttaacaaagtcttcctgttgtaggctgggcgcggtggctcaggcctgtaatcccagcattttaggaggccgaggcgggcggatcacgaggtcaggagatcaagaccatcctggctaacaccatctctactaaatgaaaccccatctctactaaaaatacaaaaaaattaggcgggcgcagtggcgggtgcctgtggtcccagctactcgggaggctgaggcaggagaatggcgtgaacccgggaggcggagcttgcagtgagccgagattgcgccaccacactccagcctgggcgacagagcgagactccgtctcaaaaaaaaaaaaaaagtcagcctgtgattctttttttcccttagattttaatccaagtgattatgaatgtcaaggattaaaatttgggggggttatttgggattccctggattcagatttctgagattatgcttcctttcctttaaggaaaggttttcattttcattataatacaaaaagcaaactgcttattacttttccaccgtacaaaatgcagttgacctacctcaacgctttgtgcattcacctgaacagaagcattttggataactaacgcgtgcttaagcctctgaggacctcattcactaagaggacgaggcggcgcaagtccagctgtggtcagtctcagtgttcccttcagggtccgccggctcacgctgggagaatgagagggacttcagatgctgcttcagttcccagctgtggctgaagctactgggttcacccagctcacctacagtttacagagaaataaagcaaaactcagatgcattcagacagaaccccacctcgagggcagcctcagctctgatgagaccagctgacaggccctggctccctaagccatggcagaggagatcattcattcacatgtcagagacaaagcccaggagtctggattgtgaagtaaacgctgagcccgaccacaaccactgtgaatactgggcaactggggcgtctcagaggattcaggtaattgaacaaatagacttcatacggaatctcaactctcctctggtcagcaatatcagatgtacttctgtgtgaataataaaccagactgcctggatgcgggagcacacgcctggaatcctggcactttgggaggctgagatgggaggatcactccagcctaggagtttgagacctgcctgggcaacatagtgagatcccatctttattaaaaaaaaaaaaaagaaagaaattagctggggataggtggcacgtgcccgtggtcccagctactcaggaggctgaggcaggaggatcacttgagcccacttcagtttgaggctgcagtgagccatgattgcaccacggccccctaacctgggcaacagagtgagaccctgtctcaaaaccaaaatgataaaaaatactcaaccaatcagaggacaccagcacagcagccttaggaagacttctagaaagtataggcaagcctcactttaggtgcgtaccctgttctcatgcccctgtagtgttgctataggaaagaagggtgcataattggattcactttaaccaagactctaaagcaacagctcagctgagctccttctctctccgtctccctcgctctctgccagccatggaggccactgagtggggatctcagtgcagaggtcccggcctcgcctgcccagggagctttcttgttccaggcgacaggaaaagcagagcctgtgggggaggcattttgtgcagggaaggcacatttagaagaagctttggtttcctggacaagcccaggctttctcattcttaccagggatcttccttagatgcttgtccttgggaagtgtaaatgtgttcactgcagctctttctgcatattttagaccttaaaataattgttttttgtttcgagctagccttagattacaggaccattgagaattgagacactgcttgggacatggactggagcttcatcctcagccatagagcagcactgctgccggggttgagggagctcggggagcttttccagacaaaacctttgctccaggcgtttggcagggccataggaagagctcctctgtgggctccctgagctggaactcggccttctccgcccgatgaagcaaacaaactgtgccgagggcgcaccggcatttgtgccgtcagcaagctgggctgtgtctcagcctcacagcactcctcccacgggcctgggaaggcaaatgtgttttctgaactgtgttgagaccgtgtgtgtgtgtgtgtgtgtgtgtgtgttggggtgtcttgtgaagtcctgctaacctcttgtcagcagaatattcgagaaatgcttctgagaagagagaggaagatgacttcagaggctgcttgtggtctctcactcaaggctggtagggagccccggtctgcgtcctggaggaacggcacgctgagtcctgggccagtggccggcggggctgttggcgaccacagtagcacacaagggctctttctgaggagcaggagaccctggcacgggccccacgggagtgtctggggcgtccccgcctgtggcctcttctccccgccgcagcaccagtggctccacgagcagggctcggagctggccctctcctgcttcggagccgcgctgactgggtgtgtggcggatgggaggccgccctgagtgctcctcctcccttttgtacagcctgggtggaaaggacgggcctggtgcacttcctgcgggagggaggacatggggcctgcttccctctggcgctcctccacccgggcagcgtggtttctttccaaatgatttatcctctcatcgtcctgccgctctgtgcttcatggcattggggtcttatccggaaggggattgtccttttttgggtttgtaaatgtaattttcaggaaatgtcattggatctaactccagaatagaaggcgtggtggaactgcttttgtagtccacagttaggctactcacacctcaggccccgcacacgggtgggttcagaggctggactttggagttaagtagcgtttttgcccttggccaagttaacgtctaagctttggtttcctcagtgaggaaagtgggaaccgccataccgtgtctggattcggtgggatcgtgtgtgtccagcagcagtcgcgcagcgcctggcgtgagtggtgggtgcacgccggccccgccatgtgcaccttctgtgacgaccctaagtcagggtggtgtttcctagcagtgcagaacacgaagcccttacaacttctcctagaaacgaagcctgggttgacccctccacctcagggtgagagcttttggtattttgagtcagtatttttggcatgtcttgttttcacaggtttctctgccgctttcgcttttttctggaggggctggaggtagggacagtaatgaaggtaaggaatgcggatggagccgcagttctctgcgagtgttctgtgtgagtgctgggaggcctcggtgaggttaggctgtggtgctgggtggactggtgggcggctggacactccacatttttcccttacatttggacattccgtggatacgacagatgggaaaactggaccagctggaagccgaattttacgttgtgacctaaagagctgttaggtactcagcactatccagggtatgaaagcagcattagttggtcatctcttcacgttttaatgaacgtgaagtgccgatgctcttttcattttccagtggcccatcttgtcaactcttcattgttttttaagcaaattcaaggattcggtcaaaggagaaccaatagctgcaaattgtaaatcctgtgaaattgtctttgggttccgtcctgagaggccggttcgggaacgtgccctgtgtaaagtgagaactgtttgtatcctaggaattcggtagatgaggtagtgacaattctggagggcgatgctgtccgttccagctctttttagtcatcctgaattgcatcaggttttaggaaaaagtttctggttttcttctttatttgtactaggcttctgaaatatctcaaattctgccatgaagtcagccgtccttgggagtctgtgtggcacagatgtctggtttcagggaaatcacagctgccatctgcgtgcccaccccgtgcctctaggcatagccagcagacggctctgtgagcatggggtggtggctttgacctcatagaagaggaaactgagacccagagggggactgtgccatccacggccgggaggtagcagagccggggctgctgtgctgggagcttgtttgcgcagtgccgtgcacggtggctcggtgaggcggccgtggttgtctcccatccgcataactctaagaggagccccacagccgagagccagacgtgtaggaaatgctttctatgagatgcgtgctacgttcctgactccgtttacatgtcattgttttgggtctaaaacaacatgctgtcccaaaactacccatgaactgtgaggactgagagcaagcaacttcgtcaagactgtgggaaggacagggggagctggagtggggaaggtgccagccagaaccccccactccccaccaaagaagccacattgctgtgaggatgtgacaacttctgttcctcgtgtcaccagcctcttgcagacaagctaacctctggtgacttggtaaagccacgcagctgggacggtccagcagtagggagctcgacgctgtccctagaggaaagattagaaatggtcgtagctaaacttagctctggataagctgcctgtagaaggaaatggagatggatttggagggtggaggttgggaaggtttaaagggacagtgacaggtctgtcctgcttgagggatgtgtgtggaaagtcttcacaggctctggtgcagtgctcgtcagggacgccctgatgtgacgtggtgccatagtcatcttaggtctttggaatgaagaataggctctgcccagaaggaagtgaagccacggtgttgatttgacaggcagaagggcctgggtggttctcaggtgcttaccacagcgtccgggaaagaccactgacattgattgctttgatctcctgggtgattggcagtgagccagttcagatcctctgacttggtgtccccctggtgtactggtaaggcattctattgagtcgagcctgtgcagaacacagcaggttgtggacctagggaggcagcgctgctgggaggcgagcctgagcagctcgtgctggggtgtgccctcctgcctggactctgcacgcgttgggtgtgtcttcaatctccactccttccccaggcagaggcgggcgatgggaagaaagcacgtccatcacgtggggctctctttgtccacacatccaagctacacattgccaacagaggccttggagctcttgaccttcagttcctcaaccttgacatcctagtgttttcatattttaaaaaatacttttaaaactgagtgttcctgtcatttttatgcatttgtggtcatgtgacaaagccactggtggcttccagcctacacagcctgcttggcaggagcaggtggcagaaagcagggagcggagcttttcaaaggacctcagctggccgtggggctctgagacgggggcggacaatcgcattggacggcatctgcacccgttgcagaaactgcctggagggagcggcccagccctaaggacagtttttttcatggccttcagtctgtgttttttctcttttgctctttttaaaattctgaagtgtatacatctctctcctatcctgtatgactacagaagagggtctgaaaaaataggcacagcgtgaaacagcatgaacaaacacctctgaacctgccactcagatgaaaaacatcaacagtaattcataaaccccatgtgagccactaccgccaccccagcgtcaccactattctggtatttggctaattattcctttccttttacttgtctttttaccacctattcctaaacagtagtaacttaccacttgggcatgttatttaaccactttgtctcagtcttcccatctgtcacatggacagaacagtaataacacaccgtgagtattgtgagaatgaaggtgatatgggggaggcccttagaacagtgcaggcacataggaagtgcaaggtaggtgtgagttcttacagctagcgctttgtttccttttgcctgtgttttaacttcatgtaaataaggacagtataaccattttatgacttatttcttcagcgttatattttgagatccatcatggggtttttatttttattttatttatttatttatttatttatttatttatttatttatttatttattttgagacagtgttttgctctgtggcccagggctgagtgcaatggcgtaatctcggctcattgcaacctccgccccctgggttcaagtgattctcctgcctcagcctccccagtagctgggattacaggcgcccaccaccacgccccgctagtttttgtatttttagtagagacggtgtttcaccatatcaggaggctggtctcgaactcctgacctcaggtgatccacctcggcctcccagagcgctgggattataggcatgagccaccgcgcccagcagagacccatcatgttgatacatgcggtgataaccctctcatatccattcttctgtggtgttctattagatgagtaaactgcacttgattatccactgaaccagaggtgggcactggtggcttccagcctagggctgtgactctgctgttaggggcacgctgctacacaggcaccaacctctctagcacaggggttcctccaattgtgctgtgggggcccccgagaccctttcaggggttccgccaggttccttgaaaggctcccctgattagatcaggcccaccaagatcacctccctttggcttagctgaaagtcgcccaatcacaggagatacgttccatcacactccagcttcctcccacgctgcaggggaagaaattgcacagggcgtgtgtcattgaggctcgtcttagaaccctgacagcacagaacacatgaaactgctgagacagtgtctgccctttacaccctctttcatgtgcaagcctgcattggagcttttcagaggccacacgacgtatgaggatgtcatcacttggatggcgaatgagataagtgtttgcagagccttgttttcttaaagtgctaggattacagtgtgagccactgcacccggccctaaagccttgttttcttaaaagctctgagttttcatttctaatactgtaagcatcgatagttggggagatgttgagtttttgggtttttgtctttgtttaagaataggatagtaaaaatagaggggctttccataaagagcctgaagcaacagctgctgactcatcctgttggttttgagttagggagtgactcatccccaagcaagaggttttccagacatttattaggtctgtagagcttgtgttctgtgttaaccaggcagctacatttgcagggggagggaagaatcattccttattattgctattctgatgtggggacagcgaacaggagtcagagaaccactaagctattaaaggaaaaaatatttaagctgccatttaaaaagtcaggtttgaaaaaacacatgtcttcattgactcagcaagcgttcagtacgtactaagtgcaagaggtccctggggctgagaatgtgcagggaagatgacattttcctttatgcttcatggttattttgccctaagaagtactaaaggttttttgttgctggatgaaaagattaccaccaattagcaacttaaaacggcacagatgtaatgatctcccaatgtgcttgggtcagcagcctgggcatccagagttcgccacgtgctctgctcggaacctcgcaggctggtgcacctggccgcgttcccatctaaggcttgtcatcctttttcaagctcactggtactggcagagttcatttccttgcagtcctctgactgatgtcccattttcttactagctggcagctcctaggggtgccctcacttccttgccacgtggctcctcctcataacacggctgtgtgctttcttctaggtcagcaggagagcacctcttttaaaaggcccacctgacatggcgaaaccctgtctctactaaaactacaaaaaattagccgggcatggtggcgggcgcctgcggtcccagctacttgggaggctgaggcaggagaatggcgtgaacccgggaggcagagcttgcagtgagccaagatcgtgccactacactccagcctgggtgacagagcaagactccgtctcaaaaaaaaaaaaaaaaaaaaaaaaaagcccacctgattagatcgggcctgccaaggtcacctccttttttcccccgccttgggacagagtatcgctctgttgcccagactggagtgccactggcacaatcacggttcactgcagcctcgaactccccagctcaagagaaccttccacttcagcctcctgagtagctggaactacaggcatgtgccaccacacccggctactttttaaatttttaatagagatgaggtctcactgtgttacccagaccaacctcaaatggcctgggctcaagggatcctcccaccttggcatgagccaccatacctggcccaagagcacctcctctttgactaacttaaagtaaccaaatcacaaaagtgatgttccatcatattctcaggtcccttccacactccagggaaagacaggggcgtctgtcatcgaggctcatcttagaattctgacagcacagaaatcttttcctaacccaagatcacacagatcctctcctatgtttttgtttgtttgtttgtttgtttgagacagggtctcactcaggctgtagtgcagtggcacgattgtggctcactgcagcctcgacctcccgggctcaagagatcttcctgcctcagcctcctgagtagctgggactataggcgtgtgccaccacacctgactaatttttaaaaattttttgcagagatgaggtctcactctattgcccaggctggtcttgaactcgtaggattataaatgtgagccaccatacctgacatcctatgtttttttcagtctagttttagtgatccagtttgaattagatttatataggacatagttagaatcaatgtccttttttgattttctgatcctccaaatgagagttttttttaagttatgtgcagatcaccagtttttccagcaccatttgttgaaaacttttcctttcctcatttgagttgccttgtcaattttttataaatcaattggccatatatgtgggggcctgtttctgcactctcatttctattcggttgatccatattacttttcttttgccgatgataaactctgtcactttctagcaagttgaaagttggtattatgaaaacgttgttcttctttataaaatggtttgttattctgtggtgttttgaagagataaattttaaaatgagcttgtcaatttctaccaaaaaaaatgcctgctgggatttgtattgagactggtattcaatctagatcaatttggggagcataaacaacaatgttgaatcttccatttcatgaatatgacataactctccaattatttaggtttcaaattttttgcccaagtgttcttcagttttcagtaaagaaatttttcacatttaaaaaaaatttcctgttttagccaatgcagtaaggcaagaaaaggaaatgcagggtagacatatcagagaaaaagaaatatgactgttcctgttggcagatggcacagaaaatcccaaggaatctaccagaaaagtcatagactaatgagtcagtttagcaaggctacaggatacaagatccatatacaaaatataaattttacttctatagactaacaatgaccaatagacacatggaaacaaatttaagatgcaacaccattaacagtcattttaaaaatgaaatactgtggtgtaaatttaacacaacatctagaggacttgtttgataagaagcacgaaacactcaagaaatgagatctaaacaaatggagggatgtgccgtgttcatggaaaactcagtgctgtcaagatgtctgttctcccctgattgatacacagatttgacacaattcctgtgaaaatcgcagcaagatcttttgtagacatggatgtgattattgtaaaatgtatgcggaaaggcactggaatggccaaaaatgtttgaaaaagaataaagtgggaggggccactctccctgattccaaggcctgttgtctccctgcagtggtcaggcctgtgtggtgctggcgcagggagagacacgaggtcactggacagacccgtggatcgctccccgccagcacgcccgactgattgcagccaagggcagaagcaactcagtgaagaaggagagccttttcaacaaagggtgctggactgtctctgtagggaagaaaaagtgaaccttgacctaaatctcttatacaaaattaattcaaactgagttacagatttcagtgtaaagcgcagaactctaaaacttgagagaagataacagtagaaactccttggggcctagaacttggtgaagaattcttagacatgacgccctagtgatccgttgaaatcaaattttgagaaacggtcatttttgtttcatcaaaatttgaaatgtttgctctgcaaaagtcctccttttgaggcagggtctcactctgttgctcggactggagtgtagtggtgtgatcatagctcactgcagcctcagtctcctgggctcaagcagtcctcttgtcccagcctcccctaatagctgggactacaggaacgcaacactatacctggctaattttttttttttttttaaagtagagatgaggtctcactatgttgcccaggttggtttcgagcccctaagctcaagggatcttcctgccctggcctcccaaagtgctgggattacaggggtgagccaccgtgccctgcccagatcctcttagtaagaggatgaaaagacaagctacagactgggagaaaagtatttgctgactacatatccgacaaaggactcattatctagaaaacagaactctcaaaacaatactcaccagtacgaaaacaatccaaacagaaaataacaaaacatatgaagtgatttcaccaaagaggacatgccgatggcacataagcacgagaagacatccagcctctccagccattgagtcactgccaattaagggagatgcagactcagactgctgtgagctagcactacacacctattaacacagatacaatagaaaatagtgaaaataacaaatgctggtgaggatactgagaagctgggtctcattcatcactggtggggaggtaaaagggtacaaccgttctggaaaagagtttggcagagagtaacgctgaacttaagggtttagatgtagattctctggtcactgagcatatccaagtgaacaaagcacctaagatgcgccgccggacctacagagctcgtggtcggattaacccatacatgagctctccctgccacattgagatgatccttactgaaaaggaacagattgttcctaaaccagaagaggaggttgcccagaagaaaaagatatcccagaagaaactgaagaaacaaaaacttatggcacaggagtaaattcagcattaaaataaatgtaattaaaaggaaaaaaaaattaaacatacacttatacagcccggcagtcacactcctgggcatttaccctagagaaatgaaacttacatccacaccacacctgtacatgaatgttcacagagttttatgtgtaatagctaaaatacagaaacaaccaaaatgtctctagattggtaaatggttaaataaactgcggcacgttcagaccatggaattctcccagcagtaaaaaggggcaagctactgacagatgcaacagtgtgagcagatcccaaggacattatgttgagtgaaaaaagccaacttccaaaggccacatgctgccaggtgcaggggctcacacctgtaatcccagcactttgggaggatggcttgagcccagtagtttaagaccagcctggacaacatagcaagatcccatctctacaaaaaataaaattagccaatcgtggtggcatgcacctatagtcccagctacttgggaggctgaggcaggaggatcatttgagcctgggaggagagtttgcagtgagccatgatcatgccgctgcattccatcctgggcaacacagtaagaccctgtctctttttttaaaaaaaaaaagccgcatgctgtatggtttcactttaagtacactctagaaaaggcaaaactataggaacagaaaacagatcagtgactatacattctagagatggaaatcagattcgtggttaccaagggattagggatggtggaagaaggaggatggctgtgattataaattggtagcacgagggagaccgttgtggtgggacagttgtgtctcttgattgcagtggtggttacacaaatctagacaggtgacaaagtgcatggaaccacacacacattgtactaacgtcagttccctggttctgatattgtactataagaacaacagatgtaaccactggggaaaatgcatggcaggtccacctatacctctctaggcaatctttgcaacttcctatgcatctataattatttcaagatgaaaagttacggcaaaaaaaaattcacgtttcttagtactattaaaaacggaattgcttttacaatgtttagattccattgggttattggcagtatgtaaaacatatacttgatttttgtgtagtaatctcttatcttgtgaatgtgctgaactcacggattgattctgttgctagcttttttatagcttccttaggattttgtgtttgaacagttaggcgatctgcagattgttttatttcttgctttccagtccctgtgtcttttgtttcatttgttcgcttgcttgctgtcttgctttttgctgttagtctttctaacttagcattgaccagaagcagtaaaagtgggcatccttgccttatacccagtgttagggtgaaagtactcagtggtccaccatgacttaggatgttagttgcatggttttcatagatgccctttatcaaactgaggaagtttctttctattagtctggtgagagaggactttttttttaagccctgagcatgtgttgaattttttcacatgctttttttctgcatctattgaaacattcgtatttttttcttccttattttgctaaaatagtggctgtcttctattgacattttttatgtagttaggtttaaattgctaaagttttgttaaagatattgtgtcttttcaaggggagagttggtctgtaatttttcttttttgataatcttgtcggtgtgggtaccaggatgatgctggcctcataaaaggagttggaaattatttcttcctctttgattttctgaaaaagttcacgttcgttagtgttatttcttctttacgtgtttgatagtgaggtcatctaggcctggagttttcctttggggaagttttgttgttgttttagaacaaatccagtcttttaaaggctgttcaaattttctatttcatacagtatccgttttgggaaattaaattttttaaagcaatttgtccatttcgtataagatgtccaatctgttagcataaagttgtttggaacattctcttaatacctgtcaatgtttgacggagctatagtataactttttcattcctgatactggagatttgttttttctttttcttaattcccttaggaggttatcagttctgttgacatttttaaagaaccaacatttggccttgttaattgtttctattgcaaaattcattttccatttcattgttatctcatctttgttattttctttctcctgcttaccttgagtttaaagagctcttcattaagctctttgaggtggtacctttggtcagtgatttttgatcattttttctcttctataagctgttttttttttttttcttttttctttgaaacggtcttgctctgttgcctatactggattgcagtggtgcagtcttggctcactgcagcctcggccttctgggttgaagtgatcctcccacctcagctccccctgctgagtagctgggactacaagcatgtgccaacatactcggctaactttggggttttttttgagaagatggggttttaccatgttgcccaggtcttgaactcctgacctcaaccagtccacctgcctcagcctcctaaagtgctggggttacaagtgtgtgcccccgggcccggccctaatataagcatgtaaagcaacagatttctccccgaaatgctgtagtggcaacgtctcaagataaaagtgttgatattttaacattgtcttgaagttcaaaatactttctgatgtacattgtgaattcttcttgattttggcatgtctgggtaccactcctggagtgtgcatatctctcgcttctgttcccatctgtccacctttccattcgcaccctcatattaatcagttatttcagttcccaagctgataactctaaaactttcgccatatccgaatctggttctgaggcctcactttgtaacttcacactgtgtttcttcacactatgggacatgcctgtccgatagtcccccttgctcttcacactgtgtgtgtgtctgttaacatgcctgtccaatagtcccccgtgtccgtggcttcaccttccatggtttcagttacccgcagtcaaccgtggtccaaaaggggatgaatacagtacagtgagacactttgagagaccacattcacataactttattacagtgtgttgttacaattgttctgttttattgttaaccttactctgcctaacttatcaattaaacttgaccataggtacatgtgtaaagggaaaaacaatatagataaggttgggtattattcaaggcttcaggcatccactgaggtctcagcatgtgtcccctgaggataaggaggggactccagtattttttcttaaaagccaggcataacctatcagttgcaggctctggcatcatcttctgttcctggtaaactgcgattctctgcatttgcctgtctgcctctgcagtttgggggcagcagtgtgtcctgtgatctcagctctctgatgggtctaagcagagctgggacttgcagtttgttctccttgccggtgtcgctgctgtgaggatgggagtgacgacttccaggccctttacatgtcagaccggagagtctgacttctttgacctgtggattattcagaagtgtgtggtatagcatccttgctatgagtttcttcatacttatcatatttggaatttgtggagcttcttgaaatctgtaaatttatgtctttcaccaaatttggaaagttttctgcttctaaaaacattctctgccccactctctttgttctcttctgtgagattccaactacttgtgtattaggcctttaggaattgccccaaagatgcctgcacctcattctttatcttttttctctttttgagattggatcattgggtcatctctattaatctaatttcagtggtcactgattctttcctctctcatccccagtctcttattaagttcatccagtaaattttaaaatttcagatgttgtgtgttttagttctaaaatttccatttgttttccactatgttttttgtgtatctgataagattttctttttttttattttattattattatactttaagttctagggtccatgtgcacaacgtgcaggtttgttacatatgtatacatgtgccatgttggtgtgctgcacccattaactcgtcatttagcattaggtatatctcctaatgctatccctcccccctccccctaccccacaatagtccccggtgtgtgatgttccccttcccgtgtccatgtgttgtcattgttcagttcccacctatgagtgagaacatggggtgtttggttttttgtccttgcaatagtttgctgacaatggtggtttctagtttcatccatgtccctacaaaggacaagaactcatcattttttatggctccatagtattccatggtgtatatgtggcacattttcttaatccagtctatcattgttggacatttgggttggttccaagtctttgctattgtgaatagtgccgcaataaacacacgtgtgcatgtgtctttatagcagcatgatttataatcctttgggtatatacccagtaatgggatggctgggtccaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgaaatggcatctcattgtggttttgatttgcatttctctgatggccagtgatgatgagcattttttcatgtgtcttttggctgcataaatgtctttttttgagaagtgtctgttcatgtcctttgcccactttttgatggggttgtttgtttttttcttgtaaatttgtttgagttcattgtagattctggatattagccctttgtcagatgagtaggttgcaaaaattttctcccattctgtaggttgcctgttcatgctgatggtagtttcttttgctgtgcagaaactctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttgtttctgtcaggtttgtcaaagatcagatagttgtagatatgcagcattatttctgagggctctgttctgttccattggtctatgtgtctgttttggtaccagtaccatgctgttttggttactgtagccttgtagtatagtttgaagtcaggtagcgtgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcatgatatcgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctgttattggtgtataagaatgcttgtaatttttgtacattgattttatatcctgaagttgcttatcagcttaaggagattttgggctgagatgatggggttttctagataatatacaatcatgtcgtctgcaaacagggacaatttgacttcctcttttcctaattgaataccctttatttccttctcctgcctgattgccctgcctaggacttccaacactatattgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttgttgagagtttttagcatgaaggttgttgaattttgtcaaaggccttttctgcatctactgagatagtcatgtggtttttgtctttggttctgtttatatactggattacatttattgatttgcatatgttgaaccagccttgcatcccagggatgaagcccaacttgatcatggtggataagctttttgatgtgctgctgggtttgcttttccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtgccagctcctccttgtacctctggtagaattcggctgttgaatccatctgctcctggactttttttggttggtaagctattgattattgcctcaatttcagagcctgttattggtctattcagagattcaacttcttcctggtttagtcttgggaggatgtatgtgtcgaggaatttatccatttcttctagattttctagtttatttgcgtagaggtgttgatagtattctctgatggtagtttgtatttctgtgggattggtgatgatatcccctttatcattttttattgcatctatttgattcttctctcttttcttctttattagtcttgctagcggtctatcagttttgttgatcttttcaaaaaaccagctcctggattcattaattttttgaagggttttttgtgtctctatttccttcagttctgctctgatcttagttatttcttgccttctgctggcttttgaatgtgtttgttcttgcttttctagttcttttagttgtgatgttagggtgtcaattttagatttttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcatttaggagcaggttgttcagtttccatgtagttgagcggttttgatttcttaatcctgagttctagtttgattgcactgtggtctgagagacagtttgttataatttctgttcttttacatttgctgaggagtgctttacttccaactatcaagtggtcaattttggaataggtgtggtgtggtgctgaaaagaatgtatattctgttgatttggggtggagagttccgtagatgtctattaggtctgcttggtgcagagctgaattcaattcctgggtatccttgttaactttctgtctcgttgatctgtctaatgttgacagtggggtgttaaagtctcccattattattgtgtgggagtctgagtctctttgtaggtcactcaggacttgctttatgaatctgagtgctcctgtattgtttgcatatatatttaggatagttagctcttcttgttgaattgatcgctttaccattatgtaatggccttctttgtctcttttgatctttgttggtttaaagtctgttttatcagagactaggattgcaacccctgcgtttttctgttttccatttgcttggtagatcttcctgcatccctttattttgagcctatgtgtgtctctgcacgtgagatgggtttcctgaatacagcacactgatgggtcttgactctttatccaatttgccagtctgtgtcttttaattggagcatttagcccatttacattcaaagttaatattgttatgtgtgaatttgatcctgtcattatgatgtcagctggctattttgctcgttagttgatgcagttttttcctagccttgatggtctttacaatttggtatgttattgcagtggctggtaccagttgctcctttccatgtttagcacttccttcaggagttcttttagggcaggcctggtggtgacaaaatctctcagcatttgcttgtctgtaaagtattttatttctccttcacttatgaagcttagtttggctggatatgaaattctgggttgaaaattattttctttaagaatgttgaatattggcccccactctcttctggcttgcagagtttctgccaagagatcagctgttagtctgatgggcttccctttgtgggtaacctgacctttctctctggctgcccttaacattttttccttcatttcaactttggtgaatctgacaattatgtgtcttggagttgcctttctcaaggagtatctttgtggtgttctctgtatttcctgattttgaatgttggcctgccttgctagattggggaagttttcctggataatatcctgcagagtgttttccaacttggttccattctccctgtcactttcaggtacaccaatcagatgtagatttggtcttttcacatagtcccatatttcttggaggccttgttcgtttctttttattcttttttctctaagcttctcttctcacttcatttcattcattttgtcttccatcacttataccctttcttccagttcatcgcatcggctcctgaggcttctgcattcctcaggtagttctcatgccttggttttcagctccatcaggtcctttaaggacttctctgcattggttattctagttatccatttgtctaattttttttcaaagtttttaacttctttgccattggttcgaacttcctcctgtagctcagagtagtttgattgtctgaagccttcttttctcaactcgtcaaagtcattgtccatccagctttgttccgttgctggtgaggagctgcgttcctttggaggaggagaggtgctctgatttttagagtttccagtttttctgctctgttttttccccatctttgtggtcttttctacctttggtctttgatgatggtgacgtacagatgggtttttggtgtggatgtccttcctgtttgttagttttccttctaacagacaggaccctcagctgcaggtctgttggagtttgctagaggtccactccagaccctgtttgcttgggtatcagcagcggtggctgcagaacagcggatattggtgacccacaaatgctgctgcctgatcgttcctctggaagttttgtctcagaggagtacccggccgtgtgaggtgtcagtccgcccctactggggggtgcctcccagttaggctactcagggtcagggacccacttgaggaggcagtctgcccgttctcagatctccagctgcgtgctgggagaaccactactctcttcaaagctgtcagacggggacatttaagtctgcagaggttactgctgtctttttgtttgtctgtgccctgcccccagagggggaacctacagaggcaggcaggcctccttgagctgtggtgggctccacccagtttgagcttcccggctgctttgtttacctaatcaagtctcggcaatggtgggtacccctcccccagcctcgctgctgccttgcagtttgatctcagactgctgtgctagcaatgagcaagactccttgggtgtaggaccctccgagccaggtgcgggatgtaatctggtgtgccgttttttaagcctgttgggaaagtgcagtgttagggtgggagtgacccaattttccaggtgctatgtgtcacccctttctttgagtaggaaagggaattccctgaccccttgcgcttcccgagtgaggcagtgcctcgccctgcttcggctcgcgcacagtgcgctgcgcccactgtctggcacaccccagtgagatgaacccggtacctcagttggaaatgcagaaatcacccgtcttctgcattgctcacgctgggagctgtagaccggagctgttcctattcggccatcttggatcctccctgacctctgataagattttgtgtatctttattcaacatgagcatttttaacctaattgagcctaattataatagctgctttaaagtctgtgtcaagccatcccagtatctgggatatttgagttgataacttctgattgtttttgcccctgatgatgaatatcttccatattttgaataatttaattatatcttgggtattatggatgtcgttttaagacttaaatcctgttctgttcatccatctaatgttgatatttttgctttagcagacatttaacttggtgagacccaaactgccaacttggtcatgcctgtgctggtggttgcttagatcacagcagagacccctttcagtttgcccccatatatacggttcaggggccagccaggctcttaggcaaagtttatgcacagaacttgaggtctccctcactgactcttttctttttggagtgttcccaccttaccccttggcagtcctggttgccccagctctgtcctcttgttctcctggccaaaaagatggtaggctttctgtctgaatgttgttgttgccacacaccaccatgcctgtggctcacaggtgatgtgagtgtgcacctggaaaattgagaagaacctacaggtctattattagaatgaatacagagcttagcagggtgactaggcacaagccaatatacagaaatcagttgtatttctattcactagcaacaaaggattataaaatgggaaatgtttaaagatgccatttaagaagcaccataaaagattacatacctgagaataaatctaagggaagatgtgcatcacctgtgtacagaaaatttataagcattaccaagaggaattaaaggcctcattcaaaatcaaaactctgcaggtgtttgcggggacagggagggtagacattgacagctgactttagaactaatatggaaacgcaaagggccggcgagactcagtgctttcttcactttgagcaccaaagtaagcgaggacagagatgaattacagcccctggaaaatgacggcgtctgtgagtccatgtggacagcgatgagataaacaggagcagggctcttgttgacagtggaatgtcactcacagaccagcaagcatggagtggcactgactggaaaatcatctcgaaactgtcatgttaaacactggagacatcgcaaaaaccccaagggccgtgggaggcagccctcttcttcaaaaatctcagtgtaggctgggcgtggtggctcacacctgtaatcccagcactttgggaggctgaggcgggcagatcacttaagttcaagaccagcctggccaaaatggggcaaaaccctgtctgtagtaaaaatacaaaaattagccaggtatggtggtgcacctctgtaatcccagctactcgggtggctgaggcaggagaatctcttgaacctgggaggcggaggctgcagtgagctgagatcgccccactgcactctagcctgggcaacagggtgagactccatctcaaaaaaataaaaaaataaaaaaattcaagtgtttcagattaaatgaaactaaagaggcatgataactacatgtaagtaatatactaaattctgtgctagaggagggaaatggtcttataatgctgtatctgtatatattagataaacctcggtgtctaatacgtggtaattatgagacagtcatcctagatgaatactcttatccttgcggcgttctcctgaagcagcacctgaagttgccgtggttgtagaagcaggtgtcctcattcttaggacataccctctgaagttgttaggggtaaacaacttgctctcaaatgatgacggatttttaaaagtctgtgtattgaaagagagcgagcgaaggataaagcaaatgagagaagatgtgaacaggtgaatctagagaaagactgtatgagctctttgtactattcttgcaacttttcacacatacctctgtcctagccccaaagagacttggaatttgggttctggctactacaaaggctggaattctgctgtgaatttccccaaaaagtagaaagctaacaggcagtccaactgtgacatgcctggtgcctcacttgctgggttttagagattctgtggtggaagcctctggaaactgggtgagctctccccacccccagccctgttatttaggtttttgggttttttttaagagacagtgtctcactctgttgcccaggcctgagtgcagtggcgcaatcatggctcactgcatcctcaacctcctgggctcaagtgatcctcccacctcagcctcccaggtagctgagaccacaggtgtgcgtgccgccacacctagtctaggtgctttttatctagaggcaggggaataccttaaaacatactgtaaaatttctttctagctcatttttctatgatgatccctgtgatacaaatgaagaatctaaatctatagtggttttttgtttgattatttgtttgtttgtttgtttgtttgttttgagacggagtctcgctctgtcgcccaggcaggagtgcagtggcccgatctcagctcactgcaagctctgcctcccgggttcacaccattcttctgccttagcttcctgagtagctgggactacaggcacctgccaccacgcccgactaatttttttgtatttttagtagaggcagggtttcaccatgctagtcaggatggtctagatctctcgacctcgtgatccgtccgcctcggcctcccaaagtgctgggattataggcatgagtcaccgcggcgagccctaaatctgtagttttaagggctgaatctataatttgaactattaaacatcttatgaaactgtttaagaatgagcccaacagatactcataaacccattgcccagtattaacatgttgtttacatttcaccatctttgcctctgacagatgaaaatccacaagttcataattatatttgtcggctcaagctgccataacaaaatactctgactgggtgggttaaacaacagaaattaattttctcacagctctggagattggaaattgaggatctgggtggcagcaccatcaggttctggtgagggagggctgtcttcctcgcttgcagacggccagcttctcactgtgtcctggtgcctcacataggacggagtgagagggagagctctccggtctcttcttatgaaggcactatcgtatcatgaggtccctaccttcagtcacctcccaaagtccccatctccaaataccatcacactgcaggtagggcttccacatgggaattctgggagcatacaaacatgcagtctataatgatgatacaaatagaaccacctagaaaagatcaccaggaaatgccagaaaacccagaaaagatcacactggagtgccatttcacagctagtaggatggccaccgtttttaaaaatcagaaaacagcaagtgttggcaaggatgtggataaattggaaactttgtacatggcccatgggaatgtaaacttgtgcagccgccgtggagaacagcttggtggtcttcagaaaattaagcacagaattaccaaaggactgccgggcacagtgactcacacctgtaatcccagcactttcagaggccaaggcgggcggatcactggaggtcaggagttcgagaccagcctggccaacacggtgaaacccccgtctctactaaaaatacaaaaattagccaggtttggtggcgcacgcctgtaatccagctacttgggaggctgaggcaagagaactgcttgaaccaggaggcagaggttgcggtgagccaagatcgcaccactacactcagcctgagcaacggggcgagactccattttaaaataaaaaaagaactaccataggatgctacagtttcactcctaggtgtatactcaagaaatgaaaacagatattcaagcaaaaacttccacacagctgtttgtagcactgttcacaacggccaaaaactggaaacaaagtgttcatcaactgacaaatggaaaaacaaaccacatatccatacaatggcatgtaatatacatatatatatattggccgtaaaatggaatgttgcactggcctgtgccacagcatgggcgagcctcggaaatgccgcaccaagtaaaagaaccagacacaaagggctgcatgctgtgtgaatgcgctccaatgagagatccagaaccggcaaatccatggagacagaaagcagattcgtgttgtcagggtctgggccagggcagtgggagtggcggctgataggctgtagaagtggtggccgtacaacattttgaaggtagtaaatgccattgaatggttcatgtcaaaatggtgaattttctattatgtagatcttacctaatgaaaacataaaggaagaacccaggcaagggggctggtgctttaggggcccggcgtggcacccctgtgacagcaaccctgcacacgccgaggacacaccctgcggagcctgagcttacagttgtagaggctgctccacggccaaggaccctgtgcagctcttcctggggtctcactgctgtgaccaaggggtggctgtgtgccaggcttggagacgaggtgtccacaggcacagccacgaggctacacacagggcaagggggccaaagcgtggccagagtcaggggccagctcctctgtactttcacattctggcaaaaaacaaaaaaacaaacaaaataaaaaacaggaggaggccagaattctaggttccgcctctaaccttattgtcctattgggttcatttgctttaatttgggttcaattttgaggggttggttttttatttaatttttttttaattatggaagatgttagcatggttccaaagtcagacatactcagagagggctactcctgtctctgtcccatcccccattccctccctccctagaagtcatttttatctgctgctggtgtatccacgtttccttttccaaatataagcaagcagaatatgggttttagtctcccgccatttcttacataaaaggaagatactctgcgttgtttcgtgccttgtgcttttcctttggcagtgggtatcggaaacctccttccagccacggagctcttctccttcgccggtgcgtagcccctgactgcgtggagatcacagtttcctcaagcagcttctcctactagacgtttcctgcagtgacagcttgtgcctgcgtcactttgtatttctgccagtgaatctgttacctaatttttttttttttttagatggagcctcactctgtttttgtatttttagtacagacagggtttcaccatgttggccaggcttgtctcgaactcctgacctcaagtgattgcctcggcctcccaacgtgctgaggttactgtgagccaccacgcctggtcctcttacctaatatttggggatgataaattagcaacaaacaattcataggtacccaaattaaaacttgaaaagcttcctttttctaatgtatatgaatgtggtgttgtatctcttttccagaatactttcacagctgtggtatcatttaatctcacgccagccctgtgagatgtcacaggcgttcactgagcaaagcctgagttcaaaatgaggatttcttttggggaactagatactgtttttaaaagtattttgaaagattctctgttgtttggctagcgtctctattcagtggaaatcaaatgctaactttaatatttatttattaagtaatgaaattgaaaacctgggcctttggcatagtttgctgttacttttcatacacagcagttttaaaatttgtctttgtaatttgtcacgttgaagtgagtgaactagattttggaatcctctagctcaccattaacaagccctgttttcggtcacagtgtgaatgaccccgctttaggattttagagttaacctcactaagtgcagaaactgtaagacagggccgggcgctgtggctcacgcctgtaatcccagcactctgggaggctgaggtgggtggattacctgaggtcaggagttcgagaccagcctggttaacctggtgaaaccccgtctctactaaaaatacaaaagttagccgggtgtggtagtgcacgcctgtagtcccaactactctgtaggctgaggcaggagaattgcttgaacccaggaggcagaggttgcagtgagccaagatcacaccactgcactccagccggggcgacagggcgagactccatctcaaaaaaaaaaaaaaaaacaaaaaaaaaaaaaacaaaacaaaactgtgagatagctcctgaatgggcagatagggtttaaaattaaaaggccctctggccaggagctggaagttggtgtttgttttctttgtaaccactctctggtccttgatctgtccctacttagacgcttacatctgagaccaatccacggttaccttttcctctcactccccagtgggacccacacatgggctgtctttaatgcacaccctgtcagtctgtgacattgacaggcaggaactgaaccaagcatgtgggtagaaaggctccaattaggagcagaggacaagagggaaccagagtcagcccctcatgtactgatctcgagggtctggtcctgtgcagggttgaatgatctgaagctcttttctcgtggtcctaaattagctgaaggaagtgcgtgaggccagcaggggtctgtgaaggggcagcttgctgtgtgcagagacagaggtgacgggcgaggctgctgcagtgcctgcctgacggtgctgacggagttctgagcggcagcaagccgagcgtgtgtctttctcccaccggaggtgtgggtgacaggtgcttccagaaactgctgaaggctgcaggcctctgcagaaaggcggtctcctcatgggcgtgtgtcggcctaggtcctgcccagtgtcacgacatcacatctgcccggctgtgcccaatacaggtgcacaggccccatatcaacctgctgctgctgcttgaaacagacaacccctctttcactgccaccagcccctgctcaggttcaccccttctgttgctcgtgagaggacagacacattcgtgggacagttgaggcaggggacaggcccctgtcaggtgtgtgctcagtggccgctggccccagcctaatgaaattcatttcatttaatccgcaagtccaagtttgtgttaatcttgagtggtgtaggtttttcacaccaaggagagtcccgagagcccactttggatccactcgtgtttctagatcgtgtgaccgcagcagccgttgagaggactctgggctcgtcttggcaggcacagtgcctctttataaacccaccaagcggttaatttcatgtggacatctcagtttctgccacatgcattttctctaaagaaatgactgaattctcttagtgttgaaaatgcatgggattgtaaacctggcccttttaatgagctgctgctgtaagacttgaggagtccgtcgcaaacgatcgtcccgtgggctgcgtgcccaatcagcaggtgcattgtccagtctctgttggtgaaccgcagtgcaccaaacctcagggacagcaagagtgcggatgtgagtgacagcgttctggatcacacagggttgctctgtgtccccttcttccctcccctccagcccccattagagagcttgtggcacagtccctggcaccttacagttcagtggcagctttcccacggaccccctgggctgtttctcgagatgaggccgccctgacatgaaactagatttgactcctctcctccgccactcatgcaagatgaccgagagtcacagataagttttcctgcattccaagtagtgatacaaatgctgtgatgagttaaatgagccatcctcattcagtcatcgtggagaaagcagcagtgagtgtttgctgtgttgtgaagtgcagctgggggactgattgcagactcgaggggtgtttagactcacaccgagggaaacgtccctcctgttttctgcttcccatcgagcttgtcctgattgtgccctctgtggtgcttttccccttgcgtccgtactatctgggcggagcacgtgtgtccagggctttgtgtcctgtggtgataagagcactggctggggcatctgtgccactgtgactctccatgcctgacccagctagaaccctgcaggagaactgcctctgcttccttcgtgcctggtgccaccacctgcctagaaacgggcaagggtggcttgggctgtgagctgctgctactctcagctccctgggggagcccgtggccacaggagagggagggacagtatgctgatgcttcttgggcttgcgtggcacctcccgaggcccaggggagggcaggagagcaggaggaggcaggcgagagaggcgctgaggaaggaacttgtcgtaaatcagggagtgagtgcacccaacggcttctcccagctgcttcctgtcagggtgtggaaggaggcatgatgtgcagaggaccggggggacttggcacagccacgggaaggcggctgccccaccggcctcacgctggcttcccacatcacgggggcttggcgaggaagggagagagcaggcacgagaggtcagtcgtgccgggcccttggggtacgttcaccctggcactcccgatgccttccctactgcagagctgggcctctgcctggggctctagagagccggtggtcacgaggtgcacgtgctcgccccgtcctgccacagaggaggaggatgtgtgctcgctcaacacaggcagtgctgggatggggagacgtgtgtttctgtcccctcaaacaaaacactcactttgaaaacatccagaggccttcgttctaaagtaggaaggtgggctcctccctgaaggagcttcctctctgctttctcccctcagtctgtctgggacagaggaggaagagatagactgagcaggtgctggccgcctttctccatcccttacaacgccacgagcttcagcgccatcacgtagtccattctgatggccttctctccttaaaattctcctgcgtcagctcgccacatgtgtatgaccttgcccctgtacatttccatgagaacacagaaagtgactgctcttcccacaagccctgatgtcagggcagcctggaagccttgaccccgcctgctggtgtctgtctttagagcagggttcaaagtggaatcttatagaaagtggtataattggtttttaatacgctacctttgaagggactcattgcgtgcctgttcatatgcgggctgctctgtggtcggtggttgcgctctcccggctcctcccgtgccccgtgtgtgcctcgcatttggcggctcagcgcttcctgaaacggggtcctgggtgattccgcagggcccttcgcactatggaacacgtctcagattgtatcgatgattggtccaggcaggagaagactggccatcattccaccacaacaatccaaatggaagattcccctgtgtttgctactataaatcaggtcataaaaatgtgggaaggaataatggactctttctagaaactggaagatgttttgccagatgctccttttcgtcaggatgttttgtctttaaggacaatgtcttgggtcccttaggccatcttcgacagaagcaagactgtacccaggagccaaaatctaaaatcctattctagcctgtcctttgctggccgcatggccaggagtgggccagccttcatgtctggaaagagagtcccccatcagaggggcctgcatcgcaccacacaccaaaacccagcagcgaaaattgaaaaacagccagaatttgaaccttggggttggagctaaagaacctgcattaaacattttctttaatggtagtttttttattttagaaaacacacggacactctctgcctttttcctttgctttcccattcacacggaggcgaaatgccactgctcttaccctgttcagttcttgtatttgccacatcaggattcctcagtccagactgagctgtgaatattcttccttcctgacagggggagtcggtgaagtacttcctggacaacttggaccggatcggccagctggtgagtaagcacgcccgcccgaagaagctgggctccagggttagaaaacatgtgtccagagaccaaagcagtccacgttgtgaggactttggctggactgacaggccgagcttgttctgtcacattaccacgaatagtactgtaatggcacgctctcacttggatctgggccccgtctcagtggggaggggaggaaactgcctttgcccagatcaccataaaggagacagacagaggagttcatgagtgaaaggaggacttcctttatctcatggaaaattcaaacatactcaaaagcaaatagtctaatgaaaccccaggcatggcagttatcactgattaccagtcttgtttcagcagccctcccccggcctccgggagcaaatgcagagaatattttagagtgtacctcaaaaagacaagacgaaaaatgacaaccgcagtaccgtatggctcctgaaaaattggcagtaattccgtaatgtcaacctagtcagtttagagattttccctgttgtctcattaatgttttcatgttgattttgctttgttttagcagagtttgaatcaacaacctaataaggtcatgcattgccattggtcaggatcacttaagtgttaatctgtatgtctctcctttttttctttcaacttgtttattggagtaactggattatttatcctgtagggtttcttaccatgtggactttgctcttccacccctgcagtgttattgaagatgtttctctgtcccctgcacaccccgtgggtggtagtcagacctctagatcgaggcatgatcatgtccgtgtttggtgttttggcaagaagctgcctgagtggtgtgtgcactcatcacgggaggtgttttgttggttttttgttctgttttgtttttcgattttttgagacagggtctcactctgtcacccaggctggagtacagtggcacgatcgtaactcattgtagcctcaacctcctaggttcaaatgatcctcctgtctcggcctcccaagtagctgggactatagcatgaggcaccacgcccagctaatgtttttacttcttgtaaatatggggttttactatgttgcccaggctgttcttgaacttctgggctcaaggtattcctcccacttcccaaagcaccaggattataggtgtgagccaccgtgcctggcctggaggattattaatagtgcaaagtcaaagtgagtgaagagtatgcttgcctgtgtgtcgctaaagacttaaagaattgtctaagaataacattaaatgtattgcagattgaatttacatcacattcaaaacctaaattaattcacagtaaggttttggaagctataagctttaggagttagaaaaataaaaaggtatctctggtatggaaacaaaaaagatggtaaatttcctctggagaagaaaatggatgtggttttgcgctgggcctgcccacgagtgttctgagcattcgtcctcagactggtgagcctccgttcgttttgaaatgaagtatttgattctttctgtttcacggccagttgataatgttataaatgaaatttgcttttggtttctggttcaacctgttgcaaaagtcagtctctttccttcttatctttttgccatctttttgtttctattttctctgttctttcttcctccccctaaatttctgcctcatcctgtattttacagaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagatggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcggctttcgctgtgtctcctgtgtgtgttagaatccagagcccagaggaag

SEQ ID NO: 17566 - DNA, 37412 bp, Human
gataccgaaatccacccatgctcaggtgccttatataagatgatgcaatattctggtaaagaatatcctaaatcctcccacagacctccaatcatttctagattacttataataacacaacataactgctaaataaatagttggctgtactatattatttagggaataatcatgggggggtagtctgtagatgttcagtacaaatgcagtttttttcttgaatatcttttactccaggttggttgaatccacagtgtatgcggcacccacagatatggagaggcaactgtatagtgtgtgtagtcaataatgctggtacagagattatggcctgtagatgcagggctccagtctgttggggtaggcaaggaccaaatcagaaagggctatttcatcatgctagctttccatgaagggaaagggaacccgctgaaaaactttctgccagtagaagcatcattctagtataaacgttgaaaggtgatctgaagggaaatgaaactagtgattgcccagaaggaggaaaagaataatccctgactaaatttataaagcccttactccccgctaagcagtttccttcaatcatctcatttaatcactaaaatgagcaatagttatccccactttatagatgatatccacagggcttgctccctcacctcctgcaggtcttcaggcaagtataagtgcctcgcactttcctattccccttgctttatttttctcctggttgctcaactcaatttaacatctgtttcgcttttgaaatcttgtttaaagattctctcccacactagaatgataagtccctaggaataatttaatttgtatttcagttctgtatccccagtgcccaggacacagtcaaccctcagtaagtacataaatgaatacatttttaaaaatgaggaaatcgggtcccatagagattaagtaacttgtccttgatcgtacaagtaataagtggcagaattctgatttaacaacccacattcttaaaccactaagtggttacaccagagttgtaatattgtaggcaagaggcaagtaccctcggactgcggtagtggggaagcggggtgataggtctgcctcgaattggtgatgactggatgtggaagggcgctgaaagggctcaatctagcatgactttggtttctacatttggcttatgggtaaacaggagagcaattcttcaggaaaaagaatacaaaggactccaggtttgggcaaaacgataagaggaggacgtgtcttaatccacgatcctttttaactcttttactatttcccttagattactaaaacatgttgttaatttgaatatatgtgaagccagtaaacccaaactgatcccttcgtcttcagtctgaggccagtgggggataggggtggggatggggacggggatgggggtggggacggagaggcagaccagaatagggtcagctctttttttttttttaagttagtccaaacttaccaagagtagaaataagtccccagcagtgcttaactctgaggtaatttttaaggcagatgctaaaactggagaatacaccgtacccttgtggagtcaggtagtattcgtagttttagattatcctgacggtgttagtcacttgtagaagtgacaatgtgcaacaggccactgacacccaatccctggatggccaggagggcaggagggcacccggccgcggcctcaggctgctgagcaggcgcaggaagctcgcgcctcaaacgactcccaaacccgggcccggcgcgaagcagggaagcgccgctcacattcctgcacgctcgcccggccgcgggccagcggcctccggtccccaggtggcgctgtgggctcgcggaggcggccgcggcaccagggagcgtcgtctccctggtgcgcatgctcgcccccgctgcgggctagctgttgtgttttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgaggtgagcccgccccgagtcccaaccgcctgccccgccacctccagcccgggcccgggctccagatgccagccccggcttctccgcccaggacgcggggggctcgggcccggggtgggtgcagacccccagtccctgaggtgcaggccttccctgccctgccccacgtcggcggcagctccccggcggccggcccggagatgcaaagtcccggtgggcctcatcgcggcccgcagggggtggggaccgccgcgtcgcccccttcctgacccgccgccgccccctcccgccggctgcgcggcgcagttcctggttcccgcgaagggttacgtggcagccggcgaggggcctgcgggcgggggcggcccctgcgctgccgagctggctcggggcgggtgggcggacttggggggactgccagcctcggccgcggtgagcgtcagccccgcgagggccggggaaggccgaggcccggcccccgggtctgaggagtgccggcctggagaccacaggccccgagtgacaggggagcccccggtagctccgagattggggtgagcgagaaaccggagtcaggcatctgctttcgacttgaagggcggtggccgccgggcaccggcgcagtggaggcgcgccagattgttttcatttttgtcttttaaactgatattattaccagttaacgaactttttgccctgacgctttaaagaaacaaggtctgatggataaatcgaggttctgaacagcggtgccaaggaatcgagtaattttgtttcttgaagtaggagaggatgggaatgtcaggagtgtgtaaattctcttcccacgtatctagtattttgatgacttatttaacagctgttgaatgtggatgataaactttgcaaggtgaacgagtaacatcctacgtttttcccctcgctccccaatacacacgctcattcctttgcttttttccctttttaatttttctctggagcctttatgtctcagtaaatatacaaattattttgctcctgccttgttttgtctcctctctcctgcatgtaacaagtgagagtagagattttggagtatttttacgagtctgtatttccagagtctaggatagtgcctgggacataggagtgcttaaaaaaagatgagcgacgttaagaatccttgagaaaacctaatggaatgatattaccagtgaccaaaaggtgaatacattttctttttaatggagcatatttgtttttttttttaattttaaaattaaataatattttaaccttattttcgcctctcatcaaatgggcttttctggatctagatacagatattatttactcctgattgtgtcatgcatgtttgaaaccactgctaaggaggtagcaggtatagttaaagggtaggtagaaggaaactaacattctcaagctttaagtctgggctgtgccacctacctactgggtgacccaagtctgagcctcaatttttctgctctttatcaggaaataatatcacctgtactgttctcctcacagccattttttgcaagtatcagatgatatggtgtgaaggtaaatacagtgctaggcctggtgctctggcttatgcctgtaaacatcccaacactttgggaggccaaggcaggagaatcactggagcccaggagttcgagaccagcctaggcaacatagggagaccctgtctctacaaatgattttttaaaaattagccaggagtgatagatagcacgcacctgtggtctcagctgggcggctgaggtgggataattacttgagcccaggaggtggaggctgcggtgagccaaggtttcaccactgcactccagcctgaaggacagagcaagaagaccctgtctcaaaaaaaacccaatgttaaacatttgtattcactttctgaatttgatacttgcatgtactttctgctttgatcttaaagtagtactttaatatatgtagtatattcaattttctgtaacttgtcataaaccatctccacatggtaagaattcctgactttaaaaacatattttaggggtactgtgacctgcaaggtatatttgcagtgctttgaatgaaatgaaatataaatcagaaattctgacacatagtataactttgattttatataaactattttacattctcttactatatttctagggaagtccaccacctataccttgcctcacatgttagtgatttttttaaacagtggattttcacctttatataaatttataaaatttgaaaatctaaatagacaaaaatactaaatagaggtttttaagtcaattcaaaagtgagtgttaaagtgatacacaaaagtgaagtttgtgcgagttcttcctttttcttaccatatattaaggtgttaggatttcaaagcatgttatctatatataggactttgtagactaggttagttttgctattcgacttttaaaacaattgctgctgaatctcaaagttaacataattatagaattacagtacttgtgctagaataatagagaaattgatttttttttgcagaactgttaagcctgttgtgcagatacattgaggaaatgtcagaggatttatggtgacattgacaaagaaattcagaaagaaagaaatactgtattactagccaaaatgaagaagcaatggagatacactgtaaaagcatggattctggagctgaagggattcatgttcaagttagggctctgcagcttgctaactgggtgacctagggcagctcagaactgaagtttcctcatctgtaaaatggggcttattgggttactctgacaaattaaccaatttgtattatgcctagttcaatacttgacttccaaaaggtgtgcaataagtggtagctattattattctttaaaaactcaccaaaattggtaaatagaaagcatttttatgtgagagaagggcctggaatctctttagttagcatctaaagagattatacatactgaaaaggctaacaaagtagtctgtttggcagtaatgtaagagtttaatttccagggaacttcacattaatcaaaaattgcttgtaaattttggaatcatagttttattacagtaaatatctgtccacataattcaaatcatagtatacaatgaatggcttcatatttgagttaggaaaaattgaatggtcaaaaaatgttagggatgcttgggaagctttctgaaagtgagtatgtggaggaggggtgaagaattaggggttcacaagagaagtatttcttttaaggagtgtataaaggaaagatattcaaaaggaaatatattcaaaaggaaagatattcaaaatctgcaagttctttatgccatacagattttggggacgtttacaatttcaacaatcttgaaacagttttcaaggtttgggttttttttttctttcctttttttctttctttttatgacaggtaaggtgctcaggtcagaacaaagtttgagggagagacacatctcacatataagcgtgaaaccccaatcatcacacttgtgaactacaaaagggtctctcttttttttgagacagggtcttgctatgttgccttggctggaacttgacctcctgggctcaagtgatcctcccctctcgccacctgagtggctgggactacaggcacgtgccactgagccccactggaagtggaatttgatattcagaattgtctttacttttcaaggatccagtccatgtagtgactggtcacatcttcctctaaaacaagtgcaaagtagttaacatctctatataacaagaaagataccaagccccaaccggtgacatttaattaaagaaatgttattgtatttatgacattgcatacagcatagaattaggtaattcattacagtttctggtaacctatttaagatgcatctgaataagtctcttttttcatttttccatttttgtaaatggagagcagctctgtaaatgttcaaactgtcataaactcaggtatttttactttcgagtgcattatatatttctgtagcctatttatattctaaactaacttatcttactactaattaattgtggtgtgagtttaactgcagcaatgctagcagggtgtgaggcttaggaggcctggaaatggctaggagcaagactgctagcttaaacttgaaactttttggagtgtgtagtttacatttttcctcttcttcttctatttaaactcacatgctaaaccagctggaggtcaaattttaattttatttggaagcctggctaaaaggataatctaatttttgctgcttttagaatttgatgctaaatttatctttgaagaatctcatttgttgtttgtaaaggactctttttgagatggagcctcactctgtcacccaggctagagtgcaatggcgtgatctcagctcgctgcaccctccgcctcctgggttcaagtgattctcctgcctcagcatcctgagtagctgggattacaggctcccgccacgatgcccagctaatttttgtatttttaatagagatgaggtttcaccatgttggccaggctggtcttgaactcctgacctcaggtgagccagccaccttggcctcccaaagtgctgggattacaggtgtgagccatcacacctggcctgtaaaggactctttaacaaagtgttcttaggtgtgacagtggtgacttcatattacaaactggaaacagggatgtggagtgtttgtgtgtaaaacagattgtgtgtgtgtgtgtgtgtgtgtgtgtataaaacatatatatagtgtgtatatatagatatatattgtttagactatatatatatataaaaaatctaaacaaagatagcaaaactaaatgaaatgtagtgaccactcaactttactaaaaataatcacatgaaagtagtgttgccctggagactcatgtcatcgttctgctctaatgagtccttgttaatgacccaaattttaatagagtagccttagtagccttttctactcaagagaccttcatatctaacccagttcggcaactcactttactggccgtatcctgcagtttgtcatgcaagcctgacttcttccacttcctgaattctaggataacagagttcagctacaacctacgttttgttcacctccctcattctagtactcataagtcagtgctctacctagtccaagcttttgtggtaccacggccccctttccctttctccagtatattagccccctcattgttttgcctttcttcctgcaatctttactccactattggccttttcggtgcctctcaattcccagagaaagtcatactcatgctagtagataatattgcaaatcaaaggtttctaacctcagacattcgcatccggtatctttttactttccctggccatctcctttccctatgggaactatataaatagtcatcattcatgtccccattatgcttaatatgtgacattgcttttttctcacacagggaaaataaaagtttatcaagcacggatttcctcattttcctgtcttttgaagttatgtgtcccatccattactgccttcttcccatctaagaggaaaagttgttcaagagtgcaatactcagtccttacaattttgttccctgtcatatgcctccatccgttattctctttctatcctgtgtgtttaacttctcccttttccctgttgccttcactgttgcccccacacaagctcaatctctcctatcctaaaaacaacataaaatttgacctggcatctactggataccaccttgtgcctctgtgttcttcagtccactgcaatgcagctcctgctctcactacttagttggaatcactcaagctgtgaccactgatgacttcttaaattgtccagtctatcgttctctttcctcccacatctcttttgaaacttttgactttattaaccacaccttttagaaatgtttcccctttggcttttgggactacaagctctttttatttctttctctgtctctctaaccattttttcttagtttcagtgacttgaagttttgcttttttccctgttctctccatgggtctgatgttgtcctacttctctacaaatactgtgcactctccatatatgatttatgtattttcacagcttcagctattatctgtagaaagagactcccaaatctttatttaagctaggttctccctactgagttctagacttaggttttagctgccttactgcacatctcccagaaatctcagctgtaggcatcaataaataaccttgtactctttcttctagcttaccaaaccttattttgccttatgagtgcctcctgtatcccacagtcactgtcttagttcaggtctcattatctttcatgtggtctcttgcagaagtttcattcttggctgcatgctcactccggtttgtacttttaactgatatttattcagcgatattgattaattacctaatatgtaccaggccccatgctgggctctgaaatatagtgatgagtggaaacaggcatgatcccagttctaatggagcttactttctaatgggcgagacagaaattattaatataatcaaccagagtatgcctttgaaggaaaggaacacagttctctgagataatctaacaaaggaaatgacctactctaggaagacagggagacttccttgaaaaggtgtaatgcaactgagatctgatgggaaatattttccgaccgtattttagatagaacagcatgtgcagagaccctgtggtagaaggtgctgcagaggcagagagaggagtcagaccatagagtcctatggtcacattctcctagaaagatgggaatctagtgaaggatttttagcaggtagggagggggatgtggtaacatgatgagaaaatcattctagttgcaatatggagaatggatctgaaggggcctgggataccacttagcaggtcacagagagcaatccttctaaaaggcataaatgaactttcccgtcctcaacattctccacttgtgcgaaagtgaaatctaaactacttagctcaaaaaacagagtcctttctagcactcaataatgtttctagtcttttctaacgcttcctgatgtgcatcctgtgcctggccttgtgttcactgctacttgatcttgccacgctctgtttcttctatctgtactgtcctcttcatccccctttgtgaacctagggaacacctattttccagcaaaacacagctccttcatttcattccaccccagaaaaaaaaccaacaaagctcattgtttatcccaagtacccacagtgcaagctattggcacttattctacagtattataacagtttatttacctgtacttttcacaccacggagctccttgtcattagggattattttatccatcttcatctcgtccttttttgtctagcactttgcctggtgcctgtaaagattgggtaagcattccatttttctgctctgaccagtttacttttaccagtagtcaggtcagttaaacagttattgaccacttaactctgctgggtgtgtgggatactaacacacccacaccacagaccctatatttgatctgcttttctcatgctaactgtgcttctctttattttattaatttacacttgaaatttgtcttaataggaactttttattcattgtatagggctagagtagagaatcatcatttgtcaaataactgttttctggaactgcagaaaatgtcttttgaaatcttaaaattaaggatgaattacacaattttacctaaaccgcagaagagtactctagtgaattacattagctccttggcaatcagtaatttccattgtgtctgtcaggattccacaggaacgaggaggcccttggtgcttcgatttagggacagattttataatgtttttgccccgatctgttatttgggagagggtcacaaaatgacttgatctttgtttttccttctttgtagataacggcaaaagcttctatcatttttgttactcttcagtacaatgtcaccctcccagcaacaggtaggtaatttacgctaagaattttctacgtaaatagaagttcagttgaacaaacttggaaattttcatgaatgctaggtcctgcgttaattaatcgtcagagatctcatccatgatgtgactgaatgttattgtgatgattttataatacaagatctgatgtttttgattgactttaccctgtatatgttttctgtttactatatatttttgtgaatggacttgaaattccataaaataattttgttttgctttctctgctttctgattttttcctaagaaaattataagaaaagatctttttaaaattgtttaaatgtcattgttcattcaagacttctaaaagcacaatggcagatttagtttttctgtaagttacattttggacctgtaatagcaatcaatccttctaagattattttcactttttcctgtgctctacttttaacaattattttgattccagaaaatgtgttagtaagctctaggaattatctggtaatagcatccaaactattaggttttatttcaaaaatcttatttcttaatctatgtaaaaattaggtgtttcttggaagttgattgtaatttaatacagtgatataattaactagcatgggtgagggatggggtattttttggttgaggcagtaaacctgcacagttttttatttagaatgtaagataatatagtataccacatttagttggggttttttgttgttgttgctgttatttatatgtgtgtttttaagagatgacagggtcttgccaaatgtgttacctaggcaggagtgctgtggcgtgatcgtagctcactgcagcctccagcttctgggctcaaatgatcctcccaggtcagcctcccaagtaggtgggactacaagggcacaccaccacgcccagctaatttttcaatttactatagagatggagtctcactatactacctaggtcagtcttgaatttgggcctcaagcaatccttgcctccctaagtgttgggattacaggggtgagccactgcatctagcccctgagttgggtttttgttcagttatgtacagttttgtaaatatttaatttagtgatttagttatcaggttactcaaaactacaatactgttttgaaatttgaatatgccagagaagaataaagctcttttatgtatatgttccccataaacataaagtttgagaataagtgtcagcaattcacaagtatttgataaagatttgttttgaaaaattatagcaattgcaaggattaaaaacaactttagtagttgcctttatctctgctgcttatagatcaaaactaaatcaaatacaggtcaaatcagctttttcatcagaatcataatttagtgtgtagttagaaagtagaagtagaaagtttcaaaagccctttgaaaaaaataggtcagtaggctaagtataactttatcaacctaatttatacccctgggataatatcagtttattgagtgtggcctcctcttccctgttttttggtctttggtggctgtgactaacatgtgtcaagtctttgtaagtaatttctaaagctttagatttctagatagttttgattttcattgcccctctaagactcaagatgtccaagaccacgttatttatgatgttaatatagaacttttttattaggttattcttctttgtttccataactatgttgtacttaatgctgtttttataaccttgtgtatatttttgtgtatttgtgtcctttttggtcttcagaagaacaagctactgaatcagtgtccctttattactatggcatcaaagatttggctactgttttcttctacatgctagtggcgataattattcatgccgtaattcaagagtatatgttggatgtaagtatgcagtcttagaaatctatactttataaagtactagctctccataatctgctagtcatatattaaatataatttataatttattcttaattactaatggctgtttttatttttagaaaattaacaggcgaatgcacttctccaaaacaaaacacagcaagtttaatgaatctggtcagcttagtgcgttctacctttttgcctgtgtttggggcacattcattctcatctctgtaagtatgtcctcttaggttgttgttctccttcctcatctaagattagaaactctgctaatgaaatagtattaagttaagagtttcagtgataaatctgttttaggtatttttttatacagcaaaaattctaaactatgtttactgtttcagaaaggcttattcatttttagtcactctgaatgttacttttatatctttctttttttttttttttttttttttttgagacagagtctcgctctgtctccaggctggagtgcagtggcatgatctcggctcactgcaacctccgcctcccgggttcaagcgattctcctgcctcagcttcccaagtagctgggactacagacgcacgccaccacgcccagctaatttttgtatttttagtagaaacaaggtttcaccatgttggccaggatggtctcgaactcctgacctcgtgatccacccgcctcggcctcccaaagtgctgggattacaggcttgagccaccaagcccggccttacttttgtatcttatagtggtttacagatacctctgtatcagcaaaaagcgtaggttacatgagttgtaatgttcacagtcatttcctcctttaaaaacagccccagtgttttccaagcttcttaaatgttgtataacttttcagttatggcaatcaaaacctttagttgtatcactctaactaatgagaaaaagaaaggcagtatttgctttaatattagtgataacaatcccttaaatttatatggtgttccatagtttacatacttttgagtttgtcagacacataattctttctaatcactgtattagagatgaataacagtgagttttccagggtaaagcacttcatgttggaagtagactaaaactcagctttttattccattgctcattccattttactgtgctgctttaataatactttataggtaatatgtaaattttagtttaaaaactattatacatttttttaaaaaaacataaaagttatacttctgtgggaaaatactcttacaaaaatcactttagattttatttattttttaatctttttttttttttttttacatatgcagtaattctcactgagtagatctgattatctaagaaaaaaattggggcagtattttattgacgtaattccataaaactcggtagcaccctgatcctttgtctcctgtcagatgctacaaacttttcctgaaatcttctgattacctaagacaaaattcttctctcctggtcactgttgtgcctcttattggtggttttatgtttgtttgtgtacgtgtatttttattctatgggattgaaagattttttagggccaggaattatgtcttacctgattccatatctcatttctatcattgattttcattttgctcaagtaaccaactcaaattggcttgaaaataactaaaacaactaaggattttgacattagtgggttctttgcaacctggtatgggacctgtaaatgtttgagaaatgaaagtaatgccttattttccaagaagtttgcattatgctcacaggttaatttttatatcttctttcttaggaaaactacatctcagacccaactatcttatggagggcttatccccataacctgatgacgtaagtcatttttagcagccctttctttgttaaggaccatggtcatgtcactattaatcagaattcattcttgttattctctttaggaccttaggcaaatgcataaaatagatgaaaatatgtctttgacagtcccactgccgtaagaaaaaaaaagctgtgtacctttttttaatgtttctattctaatcttttcaacatctttgtaagcttgagacaactgattttaacataacttaatttggtactcgcttcttttcccttcttttcactcatactttctcctttttatgactccatcttctctatatttttgctccttttctttgtccccaccccctgtctcttttcacatcttcctttctttctcctattataagcttcttgaggttaggaattgtttcttttttatttctctagtctgtacagtgctgctgggttaaagtgctcagtggttaccaagacgtctgaataattcattattcgagcccagctctagtacaactattctatattaattttccttgctattttagcctgtattggtcttttgtatccccaaatttgtcattttggtagaaatttgatgtagtgtctatatattgttttgattgttctataattgtctcatttttgtaagtcttgtattgtgcccatacccactaagactatatgtgccttggtagcggtaaaaactattttatatccttcattgtgccaggtacattgcaagtgcttgtcacctacacagtatttagtaaatacattgtgatgtgagaattggagaagggagaagatacgaaggaaagaagggaataacctgactgtgggtattttaagtctagcagtaatacccactctactgaatcatactctgatttctaaagttttattagttcaacgaactttgtaaatattatatttatgtgggactgtattctctccaccccgaccaccaagaaattaggttggctttgtgttttctattttagacttctggaggagaaggagcagggagaataaagaggaagcagaagggctagagggatataatgtcaagaggagagtattggttctagactgattatgatatagctcctggagagcccttgtgtgccttattctgactgtctttaatcctagctctgcctccatttatttggggctttctccatgttccaaccaggtacagttaccatatttgcctaagaaaaaaaaaaaaaaacagaggatatttgaaattgggattattccagtttcaggtgattattaatctatgagcctttgcttttgtgtcagtctttttccccttcttgtcttgatgaaactgtatagacatgtgggttatgttttcagtagctaacatgacatactagtcagtattaatgaactaataggggctctgactcctcccaactggcttacatgtcaatagctttctgcagatagtatctttgcctgctgtttaatccaggggtcttgtccaatggtgggactgtcacagggagatggggaaagaggttgttgaagagttgtttaaaggtgcacagatattgtatggaatgatgacacaaaggtagttacttagtatatcctgatttccagtatttgtttacttttttttaaaaaaattatgctttaaaaggtactcttcattttcttgtgttgtacagatttcaaatgaagtttttctacatatcacagctggcttactggcttcatgcttttcctgaactctacttccagaaaaccaaaaaagtaagctgggattttgtagtgttaaaaaatgtcttgtcatttttttttttgaaaaatttttctaaaattaagtattttcttacatgtttgcccttcctccattcttcttacctcaactcttaccccatcattctcccaccaaccctctttccacaaagcctaaaatccttaagcatttcttgaaaaaaaaaaaaaaaaaaccttcagtcagtattttagcttagattttttacatttgatatgttaatggcttgtcttaaaattatgttagtggtaatgtaaattaaaatttaaactaatttttaaatgtaatatttgttttatcttactgatattcttagcaaattatttcacaagtgagccaaaaaggattagtcacattacaactaacagttctgtgtgtaagtcctaaagcaaaattcagtattggaaaaaaaagtaaaatatatttaaatattcaccagcaaagcctctcttgaaatgggtagagcattccctttttagcatgtggaaaggatatttgtttgttttatttgaacaaataagtaaactgctggagcactgcaaaatcctccttcctagttttaccctcagtgcttctgaagtcgggttccatgctatcacaaaagtcgttttctttaccctctcccttctgaaacctgtattggctccctattactttaaactagagtaatgctgctcaactgtgccctgagagtttctcccatcgccaccatcttttctcggggacctctttctctgcttactccttatgcttcatgcacactgatagtctctagttttgtaatcccagcacatcacttctttttcctggaacacctcttccctcggataaattaatcaagtactttcatttcccttttttctgggagttttttttttttttttaattctcatatatgaaatcctatgtgggattttacttcaaaataataccaggtgaaggaaagtgaagagggatatagatgaaacaagtttgatcgtttattaataatgattgagttacgggtatgtcagaatcttttctgtctgttgtgtatatgtttacatttttccgcatttaaaatttcttttttttttttttaatcccctttgagaaacctggagtgaaagtgtgacagccagtctggtgactagtttatctttgcctactcaaaagccataaaacactatttttatgtgtgctacaaatagttaattcatggactaggcacttgatttcctactgtttcgtgtctgtgttctgtgtatctgtcgttactcatgttgtctgctaggattagaaaacagcaccaaattaaaggccatatgctatggtacttaagttctttttatgctgatttcttttataaagtagattgtttctccagctatattgataaggaataggatgaagaccttttatttttaaacccttgatttagaactgtcttcagataaaattgttaggcccagattccagtagcccttccatgtttagtaagctcctaatgtgaatcatagatattgtggagctgtactgtccaaaatgctaactactagtcacatctacatgaacttaaaaaacaaaaacgaaattgacttttttagccccagtagccacatttcaagtgcttattagctactgtggctagtatgtaccattttgaacagaggagatatggaacatttccatgattgcagaaagttctattggacagcgctactgagagtatcatagtttcttgatgtcttagtagcatggctcagatatttaaagccttcttaaggtatttgtatactcatgaacaaatacctctggatttcattattaatccatgtctatatcttcttcattgactatggtaagtaagaagggacatttcaaagtaattgttcattttagttcctgaagctcttttcttatcagttcctgccagatggcacttctccagaaatgcagtctaatttttatggaataatttgcataactcagaacttaactgaaactatttttaacacctgcatatgacagttgaaagtaactgtttcaagtaattaacataatttgaaagtagcagctgcatatgtgttaaacagtttcttaaaatttactctatgaaaattatttttggaactctttactggaagaaactagtacagtgattgttttgaaccaatcatacagacaaataggaaagaaaggaacgctgttagtagcagttcaagaggtgtgttagtcacaaataacttagtttctttcaaagagaaaacttaaattacatatactgtgtatataaacagttctccattttgcccatgagaagattcaaaatatttcgtagacagcttgaatatatgagcttttagggaagtcatgaaatagccaaatgttttatttctaatattcaattttagtttaattatacatacatataattatacatacctataattgcatatcatataaagtattagaaatagtattttcccccttcctacttcatgaaagtttcattacacttttcatatgcaactttgatgttagtatctgtcattcatcatcactagaaccacttttttttaatctgatgacattttttccacatcatgacgtcatcttctgtctcactggttccttcattagaccttataaacctttaaaaatgacattgattgaagttttcgggtgtatgtgtcttacgcaaacatttatttgtcaagataattaatacagagctctataatgcagagctttgtaaagatttaattataagatgtaccatctggggtttggggggagatctttgccttatatttggggcatatatttgatattcagctttgtttatttttcagtatagagtagtcaagaaatgtgttttttataaaaataaattttttgaagtatgttatattttttaataaacagatgttggaataacaactgaaaatggcacttgaagttatttacgattttataatttggtatgatttcacccagccttctctgttctctcccttcccccacaacccatgtaaatgtgtacgtccagagaccattgtgctggtgctaggcaaggctttgttgtcggcctcagacatgtgaacaccgtgccatcggggctgtaaccccagaggaaatggagaacattgagggaggctggcctaccacaggaatactaaaaagtagccattttctagataaaatttatcattttaaaaatcatggtaagccaggcatggtggcacacacctgtagtcctggctactggggaggctgaggcaaggggatggcttgattccaggagtttgagaccagcctgggcaatgtaatgagactcatctctaaaaataaaataaaactcatggtacactacccctacttccatgtattttttgtaatcatttgggaatacctttatgtagggtgtttgttaagttagccacaattcctaccaccccttgtggtattctactcatctcttttttttttttattattattgttgttgttatccccattatacagagagattaattagcttgcctaaggtccctcagctagtaagtgacacaagtatttacccattctcttactaatttactttttctgtggtaagctttgagtgtacaaacactgctttagagacactagtcaatttgtgcaaagctgaatggaccattacttagaaaaaggtttcttgataatcctttttgaaagcaatagatactatttttaaaacttttgcataggcatttgatggttgtgaagatagaacctagtgatggcattttaccctctattattattgactcggttgactatccaaaaggaaaggctactgggcacagtggtgcatgcctgtagtcccagttactcaggaggctgagatagcaggatcacttgagccctggagttggaggctacagtgcagcataattgcacctgtgaataaccactgcactccagcctgagtaacatagtgagaccatgtttctattttttaaaaaggaggtatggggctaagatacaaagttgaatctgaacttaggaaagaaactctatggatttttccttagctaatgtcaagcacaactgcgctccacctaattgggttgaaatttaaagacaaaagatcagaaatggaatggctttttgaattatagtttgtttgtaatttataatagtgtttttagtcttgtcagagaagaaaagagtaggcagcttaggttctctgctaattgaccagtgtgaattttaaaaacttacttgtatttcttttaaattaaaaaaaaaaaaatcctcctaagtagttacattacattatagtttttccagcaaattagtttttttttttttttacattgccttacccaagtttttatgcaatgaaatgagttcaatcagcagttaaaaactaaaacgcttccctcataagttttaagggttttcttggtctgttttctcctctgaaatgtggagcattgagtaacacatatgaaagaatatggcaatattttttatacctagtcatttatgtgccaccttcctgctttaccatattcacatactactaattcatacttttgacattttaattattaaggtatattaaataacaaaatattttgggtttttgttttgttttgttttgttttgagacaaggtcttgctctatcacccatgctggagtgcagtggccacaatcacggctcactgcagctgcagcctcaacctgccaggcttaagcaatcctactacttcagcctcccaagtggctggaagtacaggcatgcaccactatgcttggctaattttttgtatttttttagagatggggtttcgccatgttgccaaggctggtttcgaactcctgggctcaagcaatccacctgcatcagcctcccaaagggctgttattacaggcgtgatccaccactttatttaaaattttagttacagttaaataaaagtatttcattgtgtactgtctgcaatcattttgttcagtaccaatgtacacaccacactgggaaacactggcatatatatagtggcacttctacatgcattgtacatcaaattgcattgataatactaagtgagcttttctgagatgattataacgggagaagagaggttcccttgtggttgcatgttatctcaacaccctttctccttccttttgtaagctgaaatatttcattggaaatttacaaattatgtagagaggatcttaagaccgtctattttcagagatacttctctcttccattggaagaatgactgtaaacttggtatcaattttcctaagagtcccaaaatacagtactgtaaattgtaatattcagactgtcttatgttctacctaaaacttgatctttgcgccatgcttactagagaagagttttccatttcaaaactagacttcaaaaaatctctactcctcaaaagatttggtgaagtagctctcagtactgaaacacagagaaatggaggaccagtagacctgcactcaactgtgctaaatgcaagagataagtttagtgaggctgcagaggaacacagttcagcctgccagcagcaacccaccatttccatcgttctaattagtagctgtagaacatgaatagtactaactagactaatataatccttgtaaatatacatacgaagaaaactgctacaacaaaggaaattagaaatgaggtataggtgtttcattagtcagtaggctggcctgttgagcttatcactgtcagtgttttgtaaacatttttactgcaaccaaagatgaaaaactttttacatcataattcattgtgtgtttgtgtgtgtgtaaaatgtggaatacaattttcataatacaatgtgctatatactctagcattttctttttctttttttttctttttgagacagcgtctggctctgccgcccaggctggagtgcagtcacaatcctagctcactgcatccttgaactcctgggctcaagcaatctttctgcctcagcttcccaaatagctaggactacaggcacatgccaccatgcctggctaatttttaaaacatttttttgtagagatggggtctctctctgttgcccaggctagactcaaacgcctggcttcaagcaatcctcctgtctcagcctcccaaagtgctgggatgacaagtgtgagtcatggtgcctggccacattttctattttatttcatgttttaaaagatgctggtgtgacccctaaattgatttcatgatccactagtaggtcttttttttaaaagacagagtcttgctctgtcacccaagctggagtacagtggcatgatcatagcttactgtaacctcgaactcttgtgttcaagtgatgctcctcctgtgtctgcctcctgagtagctgggactacagttgcataccaccacgcctagctaattgtagtttttgtagagacagggtcttgctgtgttgcccaggttgatctcaaactcctggcctcaaatgatcctcccacctcggcctcccagagtgctgggattataggcatgaaccatcacacctggccccactagtgggtcttgacttgtgttttctaaaaatactgtttctgagataaccagctcaactagataactgtgggagaaaaaaagaagtaaaaataaaatctaggtacttgggcttgcaaagtaattgaggaaaaagaatatacaattaaggaatagtataaatgagaatacaaaatgttaaacttgttgtaatgactgacaagggactaaagcatgagctgaaaatgtgaatcctattttaggtaaacagaagtgtctctactactatgaacataacaattttaatattagaggaacatcaaattgtcagcatgtaactatgattaatattgtgtcatttaatacacattagaaaaaagagccatagatcttagctctaaaagggattttgagtttatctgattgaagcaaatctaagtattcacattttatggatgaaataactgaagccagcagaggttaagtgacttgctaatgctatatacctaattgaggatgagagattgcggtggggtgggagcagaatagctttcagatctcctacttctacatttttcacttactcttaaagaacagaaatgagccaagcacagtgggtcacgcctgaaatcctaaccctttggaaggccaaggttgggggttctcttgagtccaaggttttgagaccaacctgggcaacatagcaagaccacacctcttaaaaaaagggaaaggaaatgttttagcatgttttaatctataatgtatttttttacaggaagatattcctcgtcagcttgtctacattggtctttacctcttccacattgctggagcttaccttttgaagtgagttgggatatttcatgggtgtgtaagtaggctgggcagatagtatgctgacctgtcttaattgataattaatattcccatttttaatttgctcttttaacagcttgaatcatctaggacttgttcttctggtgctacattattttgttgaatttcttttccacatttcccgcctgttttattttagcaatgaaaagtatcagaaagggtaagttgtttagccattctatttctcgtgtactaggtatttaaagtcagtgcctaacattgccaagatccatgctttaggccattatattaactttttaagcgatcagtagccgctttaaataaaacgaaattatttagcaattcagactttgtattttactctctaaaatggaggctttctcagctagagagatactgtattgtatcttgcaattttgaaggcttcttgggtttacttttctgttataacttttactttgtttgttgcatggtttttcttttggaggagtgatagagaagtgaactctcagaagaaagtgaaacaatagataattagccttatagataactaaaatatattgatggtgaaattgaactgaaaacagaattggagaggtgtaacttgtaaagagtgcaaagttgtcttaaaaaaagtaaaactgggactctttttttattattttattattattatactttaagttttagggtacatgtgcacaatgtgcaggtttgttacatatgtatacaagtgccatgttggtgtgctgcacccattaactcgtcatttagcattaggtatatctcctaatgctatccctcccccctccccccaccccacaacagtccccagagtgtgatgttcctcctcctgtgtcgatgtgttctcattgttcagttcccacctatgagtgagaacatgcagtgtttggttttttgtctttgcgatagtttgctgagaatgatggtttccagtttcatccatgtccctgcaaaggacatgaactcttcattttttatggctgcatagtattccatggtgtatatgtgccacattttcttaatccagtctatcattgttggacatttgagttggttccaagtctttgctattgtgaatagtgccgcaataaacatacgtgtgcatgtgtctttatagcagcatgatttataatcctttgggtatacacccagtaatgggatggctgggtcaaatggtatttctagttctagatccctgaggaatcaccacactgacttccacaatggttgaactagtttacagtcccagcaacagtgtaaaagtgttcctatttctccacatcctctccagcacctgttgtttcctgactttttaatgatcaccattcctaactggtgtgagatggtatctcattgtggttttgatttgcatttctctgatggccagtgatgatgagcattttttcatgtgttttttggctgcataaatatcttcttttgagaagtgtctgttcatatcctttgcccacttgttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagagctctttagtttaattagatcccatttgtctattttggcttttgttgccattgcttttggtgttttagacatgaagtccttgcccatgcctatgtcctgaatggtattgcctaggttttcttctagggtttttatgtttttaggtctaacatgtaagtctttaatccatcttgaattaatttttgtataaggtgtaaggaagggatccagtttcagctttctacatatggctagccagttttcccagcaccatttattaaatagggaatcctttccccattgcttttgtcaggtttgtcaaagatcagatggttgtagatatgcagcattatttctgagggctctgttctgttccattgatctatatctctgttttggtaccagtaccatgctgttttggttactgtggccttgtagtatagtttgaagtcaggtagcatgatgcctccagctttgttcttttggcttaggattgacttggtgatgcgagctcttttttggttccatatgaactttaaagtagttttttccaattctgtgaagaaagtcattggtagcttgatggggatggcattgaatctataaattaccttgggcagtatgaccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattatgaatgggagttcactcatgatttggctctctgtctgttattggtgtataagaatgcttgtgatttttgtacatcgattttgtatcctgagactttgctgaagttgcttatcagcttaaggagattttgggctgagacagtggggttttctagttatacaatcatgtcatcggcaaacagggacaattagacttccacttttcctaattgaataccctttatttccttctcctgcctaattgccctggccagaacttccaacactgtgttgaataggagtggtgagagaggccatccctgtcttgtgccaaaaactgggactcttaaatgagaattgggcatcctgttctttataacacagcttttttggtttgttttgtccagcattttccaaaattattctgaatactagtagttctgaggaatattaatagttcttatacaagaaaagagataagctaaacagaaaattaaacatttatttcctggattgttttagaaatttaaataggctaatatgtgttatatctctctgagtgtgatatatagcctttcccagatatttgactcaaaattcttttttgcagaataagaaatgctattttaataggcttttacttaataggaatctagtttcttctttatttatttatttatttttttgagatggagtttcgctcttgttgcccaggctggagtgcagtggcgcaatctctgctcactgtgacctccaccttctggtttcaagcaattctcctgcctcagcctcccaagtagctgggattacaggcgtctgccaccacgcccaacttaggaatctaatttctaatagaatcttgtttttgagatttcaggaatttgacttacggcctttttcttgcagattttctctgtgggcagttctttttgttttgggaagacttctgactttaattctttcagtactgactgttggttttggccttgcaagagcagaaaatcagaagctggatttcagtactggaaacttcaatgtgttagctgttaggtacgatcaatttaacatttttttcactttatacagctagataatatatattatcagtttctctacattgaatcatctaaaaaaggatgaatatgaggttggggaaaatactcatttgattttatttcatacccgttgctattttacatgtctaaagtgaagtactaaagcatttaacttttaggataaattattaatgcaatgattattaatacaattttctcaactgagtgggaattattactaaatactatgaaagatgatagaatgtattcagtggcattgttttttatacactaactttttatgtcttaatatttcttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacaggtttgtattcagtaagcaatgaaaaactcatggaagtagaaaacttttaaaaaatttgttgttggatcttatttattagttttaaggtgtcttataaagaaaatactattctgcttttcaacaaaattagaggcaaagtaatcttactgcattccacaattgggtgatcccttgggtgaggaaactcagttactcccctcaaaagctgtccatcacatttctctttaacaagttttccatgcttggttaccttgagctactttagaccaaactttatgggcaggtttaaactaaacctgaggatggtagtttgttttcaagcatcttattcacattttaaaaagctcttcacaacctcttcccatctgcccatttgtcccaagtggaatagctttttttttataacttctgattgcttgattctttgtctttaaagccttcatttaacctcttttttccttatggtttttgcaaaaattgaaaatgcatcgatattacagttaattttttcagtgtgtatgtggtattaggcttagaactataacacaggaagtttttagagtatgtccactctggtttactcctttgtaagtattaatacctgataatttacatcctacagccctgcctttttttttttttttcaagtttgtcccagcaagtcttggccctttgcattttcttaatacattttagtacaacttgatctaggtgcagtggggggtgcctgtagtccagctattcaggaggctgaggcaggaggatcacttgaacccaggagttcaaggttacagtgcacaatgatcatgcctgtgaagccctactacactccagcctgggcaacatatgcctctttagaaaaaaaaaaaaaaaattatacaacctggtcaatttccacaaaagttgctgggatattaagttgaaataacatcaaatctgtagatcgatttagggataattgactatttcaacccattaacatgatatatacctctgtttatttaggttgtctttaatttctccaagtaatatttttaatagctttaatgggatgtaattcacataaagtttaccctttaaagtatacatttcagtcatttttaatgtatgttcacaaaatcgtgcaaaccactatctaattccagaatatttctatcactgcaaaaagaaaccccatgccccttagcatcacttcactttgcccccttcattctgctccggcaccctctaatctattttctgtctctaaggattggccttttctggacatttcatgtaaacagaaccatgtgatatgtggttttgcaaatggataatgctttgaggttcatccatgtcatagcatatagaaagacttcatttatttttacagccaattaatattccattgtatggaaccttttggatggatgtataccatattttgtttatccattcatcatttgatggatattgagtgccttttactttttggctattatgaatcgtgatgctgtgaacatttaggtgcaagtttttgttcaaacatgtgttttcattctctagggtacatacataggagtgggatttccgagtcatgcggtaactatgtttaacattttgagggaactgccaaactgttctttgaagtggttatactattttacactcagtttagcatcttgatactcagttgtccctgtgccatttgttaaaaagactccttcacttgaactgtcttgatacccttttcaaaaatcatttttaagaaaagtttatttctggatcatgaattctatttcatttattcgtatgtcgattcttatgccagaaccacactatcttgattactgtagctttgtagtaagttttgaaagcaggtaatgtgagtccccattgttgttgttctattttatgttttggttattctgggtttcttacatttccatatgagtttttatttaagtgacgggatcttgctatgttgcccaggctagacttgaacttgtaggctcaagggattctcccatcagcctcccaggtagctgggactacaggcatatgctgccttgcccagccattttaatatgaattctataatgagcttgtcagtttctgcaaaaaagccagctggggttttggtatggattatcttcaatttgtaggttgctttgcagagtatgaacatgaatgtctgtttatttagatcttttaatctctttcaattatatttatcagtgtatacatcttgcagttcattaaatttaatcctattttattctttttgatgctgttgtaaaatagaaccatcttcttaattccattttcagattcttcattgccattgtatatgaaatacaattcacttttgtatattgatcttgtatcctgcaaccttgctgaatttatttattcaaataggtttttttttttttggtgggcaatctggatgctttctattgcattttcttgccaaattgccctgcccagaacctccacaacaggtgttgaatagaaatggtgagagcagacatccttgtcttgtttttgatcttaggggtaggcatccatccagtcttttaccattaagtatgatgttagctatgggtttttcataaatgacctttatcaggttgaggaagttcccctctgattcctagtttgtttttatcatggaaggttgttagattttgtcaattgctttttttcctgcatctattgagataaccttgtggggttttgtcatttttttctgttggtattatagattagattgattttcagatgttaaaccaacgttgcattcctgggataaatttcacttggttatggtgtatgatcctttttatctcttgatggattttggtatgcaagtattttgttcaggtttttttgtgtctgtattcataaaggataattggagtatatttttcttgcaacatcgttgtctggttttagtatcaagataatactggcttcatagaatgaactggggagtgttttttccttttctgttttttggaagagttcttcacttgatcttagccaaaatgccaagaagcaatggaagagttgttgaaggagatattttataggtttctgtatagggatctcatacatttttcattaaatttattctcaggtattttcttttttaagctaatgtacatgctctttttaaaaaacagttttaactatttgttacgtagtagtgccatttgttttctttaagatactatccaggtactgaaaaaagtcttcctaattcacttattctaaagtttacactaaaatatacagttacagcgtctataaatattataccttttcattttcttcctgtattacactagctaggactaaaccataatattcaatataagaaatgaatactcttgttcctcatataagagggagacctttcggtatttcattattaagaatggtctgtagatgccctttattcagttctcttctgtacatcatttactaagagtttttgtccatgacttgtggaatgttaagaaatgctttttctgcaagatttagttagtcatagagtttttctttactctattaatgttgtgaattgcattgactacattgactatcaatgttaaaataattctgcatttctgacatgcatccaagttggtgataatacagttgtctccctgggggaatacattccaaaacccccaatggatgcctgaaaccaggggtagtttcaaactatatagttacgtgctaaataatgacatttcagtcaacagctgtacaacatatgtgtatacatgactcatttatgacactggtcctataagataatgctttatttctccaataccatttctatgtttagatatgtttagatacataaatagttaccactgtattacagttgcctaaagtattccatacagtaacatgccatgcagatttttagcctaggagcaataggctataccatatagcctgggtgtgtggtaggctctaccatctagatttgtggaagtacattctgtgatgttcatacaatgatgaaatcgcctaacacatttcttaaaacatagcctgttaagtgatgcatgactgtatatactatgttttctcctaattagctatgataaagttttatttataaattggtcacatataacagcatattgtagcaaaagttaattgaatgtggtatttttctctctcaaaatattatacagtactcatctattttcagaccatggttgactgtgggtaactgaaaccgtggaaagcaacactgcaaataaggggagaccattgtacatcactttcgctgaattccctttttcagtatttcattaggatttttgcatctttgttcatgtaataatagatcagcctgtattagcccttttttgtaatatgtcagattttgacctcaaggttgtgctggctgtaaagaaagtgttgggcagatttgtcctttgtgtaatatcagcattatttattatttaagtgtttggaagtgttcaccaactaagccctctgacctagagtcttcttttttttcgaaacagggtcttgctctgtcgcccaggctggagtgcagtggcacgatcttggctcactgcagcctcaaccttgtgggctcaagcagtcctcccacctcagcctcctgagtagctggggctacaagcacatgtcaccatgccactactttttgtgttttttgtagagatgggatttcaccatgttacccaggatagtcttgaactcctctacccaagtgatctgcccaccagtctcaaccaattggctgggcacccagcactttgggaggctgagatgggtggatcacttgagcccaggagttcaagaccagcctgggcaacatgacgaaactctgtctttacaaaaaatacaaaaatgaaccaggcatcgtggtgcatgcctgtagtcccagtacttgggaggctgaggtgggaggatcccttgatcctgatgtcacccttggggtgtcacttcaccagctggaaacctttttggctggtggcaccttctgcctgagtattgcttgcatccgctgggctcattccacccacttggcctgacaggctgtgcttggcttaagctaccggcccagatcctacacctgtcaagcatgagccagacgtggagcagcagggggtgtgtgggcaagcacacacaaggtctagccactgcgcacagccagacacacaggctgctgccacggggcaggcagctctaggcaccagcaggtgctggctctgtgtgaggctgcagctggaccagatgtactgcatgcggcttccgctgcagggacccatgactggacaaggggagtgtggtggcatctccagagcttggagatggtgggaaccactgaaccccaaagagggtgtcatagccctggctcagggagcccctagatctgggcttcccagaggagcacagctcttctctctttcttgtcatccacaacgtggtgagcagaggggcatgtttcagccttgtttgtgctatagccctttcagtcccaccattcagcaggtcccaagttcttgtcctgcatccaggaagaatgaggtatgcagacaactggagggtgagcaaggcagagaggaggttcattgagaggcagaacagttctcaggagacctgaagtggttagctcctatccacagtctcatcatctgcccaagtctggctgagtccaggatttttatgagcttcatgggggaggaagtgcatgctgattggtccatgggtgggcccagaaaacactgtaagttctcactccagtccatggaactggtggcctggcccccaggtttcaggctgtccctggcttgaagaggggggcttcaccagggcccacccctttctgcccaggaacctgtctgcctcctgctgccatcaacctgccatccgtggtgcctaggctggtcatgccaaggggtgcctacagacccacaccaagctgccctcagcccccctcggcctccctctcgtgctcatcagcacccaaagtcctgacagggccaagggagcagggagctgccttgggaactttggacctgctgaatggcgggactaaaagggctatagcacaaacaaggctgaaatatgtccccctgctcgccacgttgtggatgacaagaaagagagaaaagcccccagatctaggggctccctgagcaggcatatcagtgctgctctaatcccagggtcagtctcaccttcactccaaaactagcagacgccaggagcagcagagtggccaggcagtgggagcaggcacttccaagcctgcagaggtagtagggcttcctgaacccccaagaactacagctgggtggctgccactgtgcccaggagtgcgggactcccaccactccaactttgaaagggatggggctcctgctagctatgtggagcacacagccctggatgcacctctcacactacagccaatgtcatggcagtagccactccacaggggctgccgctgccatcactgagaagtggaggttgcagtgagtggagatcatgtcactggactccagccgggataacagagtgagaccctgtctcagaagaaaaaaaagataatactattgttcacattttctgtttcttagtcgtttctcttttggtaaataatgtttttcaaggaatttgtctagttcatataaatttgcaaatacatcggcataaaattattcatatgactttcgttatcctgttaacacctctaaatcaggagtgattcctgtttttcatttcatgttgttagtaacgtaagccttttatctttccttccatcagtcaaaaccaacatttgtctttttgtgttgattttcctagttgtctcttttctggatcattgatttctattctttccttttcattgggtttaatttgcggttttgtttgtgatttaccttcttgagatggatctttggagcattgatttgtatctcttgtgaattacattcagttaatggtaaacttttcctttcaacactgctttaactgtatttcacaaggattttttgttttgttttggggtttttttttgtgtggtttttttttttttttcttttttttttagatggagtctagctctgttgcccacgctggagtgcagtggcgcgatctcagctcactgcaacctttgcctcccgggctcaagtgattctcctgcctcccaggtagtcaggattacaggcacccaccaccacaaccagctaatttttgtatttttagtagagatggcatttcaccacgttggccaggctggtcttgaactcctggcctcaggtgatccacccacctcagcctcccaaagtgctgggattacaggcgtgagccaccatgcttagtctgtatttcacaggtttcaatatgtctttttcattattattcagttcaatgatatctgtgctgggattccacttgtgctgtgattataggtgcaagccattgcccccgcctcaaacatccatttctgtatgcaacttttgtatttttggagagagagtcagtcacacatacgctactccatcatagcttgaagaaggccattactattagccaggtgtggtggcacatgcctgtagtcccagctatttgggaggctgaggtccccgggagcatcactggtccccgggagttcaagactgcattgagccatgatcgtgccactacacagccttggtgacagagtgagaccctgtctcaaaaaacaacagtaacataaataaataaaaagaaggccataatacacgcctccacatagaaattatcctaaacaccaactttactatattgtaaacaaatatccccaaggacttcgctgtcaaatgtgaaaagtttctttatttctacagaaggtatttctcttgaatactatttttaaattcttgtgactttatagttttctgtgctgtcacttttttctgcttttaatagtagttttcttttaatttgctactttcagttcattgtgttaaaaatgttaccaggttttgtgattggttaaatactggtaagtaaatttcacctgagtgaattggattttacattttcttttctgaaggtatctttacatataaagattataacttgcatttatttataaaagagagtaacatggattcttttctttttgcagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaagttgtatcctggatgtttctgtcattgttggtgtttaggctattttggtatataacctcattaaaatgtaccatatttaaaacacttcatagacattcagaataacccttttcaaaattgtgttctgcaaataaacagatttgttccacagaatattggtgaggactactggggggatagatggtcataaccaaataaatctgggaatcactggattaaactaacctaaaggtgtctctttattatgggaccgttcagtccttaatatgcaaacgtgtttcctggtgcaccaagaatgttggatataatatgcagtgtttcccaccttatttgcctgtagaattttctgttcactgaattactatagcactttgttttctgcagcatacactgtgtttaggcaaagaaaaaaaaaagcccttgacatgtcattaccaagggctaatatatacacagaagcacatatacacacaagtatgattataaattatgagccctacatcctgctctcaaatgtgctgaggaaagtct

SEQ ID NO: 17567 - DNA, 109025 bp, Human; identical to SEQ ID NO: 12609
  misc_feature (1)...(109025): n = A,T,C or G

SEQ ID NO: 17568 - DNA, 16158 bp, Human
  misc_feature (1)...(16158): n = A,T,C or G
agctaaatatggagatgcggtttctccatattggtcaggctggtctcgaactcccaacctcaggtgatctgcctgcttcagcctcccaaagtgctgggatgacaggcgtgagccaccgcacctggccaaggcacttggtttcttagatcacccacttggccctcttccaagttgtactttccttctttccttcctgttctaaagttttttaatatttttttttttcctgaaatggcatctcactctgtagcccaggctggagtgcggtggcgtgatctcagctcactgcaacctctgcctcctgggttaaagcatttctcctgcctcagcctcccaaatagtagggattacaggtgcctgccaccacgcctggctaatttttgtatttttagtagagatggggtttctccacgttggccaggttggtctcaaactcctgatatcaagtgatcctcccgccttggcctcccaaagtgctggagtttggagttacaggcctgaacctctgtgcctggcctgcttttttttttagactgagtcttgctctctcgccaggctgtagtgctgtggtgcgatctcggctgactgcaacctctgcctcccgcgttcaatcgattctcctgcctcagcctcccgagtagctgggactacgggcgcatgccaccatgcccagctaattttttagtagagatggggtttcatcatattggccaggctggtctcaaacccctgacctcgtgatccccccacctccgcctcccaaagtgctgggattacaggtgtgagccactacgctcagcactggcctgctttttaacaagcttttactactgctctgcagcttacctccctctggctttctgccttatgcccctcagtgcaattctttcttctgaggaggcaagaattgaggttgttgctgatgtgtagggattcaccacccggaactccaccagtaacaggtcgaggatgctagttgaaaatgttatgtaagctgcatgctttttacaaatggtagtggttctcatgtccagcaatggccactgcaccgtccctgtatgaaagtcccctccataaatctatgtctcctttgctgtctccagatctcctcctctacctctcccacacggtgccttccctactggagtaaactggggtcccgcagggcaccctttccctgcaattttttttttttttttgagacagagtctcgctctgttgcccaggctggagtgcagtggtgcgatctcggcttactgcagcctttgcctcccgggttcaagcgattctcctacctcagcttcctgagtagctgggattacaggcacgcaccatcacgccccgctaattcttttttttttttttttgtatgtttacaaaatagggacggggtttcactatcgttggccaggctggtctcgaactcctggcctcaagtgatctgcccccctcgggttcccaaagtgcacctggcctctctccctgcatctttatgtgcctgcaacaccaagagggagctcttggcccctgggttaaggtcagggctccagaagcccagggtcaaggctatggccgcatcccaaggacgtgcatccctgcaagaggctgcatcagacaggcatggaagaggcgccgctggggcctccttgaattcctgctgggaaaagcaagtggaggtgctccttgaagaaacagggggatcccaccgatctcaggggttctgttctggcctgcggccctggatcgtccagcctgggtcggggtggggagcagacctcgcccttatcggctggggctgagggtgagggtcccgtttccccaaaggcctagcctggggttccagccacaagccctaccgggcagcgcccggccccgcccctccaggcctggcactcgtcctcaaccaagatggcgcggatggcttcaggcgcatcacgacaccggcgcgtcacgcgacccgccctacgggcacctcccgcgcttttcttagcgccgcagacggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggaggtgcgatctcggggcagggccgggaggcgcccgaaagcccggcggtgggagtaggggagcccgggccccccgcagacttcttcccctgggcgtctccgagctggggcccgcaggaggttaaaggtcaacgggcttgggggcgccggcttgggggacgggggaacaggagcaccctggagggccggggcggattaggcaggaggagaaaaggctcttgccgagccctttcccgaggtaaaggctgagtctgtgcagtatccttcctttcaatatttatttttaatttttaaaaatttttttgagactgggtttgcacctgtttcccaggctggggcggagtggcgccagcctaacttctgagctcaagcgattctcccgccccagccttgcaatttagggggtgccaacacgcctggctaattgaaaaaaaaaaaattatctgggctcggtggctcacacctgtaatcccagcactttgggaggtggaggcgggcgaatcgcctgaggccaggagtttgagaccaggctggccaacataacagggtgaaacctcatctctactaaaaatataaaaattagccaagtgtggtggttcatgcctgtaatcccagctacttgggaggctgagtcaggagaattgcttgaacccgggagtagaggttgcagtgagctgagatcaggatgccactgcactccaacttgggcgacatagtgagactacgtctccaaaaaaaaaaaaaggcaaaaaaacttaaaaaaaaaaaaaagatacagggtgtcactatttacccagggtggtctcgaactcctggcctcaagccatcctcccacgttgacctcccaaagcgctgattactggcatgagccacccacacactctggccacagcggcatgcactgcacagagctgggcccggggatcgggagaaggtgacagtttagatgtcctgaggtcagctctgccgaggcaggaagtcccttggttttcaaggttcacatagaggacaggacatgacatcaggcccaggacgccacccctgttcccctcctgacttggatgtgatctgcagagaagtggaactgggtgaggtctgggcggcttttgcctggtctacatcctcttattctgactttgcagcattcagtacaggagggaaagaggagggggctgggtgccagtgtgcaccccactcacagtgtcctaagcaaagctccccccattcctccaaccagccttcctccctgtgacaggcagtggccatctgcctcttagtcacaggtctgaaccttcttgcctctggctgggatgtggccctgggcttgctcctgtctcaggagatattgtgccccatccactctgaggaggaactcctggccccactggcccaggtgcacagatcgccctggcagttgacctgtcatcagcaagttatctgtcctttctgccaagaatccccgctatgtgtcagggcttgtgctaggcctgggggcacagccgtgcagcacactggtcctggacccttttgggggcctaggagctgagcccggctcttctctccacagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtggtcagtgcggccaggagcaggcagggcgggtgggggggcacggctgctgaacagcatgggacctccagctgccacccacggcatgtatgctggggtgggatggtggggggtcctgccctgccctgccctgggggctgtgccctgtatagggggataggtagcctgatctaccccattgggatgtcattcttcccgtctggctggaaggccccggagccccatgctgcaggttatgtgagggagtgcccgatagtagggcgcctcctcatgccctgacctgcagccccctccccgtatctcctgtgtctgcagtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtgggtaccatcctgcctccattgcacacacccaccttcccgccccaccctgtggtcttcctggtagggactgggtggccttcacagagtggaggccttggatctggggaggccagggaggcctgtgagctgaggtcaggggacccagagcaagggcccagcaaaccacagtcctcccatcctaggtatcccaagggttactttgtccagaacacatattttgactttttcaactacgctggactgcagcggtctgtacttctgtacacgacacccaccacctacatcgatgacatcaccgtcaccaccagcgtggagcaagacagtggtgagggcttctggtaggatcctctctcagcggggcccagggtggctctgtttgttccctgtttggaaagctctcccaggaaaaaggtgctcccagcatctctacaccctcacagattcccttccacctatgaagctaaaattcagcctgtgtgagcggatacgggctcccaaaatcacccgtgtggttgacctcgctaggagaagaggggtctggcctaacgtcacacagctcggggtggcaatcctgtcccttctctatggtgctactctcactccatctccccttgctacacatcgtgctcaaggaacaggcagcttcggtggggggggcgccgggcatggtggcttatgcctgtcatccagcactttgcaaggaggccctggtataaggatcacttgaggccagtagttcaagagcagcctgggcaacatagcgaggccatcaccacaaaaaattaaaaaattagccagggatggtgatgtgtgccggtagtcccagctgctgaggcaggagaatcacttgagcctgggatgtcaagggtgcagtgagctatgaccacaccactgcactctggtctgggcaacagacgcagaccctgtctttctttttttcttcttttttttttttgagctggagtctcgctctgttgccaggctggagtgcgatggcgtgatcttggctcactgcaacctctgcctcccgggttcaagcgattctcctgcctcagcctcccgagtaactggattataggcacccgccaccacgcccggctaatttttctatttttttttagtagagacagggtttcactctattggcctgactggtcttgaactcctaacctcaggtgatccaccctcctcggcctgccaaaatgcaagggttacaggcgtgagccactgtgcccagctgggataccctgttttttttgtttttgttttttgtttttgagatggagtcttgctctgttgtccaggctggagtgctgtggcgtgttcttggctcactgcaacctccgcctcccgggttcaaacaattctcttgcctcagcctcctgagcagctgggattacaggcgtgtgccaccacgtccagctaatttttgtatttttagtagagatggggtttcaccatgttggccaggctggttcaactcctgacttcgggatccacccgcctcagtctcccaaaatgctgggattacaggaatgagccacagcgctcggtctgtatttaagaaaaatttttgttttaagttttttttctttttaaaaatatatctttttcagggcgggcgcggtggctcatgcctgtaatcccagcactttgggaggccaaggtggggggatcacgaggtcaggagatcgcgaccatcctgactaacatggtgaaactccgtctctactaaaaatgcaaaaaattagccgggcatggtggcaggggcctgtagtcccagcgactcgggaggctgaggcaggagaatggcgtgaacctgggaggcagagcttgcagtgagctgagattgcatcactgcactccagcctaggggacagagcgagactccatgtcaaaaaataaaaataaaaaaatatatatatatctttttctttttctgagatgaggcttgcactgtggcccaggctggagtgcagtggtgagattattgacagccgttgtggggccgcggttctaagtttaaaagaatttaggctgggtgtggtggctaatgcctgtcatcccagcactttgggagtccaaggtggatggatcgctttagctgcaaagtttgagaccagcctgggcaacatactgagaccctatctaagaaaaaaataaataaataaaataaaataaatgaataaaaaagaatttaaaaaagaatcccacagcaaagacaatgcaccatagagcaatttattgccaaggaaaggtattttggaagttaagtttagaacagcctgggtgcactggctcatgcctgtaatcccagcacttttggaggccgagatgggtggatcacttgagctcagaagttcaaaccagcttagccaacattagctggacattgtggtgtgagcctgcaatcccggctactcaggaggttgagatgggagaattgtttgaacccgggaggtggaggttgcagtcagctgagattgcaacactgcactccagcctaggtgacagagtgacacccccatctcaaaaaaaatagtgaagtgcaaaatgcacagttcaccctgagacacagaattcaggacaggctgctcgtaaggatgagacagcaccgattattactggggaaactccctttctgggagtcttccgtgatgaattcctaaggagctgggaagaggtgttactgtaagcacgttctgggccgtcctctggttgcacatgcgtagtagctgtacatgcttgttcacacgtcacgtgtctcagtgccgtggttggcatgtctgagggacacggtcacttccttgactacctatcctgcctcaagatcatagctcactgcagccccgaactcctggctcaagcaatcctcccacttcagcctcccaagtagctggggctgccggggctgcaagcacgcaccaccacgaccggctgattgtttgtatttttagggaagaagtggtttccctatgttaccccaggctggtcttgaactcctggtctcaagcgatcctcccaccccagcctcctcaagtgttgggattacaggtgtgaccactgcacctggccaaaatctttttttaaattaaaaaaagcacnnnnnnnnnnnnnnnnnnnntccaaggtggatggatcgctttagctgcaaagtttgagaccagcctgggcaacatactgagaccctatctaagaaaaaaataaataaataaaataaaataaatgaataaaaaagaatttaaaaaagaatcccacagcaaagacaatgcaccatagagcaatttattgccaaggaaaggtattttggaagttaagtttagaacagcctgggtgcactggctcatgcctgtaatcccagcacttttggaggccgagatgggtggatcacctgaggtcaggggttcaagaccagctgtggccatatgacaaaacccatctctactaaaaatataaaaattcgccaagcatggtggtgcacgtctataatcccaggtacttgggaggctgagacaggagaatcacctgaaccccagaggtggaggttgcagtgagccgagatcatgccactgcactccagcctgggggacagagtgagactccgtctcaaaaaaaaaaaataagaaattaaatttaaaaaaagcaacagaaacaaatggctgcctggcagcggtggctgcagggcgctcctgtttgtgtgactcaggtcgtgtccctccctcagccctggtctctcttgtttcttgcagggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtaatggtggtttgggacatgcctaagggaggtcttttgcccccatgtggtgaccctggcttcagcaggagcccaagacaggtggatgggcaggcatggtcctctgagctttctgatgtttctcacccttggtgggaggcccattttcttttttttttttttttttgagatggtctcactctgtcacccaggctggagtgcaatggcctgatcacagctcactgcagccttgaactctcagcctgcagcagtcctcctgccttggcctcctgagtagctgggactacaggcacatgccaccatgtctggctaaataaaaaaaattttgtagcctgggcagagtgactcatgcctgtaatctcagcattttgggaggctgaggtgggtggatcacttgaggccaagagttcaagaccagcctggccaacatggtgaaaccccatctctactaaaaatatgaaaatttgctgggcatggtggcgaacacctgtaattccagccactcgggaggctgaggcaggagaattgcttgaactcaggaggcagaggctgcagtgagctgagatcacaccactgcactccagcctgggggacagactgagactgtctcagaagaaaaacatttttttttgatagagatggggtctcagtctgtcaccaggctggtcttcaactcctggactcaagtgatcctcctgccttagcctcccaaagtgtgggaactccaggcatgagccaccttgtcttgtcaaagggaaggccatgttttgaagggcaggttcccagggtcagccagggtagggcagaacctctgattgctgcatctctgcttacaggcccagaggcagctgctggggtgcacgaggggccttcctgctggagggcaggccggatggggctcaggctgtcggggtgctcacacctggtgctttggctgtcataggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacgtgtgttggggctcctgggtccttgtcggggctgcttctggtcaccctccactttcgccttccctgtgtcctgcagttgagggcagctcagggcaatgaggcaaatggctccaaatggagagggggctcatggggtggctctccagggtcctggctctcagaggaagtgcagcttcgacagggacaggggtcacttggctctgctatctcctagatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgtgagtctctgctgtgcacctgctccgcctgcccagcccgggggcgtcaccgtgaccctctgtcccttccctcctggcccgcaggcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagtgagtgctccctccctgccctcggctagagtgggaaggagaccctggcaggtggctggcctcggtgggcatgtgctgttcaagatcggcctcgtgtccagcccaatgggaaggccgtccatacccagatagttcaggggaccaaatatctacccacccaaattgtggttttcttttttgttctttttttttctttttgagatggagtctcactatatggcccaggctggagtgcagtggggtgatctccgctcattacaacctctgcctcctgggttcaagtgattctcctgcctcagtctcctgagtagctaggattacaggcacccatgaaccactgtgctggggctgtttttttttttcaaaatgggttctcactctggttgcccaggttggagtgcagcggtgcagttttggcttactgcagccttgacttcccaggctcaggtgatcctcctgtctcagcctcccaagtagctgggattctagatgtgtgtcatcacgcccagctaatttttgctttattttttattttttggatatgcagtctccctctattgcccaggatggagtgcaggggcatgatctcagctcactgcaacctctgccgctcaggttcaagtgattctccagcctcagcctcccgagtagctgggattacaggcacatgccaccacgcccagctaagttttccttttttcctttttatgagatggagtctcactccgtggccaggctggagtgcagtggcgcaatctcgtctcactgcaaccttcaccttccaggttcaagtgattctcctgcctcagcctcctgaggagttgggattacaggcacacgccaacataccctgctaatttttgtatttttagcagagacggggtttcaccattttggctaggatggtctcgatctcttgaactcatgatccgcctgcctcggcctcctgaagtgctcggattacaggcgtgagctaccacgcctggccaacttttgcatttttcagtagagacggggtttcactatgttgggccaggctggtcttggactactgacctcaggagatccacttacctcggcctcccagagtgctgggattacaggcgtgagccaccgtgcccggctaattagagactgggtttcaccatgtttgccaggctggcgtggaactcctggcctctagtgatcctcctgcctcaccttcccaaagtgctgggattacaggtgtgaaccaccacacctggcccccttttcttccttacaatcgtgcagttctaactcagcgttcagagttggatttttcacttggggtagaagcaggagaggtggtagaaatgcctcttgactcatacagcacaccccaatttcatgcagtgctttgggctgagccaagtctgcagcaggcagaaggctctgagaagttgttgcagcctgggccaaggacaattcagagcttgggggcacaggggtgtgctcagcaggactgggtggacaggccctttgttgcgaaggggaagagtacaggcttccaggagcaggtgtttgaggcttctttgggaggtggccagaggagatgcctgttttctggggcaggatttggagggagccacccaggctggagaggttcagccaggctgtcacaggctttgaagtttcccatctgagagcctggctgttggagagtgtgggtttggaacttgaggctagggggttcttttctgatctgtgccagccacagccttcggataggcagagcaatgatgggggagggcgtaaaagaagaaatgaactgaggaaagagaagaggaaaacaggcttcaacaacagtctaggctgggtgcggtggctcacgcctgtaatcccagcactttgggaggccaaggtgggtggatcacctgaggtcaggagtttgagaccggcgtggccaacagatattgaaaccctgtctctactaaaaataaaacaattagcggaacacagaggtgggcgtctgtaatcccagctacttgggaggctgaggcaggagaaattgcttgagcccaggaggtggaggttgcagtgagccaagatcatgtcattgcactccagcctgggctacagagtgagattctgtctctcaaaaaaacaaaaacaaaaacagtctgtactgtggaggcctcgggcaggtgccaggagctctgagcacagatgggtccctctgttgggtttttcttcccttctaagggccatttcttcttatttatttatttattttttgagatggagttttgcacttgttgcccaggctggagtgcaatggcacaatctcggctcaccacaacctctgcctcctgggttcaagtgattctcccgcctcagcctcccgagtagctgggattacaggcatgcgccaccacgcccagctaatttgtatttttagtagatatggggtttctccgtgttggtcaggctggtctcgaactcccaacctcaggttatctgcctgcctcagcctcccaaatagctggggccacaggtgtgtgcggccatgtcaggctaagtttaaatttttttttttttttccgcaagatggagtcttgcttgttgcccaggctggagagcactggtgcaattttggctcactacaacctctacctcctgggttcaggcaattcttctgcctcagcctcatgagtagctgggattccaggcgcatgccaccatgcccagctaggttttttttgtatttttttgtagagatagacttttaccatgttgaccaggctggtctcaaactcttgacctcatgatccacccgcctcggcctcccaaagtgttgggattacaggcgtgagccaccatgcccgcccctaatttttaaatttgttgtagaaacaaggtcttgctatgttgcccaggctggtcttgaactcctggtctctggtaaaactcccaaagtgctgggattctaggcgtgagccgccttgcccggcacttgcaccatttctctgcatgcgtctccactcccactgcccaggacctgtggacttagatttgagtcactgctgagcacctcgcacctagccccatgcctgcctcccagcctgcactccgtttgcttgatgcattaataaatatccctcccaaatctgcatccatccacctcctgtgttcaagagctgtttcagggcgtcaacctcatttttgccagtgtccagcctagtgacctcagctctgtgtacctggaagagtggctgctcctctgggggtataggattcggagatgggggtagaaggagtgatgttagagagctcggtctaggactagaggatcatatgcccttatgtaaaatacatctcaagttagggaagaaagcagcggctccatgcttttttttttttcccctttgtttttgtttgtttgttttgagacagggtcttgctctgtggaccaggctggagtgcagtggcatgatcttggcccactgcagactcctccttctgggttcacgccattcttctgcctcagcctcctgagtagctcagactataggcgccggccaccacgcccggctaattttttgtatttttagtagagacggggtttcaccgtgttaggatggtatcgatctcctgaccttgtgatctgcccgcctcggcctcccaaagtgctgggattacaggcgtgagccactgcgcctggccgctaatttttgtatttgtagtagatagagttggggtttcaccatgttggccaggctgatcttgaactcctgacctcaagtgatccacccacctcggcctcccaaagtgctgggattacaggtgtgaaccatcgtgcctggccccgtgttgtgttctggcggtggaagatgggacagagaggatgggagggtgtctgagccattcctggactgatggaacctgtttcttctgccttttgtggacaggatggtgatcgctcacaccaaatccttggacccctcccggcctgtgacctttgtgagcaactctaactatgcagcagacaagggggtgagcctgggggtccccaccccacttctccctgcctttgcctgggcttgtcctgaagcctggtcatgggaacagccaggaagaaccatgcgctgccagtctgggttttatttcattttcttttttacttaaaaagatagagacagggtcttgccatgttgcccaggctggtctccaactcctgggctcaagcaatcctcctgccttggcctcccaaagggctggggttacaggtgtgggccaccacaccccggccgcagccagtctgttttcacagatggtctttgggttaatgagaattctccccctgcttactcgccaggcagtgtggctttctcaatccaaggaggctgggcatagggagatgggatttgtttgctcagtttggactcagcattttttgcacttcgatttaatagactcataaaacatcaaagatttaagggagcttagagttcatctggcccacacctggctgatgagaatctctaggggaagtttttatgaaatgccagatctctgcattctgaggtcctgatttagtacgtccagggttggaacttgagtttttctttttcttttgtagaggcaaggtcttactctcttgccctggctggagtgcagtggtgcaatcacagctcactgcagccttgaattcctgagcccaagtgatcctcctgcctcagcctcccgagtagctgggactccaggttttcaccactgcgcctagctaattttatatctttttgtagaggtggcatctctctatgttgcccaggctggtctcaaagtcttgagctcaagtgatctcctgccttggcctcccaaagtgctgtgattacaggcatgagttgcagtgcctggctgacattagcattctttatttatttatttatttattttgagatggaatcttgctctgttgcccaggcttgagtgaaatggtgcaatctcagctcgctgcaacctcgtcctcccaggttcaagcaattctgcctcggcctcctgagtagctgggattacaggtgcatgccaccacacccagctaatttttgtattttttagtagagatggggttttgccatgttagccaggctggtctcaaactgctgatctcaggtgatctgcccactttggcctcccaacgtgctgggattacaggcgtgagccaccacacccggccagcatttttactagaaagaaatgtgttcaggacgcattagaaactagccagttggacacagaagcccctgctgctcagctgtaagcaccgctatgctgaagcttggggtggtcctactcggtcgtcaccgccctgctccttggagtgacttttctggccctctgcagtccacagtgctgccttgtgaaagctccctcaagatcctctgtgacagccgggcatggtggcttacacctatcatcccagcactttgggaggccgaggcaggcagattacttgagatcaggagttcaagaccagcccagccaactggtgaaacttcatttctaccaaaaatacaaaaaattagctgggcgtggtggcgcacgcctgtaatcctagctactcgggagactgaggcatgagaagcacctgatggtgggaggcagaggttgcagtgagctgagatcgcaccactaacattctagcctgggcgacagagcgagactctgtctccaaaacaaaacaaaagattttctgtgagaatgactgcatcggcccctcgggtggcagcgcttctccagggcaaggtgaggggaagcccagtgatgggagtgctgcctggagaggagtcagttccagtggtgggggccctgggctttggctgagggctgtgcgttggcagctgctgtgcctctcacagcccttcccagcggcgcacgtcatgagtgtcagtgtggagtcccaggcctacctcctctgggccactttgtgaccatgtttcttgcctatggcagggtaatttcaggatctaaattggtacacttggacgttctcagc

SEQ ID NO: 17569 - DNA, 29909 bp, Human
ttacagatgaggaaaccgaggtccagagaggtcaaggggcctgcctatgctaatgaatggcagggccaggtctggaagctgattctcctgattcataccttctgtcttcccccagactcctcctgaggctgctccttggcctcaatcagtcctcgcctgcctccacctcacctcatcaccttccctccacccccgctgctccctcagtaacatcccaggtgactgaagcaattgcagccatttgaagaggctccacgtgtcagtcagcctgcgagccgcggggaggtggggaaattacagatgctccaaaatagtgttcccctccccctgaggatatttggaattcaggaatcagactctgcctgatgcttcctcaggtctctgggaccctcccaggtgatttcccactctcaaatgccccccacgagttgattctaagtatctgggagagggctgccacccagtggctgcccgggggcatagcaaccccccagcactgcctggtaccgctgaacagctccccaagacctgaatggaagatcctcccttccttttggcagctccgtgtccagtcccctagtaaatggatctcgacctccctcctccacaatcttaagtccactctcccactagggacctccagaccccttctctggtttcctagatgtccactactcccaacttctcatccaacttctttccaatgtgccatccccttctcgttacaggttttcttctaacttaaagcccggcaccatgtcctaggaatacacctctcaccatccttctccccgagccgcaccagcctgcaagtagagcgaaggagccactagagacagaactctggtcccccgcaccctcctcctcatcatctgacaccatcagacctcaacagcctctgtgctaagagcccctaatgagcatcagcaaattaacaacttccccttgattgctccttctctgttaattggatagggagggcccccctccccaaggcctctcagagaagaggagggaggcagggaaggagaaaggtgagagccacaggagcagcccccaggcctgcgttctgtgctgagacttctgctccatccctgagcatagctccccgttccaacccttcctcaccctgtccccttcactccctttgcctccttccttctgtccaaattcccttgacctctggctatttttccttccttttctctgctccttctttggagatttggcagtaaggggttgcgaccatgccccccacaagcccaaagctacaaggatgggatctgagtggtcaaggctgcgtgttggctcacatatgtgcacgtgtatatgtgtcacatgtaggtgggagcagggataagagcaggtgagtgcttgccatgtgggtcaggcccccgggatacgtggacatctgttgcgggggggtgtggttgtgaatggtgtggtgtgactctggtcggtatgtgtgtctgtctccatatgggctaagtgcttgaattagtcaagtgtgactcggagcgtgtgtgtgtatgtgtgtgtgtacgcgcgtgtgtgccaccagaggaagcagcagcaagaggcaggagcatcgatccgaaggagacagcgcggggagggggacgctaggggcagacaccctccctcctgcgcgcacacacgcgcgcgcgcacacacaccacacacagagtcatacacacaagccatagggcctcgcaggcagggagacggctccgggactggagagaggcagcgccgccgaaagcggccgcgaggaggggcgaggcggcgcggggagccctgggtcccgctcccggatccggggccccgcgcgcacaccagcccagagacagcctcgcagacactcgtaggcgcgcacgcgcaccctctcccctccccctcccctcccgccgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggtgggtttccgatacccctgcctttggccgcgaggctcctcgctaccccgaagccgggactctcctccctctggatttcccttgctgctggggcggctcggtggctggggaggggggcgggggccgagctggggatctgactgcgacgagaagctggactggggggggctgcgtccggggcggggacagctcgctgtcatagggaaccgcgccccccctccatacatccacctcgggcagcccgccaccccccactcccaacatacacacagcctgcgcttatgtgagaactggagacacccgcaggtgaggactcaggctgggcccctccctagatgtagccacctccctgggggttttctggccccagtttagcccttaggaccacagccccgtccagggaatacccgtgaccaggacaggagctccttaccccggggtcagcccatctgggtgagttttcatctccaggatggggtggatattcttgtcccagagtgaccccacatctggagggaactcctgcgcctgcctatgggtgcatcaggacttccccctcaacctcggatgactatatctggggtctccccgggcctgggaagcttctctggggagcattctcttggcctgacctgaccccctgtgcctctgtatttggaggaaccctggatgtgtcccttggtcagccacctctgggcttgcaaagcagggaagtcttctgcccgaggagtggtgacctctggagatgaggattctggatgggcacatgtggaggggctccatgtgtactttcatcccaggacaatgatagactgtccctccctcctcccccaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtgggtggctcccaccctccctcagccctgctcctggagttgcttgagttccagtcaggatgtctgcctccctgacccaccatagagcccagccaaccctgccctttaacccacccccacccccaaacctgccactcacagcagaggagttagggtgctgctgagcacccagttaagggcacccagcctccgatcccagcatagtccagaacagctcgacccccacccagcctgaggtatgagacattgtcaccctctctggagtgagctttaccttcattctggccactctgtcttgaccttctcgtcagttgggggatggggacagaacatctttaaagggtagaaactacagtataaaagccacagcccctgccttgtctctctgcccaccttatccatgcttcctctcacccatgtgctgggatgggatgccctgcccctgggcagccactacagttcctcctgtcatttcagacccatgtggtagagcctctgcatgcccagctctccttccttgcctacacctgggactgatccccagggctggaggctgcccccatcacccaagttgggtgcaggacactgatgactgtactgacccgtgtgtcactcacccccggaccccaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtgagtcccctcgtgtggggtgtgagtcagcctggcccacagaggaggaggaggagacaaggagcaggctgggcctctccgggtgcttgctactctgggagaggaagttgtatgtcctggggtttgcttctagtagaaggggagtttgttcagcataggggcacatttgcactcactgcatgagcacctgagcctcagccttgcagccatgatggcaggaaagagagcctacagtgcacaacacacacatatatgcacacacgtgcgtggtctggcatagccacaaacccaccaagcttaccttctaggccacaggtgtcagagctgagcagacaggtgggtaagctacagccttgttacttgtagtgaggtccaggaccatcaactgggagcttgaaaggaatgcaggactttgccaccccacttcccaaacctactgaaccagaatctccatctaataagatcctcaggtgactggagtatacactaaagtttgagaagcaccgtgaagcacaagtaagggaaaccttctcttaaatagccagacagtaactccctgtgtgccatccgcaccccatacatagacacatacactgtttggttaggtttcctgcttgccagcaagagccgcagagccagggtctgaggaaaggaaggccatcgggacacccagtcatggctgccctggaggcttcctttgcatcttaaaatggagatgccccacagatgtggctgcctcaggccagcacctcagggagggcatagggaaactgattttggcatctgatgtgctgggcaaccctgggcaagtcacacagattcctgagggttaagacctggacccagatggcaaagagaccagaggctccagagccatgcaggaacaataacaccaaatgaatggacaatgcttgtaactctttcaaatgctttctaggctcccctcaatccccttgatacataatcacattacctctgttttacaaatgcacgaaactgagacacaggcagaatgatttacccaagctcacacagttagtgacaggtgacaggttcaggattagaactcatgtcttgttaagctgaaaatgtcctttactcttttaattaatattgtggaccctggggttattgtgtccacttcaaattcttgccagtcttttccaggaccctttgctctccatgcctactcagctcttggattctcttccttcttcctgcctattttctccccgcttgcttgcttcctcctgcagtatgggaatatgaactgtatttgtgcagaaaggatggcaccatagtcatgcttagtgtttctagctgtgcaagacttcccaatctccttaagccttgctctgcagaccagtttcactggcctttgtcaatcctgctggacaaagttcacatgactgcactctttgctgagccaagctgatggggagcttagccaagatgcaagaaccacttccttccctctcttactgcttcataacaggagagtcctggattccccagagcttgagaccagagggtttgcagtctcacaagtgatgctcccaagagtaacaggactgtaggtgaaggtggaagcaaaagccagagccgcctccctccaacacacccaacacacaagcaggagggacccgtgagaaagatggagaaaacgtatttgtttgagtggtttgtagtgttggatgagggagagaagtgcttggctcaatctgaggaggtgctaagatataaatttgggcacagttagtccatagaaagtattcagttgaggctccatctgtccatcatgtccagaaagattccaagtggtgatgctaagataacatttggttgatggtaatggagacactgagatgtgattggtccatgctgtctgaggggaccattctaagtagtcagatggagatgtgattggctcacaaagttctggagcagtctgaattattcctcttactcaggggtaaagacacacaggctagcaccctgcagccccagctgtgccccttcttgcttctgggttgtcagggaagaccaggtttttgctgttttgcagcccatgtcaaagacctgaccctgaattttgctggactcaaacctctcactcctccctctgctctcttcagttggtttcattgccagcccctctccatgtcaagagctctacccatagggatgttcccacacagatgggcgtctggctggagtccatgtctgacacctccccggtggagaagggcctggcagtctctctcctccagctccccagtcctaagggctcccacactccttgcctgatactccatgctctcccttctctcctcagtcttgtgattaacatccttgccattctctgctaggccaagaggtgtgttgggagtgtgtctctagccctgggcagatgtagcactgacaggaaacacctgtctatagggtcgatctaagggagaccatcttggcatcttctgcagccttcagagcagaggttcttcactgaggaaagaaggtagtcagggaagagaggctttgtggttagggctttgcttgctctttcagtagctcaggaagaagctgctgggccccatccaacaggattgctgtgggataccaccccccactgtccaagaccttgctcaatgcttttgcaagtatagtgtgcgggggcacgtgtggactcttttgtagatttctaagggcaaccctcttctcaacaataagaaccctgtttctcaaggctggttgggggaggcataagaagacaattcagggaggctactctggtcactcaaagaccccagctcccctgatgaggatctgcagtaacaggcatttctccagatgtgctcctggatctagctcaaccccagggaatagttggtggtcacaaagcatttggccagggtccatcccccaggtgtggctgagtcagcttgggagggtgggggtgaatatggggagcctgagctgaatctgggagagactggtttggaaatccttcgggactgaagagggagaagggcagggcagggagtatccccacagcaacctggctgggaaggtttcaatagctgcctcctgagcaaccacagtgacccaaccacaaggccccctcttcccggccacctccttttcttcctggtagggtgtgttgttgccaagacaatggggtccatggctcctctctcctgccccaccttgaggccagccaggccaaggcagggcagggattccatggaggggggctggggtgcagctgtctgctggtgtctgggtgggggccagagaagtgagcacagtcgcagctggtgccatcctccagctgcaccttatctgtccctggcagtgggagcagctgatgtggccagaatgctgagcagcagcaaggggagggggctggcagatggtcacccagtctgccctatgccaccccctcctccgctgagacctagaccctttgcctagcggagagagaagcaggaattcatttctggggcctggaagagaaggaagaggaggacagagtggaaatgctggggtggacatgtggtgtgactcataatctctctcaggagggtgaaattgggggacaggaatccctgggaggggtccacaggagtccttctcaggaccctggattggagaccagaatctcccagggaagaggtggagtgaatggggatgagcacagaagcctcccctgcaatccactgctaggttctgaaggggcccgggcatcccctggagcacctagggaagtaagatgctgcaatgagaggtggctatgggcgcctgatcctgggacccaaagtggggagagagaagtcatcttaaagcaggagagccagggatggcagtgcccagcaagagccaggactagcatggagtttattcatccctagggctcacccctcatccccacaccccatgctgccccatagaagctcagaccagaagtcccttgggagggcctgaccttactactggggtctgcaccctccagctaggcagggagtggaggggctgctgaagggaaaggctgcccagactgccatgcagagaggggaaggggaatcttgggcagctccacccagaggcctggtggtcttcatgggtgggaagggggaacatgcacagattgcagagggatagaagaggccaacctggagacagtaactttagaggaggggttcatggggttcatgaactttgggggaagggttcctgccctaggggttcatggctaccacctcctgccttatccttctcatctgtccctctctcctaggaagtgcctaaactgaacacaggtgggtggagagaggagacgggagcagagcccattgcagttgcaggaatccagtgggtggtccctgggttggggtctcagatgtctccttttgcctctctctcagacacagatacacacaaacatccttcaggtagcccaatttcctctctcacctcttccccttctccccagaccccagccatttctgactccatccctctctcagacagctatcagctaagaactactctaagctaattgacctgggggctgttggctaaagcaatagggaattcagtaactaagtgcctctgggggccaagcctggaagtggagggctggggaggagcacctctaagtcttgggactttgtcactgcccagctggtggagaactcctggatatggccactgcatgcccagtgtgtcctggaggcagaagggcaggcccacagagaggcttggaatgttctgctgtggatggaggttgcttctgagtgtgtttcagttttgtggaaagtaatttcaattctctggggatagcgagggagacagaatattcagaatgagaagctgggattaggggagcgttaagctccactggattcattcccatagcagacagtgccacttccatgtgccaggtcctgcgctggggcagttaagtgcagcacggaaggttcagggctgagagccatgggggtggtactaaagggggcccagtggggtgggcttcagaacaagggggaacatgctggggatgagcagactctcaacatccagggggagtcctcccaatctccccagccaaactcagcctctcggaaaatgccaggttcatagaatatgttggtgtctccccagctaactaaatcaaccggccaattctctccggccattcttccgccttggccaacccctgcccacccccacccccaagctttccctcacttgtatgtttggggtggccaatgcagaagcctctaccttctgacctataacgtcccagtcaggacccttaggtgtgcattctgggaggcaaagctggaaggagacagcgagaatgagaaggggtgcctagctgggtggaggataggactgggcattagggctcctggtctctattttgggcaaagttccacctggccccacttcttagcttctaagcccaatctcctgtaaggaggttgtaaaattattctttattgaggggcagtccttcctctgggactctttggccaagcccacggtgccccatgtgtaatggatgtgcagcgccaacctacctggacacaggaattggacatcttcctcatagaatatttaaaaatgatcatgaagctgctgtgtattcacttgaaagggaagttcccttaaggaactgtaaggacagacactgccaccccaggctctccaaggccactctccagggagagggagggtcaattgtgatctttctgagatcccatgagttcttggatagaaaatgctttcccacccttctgcatgccctctgtgtggctgacagttctgggggcccaggaggttgggctgtgcagcttagtgccatgtgtctctagttggtgtcacaccagcatgccaggctgagaacatccctgggggtgagactgtggcagtggccttggccatggacagcagccatctcagacttcctcacaacaccctcatcacatatgcgccccgagcatgcaagcacacatgtgcacctctgtgtgtgtctgcgggggagtgtgaatgtagagtgtgaagtggaagcatgtggaggtgtatgggggcccatgcagcttggtgtgtgtggctgtgagagaaagcttctgtgtaggcaaacctctggttgcatgcagagcacatactagcaaaattaatcatctctttcagttgtgctttgcaatttacaaattccctttactttagctcacgtgatcttcataattcttgtaggaaggaaattattaacatcttcattggaaagatgggaaaactgaggctcagaggagttgtgtgacttgcctgaggtcacacagctgggaaatgacagagtgggaccctgacttcagatcttctaagtccgggttctttgtgtgtggctgtaggagtgtgtatggaggagggtgctctgttgagaagcagtgtggagaggcaggaagggcaagaaagggtatagagaagagaccctaggaatcccgttcccaagttgagtaggcctagttttttgatgcttttgtcttttcattgcatcatcaggccaagtgccaatcttaggtgaacccaccactggctttccccagggtcacaccagggcagtcaggacctccctgaggaagtcacataccagggcagcttagtatcacattgcgttcatgctcaacatccttaaatgggcgtgcagtgctgcctggcaaccccactgtgttttcctggtcagcttgctctctctgatgactacttcgaacttctccactcttctcagtcacccttcctagctcctctctcaccctcagcggatgaccttggctaccacttacttcactgagaaaatagaagcctcagacaagatcttgtccttcttctgggtaccaagccctagaagggaacattcatcttatctaggataaagtctcaacctagaattttcatcttattccctctgcctttttaagatctttctcctgctaattctgtctctccctgctctacagttggtcgctctttctcaagtgaaaccccattgacaatgaaacatgctgaagatgctcttgtcttaaaatacatagccgtaacgacagctaacatatattgagaacttgctatgtatcggtctttgtgctaagataaaaactaaaacatatgtgtctctcaactccacagcacctgccagctcctatagtatctctctgcttccctttacaaagttcctaaaagtgatatgtttatttcactgtttctatttcctcatctctaactcactttctgatccactccaggctgccttcttcccccatcatcaccattcctcctaaatggttctagctaaggccagtggtcaccttcatgttgccgaatccagcaaatattttttttattattcttgatctctcaatagcatttaaaatagttgcccaccaactcttctgttgttgttttttttttttttttgagacggagttttgctcttgttgctcaggctggagtgcagtggcaccatctcagctcactgcaacctccgcctcctgggttcaagcaattctcctgcctcagcctcctgagtagctggattacagatgcgtgccaccatgcgcggctatttttttgttgttgttgtatttttcgtagagacgggttttctccatgttggtcaggctggtcttgagctcccgacctcaggtgatccgcctgtctcggcctcccggagtgctgggattacaggcgtgagccactgcgcccggaccccaccacctcttttttgaactattcgctttcctgacaatcatactctctttgttttcctcctatgtctacccactcctctgtctctttgccagttcattttcttctacttggccatttagtgtcatcactactcaaggctcagtctcaagctttaatcttcttttaaatcataagagtacaatgcaccagcttgaaaaatttttacactggtatgtcttacagtgtagtattttgcatattgcattggtataaaacatttccagtaccccagaaagttccttcaggctgtttcctagtcaatgctaccccataagagttaaccactgttctaacagtatagatcaatttccctcattcttgaacttcttggagtatatgtatcctccatacagtgtatactcttttgtgtctgtttgttttgttttgttttgcttgtgattacgtctgtgagatttagccatgttgttgtgtgtgggagtggttagttcttttttgatgctgtatagtatctcattatatgaatatgccacaattgatccattctactgatgctagacatttgggttgttactagtttttggctcttatctataaagctactatgaacatttttgttcatgttttttggttgatatatgcactcatttctcctgggcacatgactagctatggagctatggttaagtcatagggtatgattctgtttagctttagtggatactgccaaatcagacctttttttctatcttttttttaaactttatattctattcttgggcagtctcatcttcactcatcacttcaattaccatctacacactgacaactgccaaatttatgtctcagcccagctctctcctcttagcatcagctccagtcgccaattttcccacttaacgtctctacttggatgtccctaagactcctcaaaacctgcatgtgcaaaaccaaagtcatcatcttacctcccaaactagttctttacctgtgtgcctgatctagtgagccacccactgttcaccccgtcatgcaaaccagaaatcatccctgacactccatctccctcacctgccttgacaggatctgccaattttgcctcataaacatctccactctaccccctgttccggcccatcccaccactgcatgtctctttgggccacggcaatggctcctcgacaggccttccagcagcccttctatatccttcactctgcagccagagtggtcttttcaaatcaaagctctgatcacttgaacgccttccatggggagtctttcattgtccctcagccagaatcctcaccgtggcctttaaggccctgagtgacctgggtcctccctgcctttacccacctctccagccacacttgccccttctcatctctctccttccaggcctttgcatacactctgttctctctctggaatatcctccctcctccacagcggtaagcgctagtgcgcacgtgcacacacacaaatatatacacacacacaccattacctaattactcctctttatttattttttattttatttatttatttatttatttatttatttatttattatttaatttatttttttgagacagaatctcgttctattgcctgggctggagtgcagtggtgcaatcttagctcactgcaacttccacatccttggttcaagcaagtctcatgcctcagcctcccaagtagctgagattacagtcatgtgtcaccatgcctggctaatttttgtatttttagtagataaggggtttcaccatggtggccaggctggtcttgaactcctggcctcaagtgatccgcccatttcagcctcccaaagtgctgggattacaggcataagccaccgcgcccagcctcctctttattctttagactgtaattcaaacatcatttcctcagagaaagcttccttaattccccagtctggggcaagtccctctgtcattcactctgatagagtcatttttttttttcatagcacttatggtttgcaattagatatttgtttttttcatttttgaattgaggtctgtcttccctgttcgacagtaagctccatgagggcaggtccatgatgtgttctccactgtgtcaatgagtaaatgcaagaatgaagaagcaagggatttggagacagatgacctcattccagcctccagcccacttcttgctctccctaagacttgaataggctggtgtggctcagttttctcacttgtcagatgggaatgaagttactcaaacctgcttatttcactgggttgtgtgaggatcccatgagataacaattgaaaaccatgaagcattacacagacatgaggggtggctggaatgaagaaagggatatagaaaaagtcagaaaccactcagcacacactgctaaagagaaggtctgggtggggggcgctgtatgcttggacagagggttcaggactgagtgcagctctgtgtgtgtgtctgcttgggcacctctccaggggccctctgtgtatgccctttgacactttcctcatcccccaattacttgaacaagatgaagatgggaaagaatgttagaagaataagcatttgtttgaacaagcatacaggcgatggaggagagaggacatgcagttgggtgtgtgtgtgtgttggggtgtgtgcgtgttggggtgtgtgtgtgttggggcgtgtgtgtgtgtgttggggtgtgtgtgtcgccccacaccagggctgcgtgtctgtgtggtaatgtgcaagtgtgcagtgtggtcttggttgctgtgggggaagaggtattcagttgcacccaacttactgtcctttggcactgtctgtgcgtgcacacccttgtctttgctggggctcccaagctggaagctcccgctgccttagctgcttccttctggaaatcaatctacttccccttccaaaacatctgaaggagggggacagtgccctctagtggggacgcatgggcagctgcagcttcctcagcccaagcctcagccccactccacccaagtctggaagtcctctctgaagcacttcctggggaatgcaaaggaggaggcccctgccctctgagagctcaagatctggcaggcaggaaaaagatacacacaggacaggacacacaggttcatgcaggagaagcctgaggacagcagctgaaggtgggggagtctctcctcatctctgcaatgacttatctctggttgccctgggtgttcctggccttccttgcttcctgttcctgcacatggtctcttggtcctgctcttttgctctcggtcattactcatagctgtagggccttgagcagaactggaccctttagtctattccctgggtgggcactaacagcaccctgtggagtcgggaggattcttggaggaggtaacatgtgagtaggatcttgaaaaatgagtaggaattctccagatggagtccagggaaggcacaggactgtggatgagcctcgtgtgtctggggacaggtggtggtggctggatgctggcctgaggtggagggtacattgctttcagcttttttttttttttttttgagacggagtcttgctctgtcccccaggctggagtgcagtggctcagtctcggctcactgcaagctccacctcctgggttcacaccattctcctgcctcagcctcccgagtagctgggaccacaggcgcctgccagcacacctggctaaatttttttggttttttttttttgtatttttagtagagacagggtttcactgtgttagccaggatggtctcgatctcctgacctcttgatctgtccacctcgacctcccaaagtgctgggattacaggcgtgagccaccacgcctggctgctttcagctttgtggggctacaagagaggactaaattttgccaggaggcagtggggagtgagagaaggtctttacttttttgagatggagccttgttctgtcgcccaggctggagtgcagtggtgcgatctcggctcactgcaacctccgcctcccgggttcaagcgattcttctgcctcaacctcccaagcagctggaactacaggtgcgtgccaccatacctggctagagaaggtctttaagcagaagaatggtcagagtcacacaactcgaactaaaggtggggagaaactgcagggaggcagggagaccagttgagaggctgttgtttaggcaaaagaggagggcagtggcagaaagaggaggacagtggctgttgtttaggccagtctgagggcagtggcagaaggatggagaggggctagagctcaagactctgcttctgaggcctctttgtccctggcagcaaagctgaggccaaaggttccacatcactcagttctgctagaacctgacaccctgcctcacatccccaacacactctagggtctctgcaaatggagaagggaagatggtgggagcagggagggagaagagaggaggaggaaggggaacatggcctggggctaggggatgcttaaggaatggggaggcccaagcagacccacctagccccggtctagccccactgctcctcctctggccctgcagagaaagcgttaatctgctatacctccctcccccgcttcccctcctcccctcgggtcaccttcttggccctggagacttggctgatggctcaagttcctcaaccagtggccctgagtaatcagaacacacagaggggccaggggcctgggggcagggaatggtaaattagcggtaggggagcctcagagactgaggccgggagtctgcaaggctgagggttttggtgggaaccccaagttggttcccaatactctctacctgacccaggtccccctgccccacccccagcactgatctcaatttcttccacccaccagagaattcctcgaacaaactaaactgttcggggggcggggggcaggccaaaaagggtagtggtgatctgccaggaagctttcccactgcaggagacagggtccctccccctagtgccgggaactggtcagaaatgagtctgtggtcagtgagagactgctgctaatggaacctgggctggcccacaagccacaggaggggtaggggagaggaaaggaaccaaaatacatctcagcataggtgggtaggacgagggctggtaatgctgtcctgaaatagagctggggccagggagggaggggaagagaaacagggtcggggactggaattggaggtctgagagagtacctggtggtggggcacggaggggctcaggtatcccagaggaataactggacgagggagaataagggagaggacccagaattgggatggggacactgagggatatgctgaggaacagattggaggatgacagagagcatgagtgtgtgttgtgtgtgtcctgggggggtagggactgtggtcgctgtgatcatcatggcagtgggtgcaaaggatggtgctaggtcccgtctcacctgggaggggtgggttccaggaatcccagccctaggcttttccagggtttccactctgtcctaaaccctctctgtgctgccggagctggtgacaggaaaggggctccagccccctgctctccatcagcctccctttcccactgccatcaattattcatcagcccagacacccgccctccctggcagggcaggctggtcctcctcccatgccccgccccagccacactgccacagaggccctggtgaggaaggacggccagctgggctgagatacctggctgacgggctgggtggctggctctgccggactctgcctggagtcacatcgccttcccctctggcaccttcccccttcctcctgcaaatccctggcaccaggaagcccctggagaaaatgcccatccagatcttctgctccatgtcattctcctctggagaggaagccccagggcccttgggagatatttggggtccccaccaccatcagcagcagcaggacatctcagaatcggaagaggaggaagaagagaaggaaaaggaggcagtgaggaaggaggccagtgaggggcattcacccatggacttggtggcctttgccaacagctgcaccctccatggcaccaaccacatttttgtggaggggggtccagggccaaggcaggtgctgtggtcggtggcctttgtcctggcactgggtgccttcctgtgccaggtaggggaccgcgttgcttattacctcagctacccacacgtgacccttctaaacgaagtggccaccacggagctggccttcccggcagtcaccctctgcaacactaatgctgtgcggctgtcccagctcagctaccctgacttgctttatttggcccccatgctgggactggatgaaagtgatgaccccggggtgcccctcgctccaccgggccctgaggccttctctggggagccctttaacctgcaccgcttctacaatcgctcctgccaccggctggaggacatgctgctctattgctcctaccaagggggaccctgcggccctcacaacttctcagtggtgagtggagccccatgcctgccacagtaccccaagagtgtctgccatggctgtccctgactgtcacctcctggggttggggctggggctggggctggggctgatgactgtgctgccccctacctcatctggctgacacaggccagagctcacccaggagtccggggcctggagctgggctggtattcccaggtccacaccagtgctgcttttcctgttagaatcttgaaacacgtctgtcttagttggtattttgctgctgcctcccaacatgtcctccagctttacctgcccttctcaagacttcctcatggtccagcagggcccgggaccttgctccatctgtgaggtcaacctttgatctgttggtggacgccagtgcctggccagttgttcactattttgactagcacccatggactgaagctggggtgggtgctgcctggtctctggtggtacaagagaagggagtgaaagggtgacagtagaggggtggggatatcccccaaccccaccccaccatggcccttgtcagcatctcctgcagcagggacttcattgcatcttcacttggtcttcctgtgccctcctatggacgccccacccccaccagctctgtgtgtgtgtgtgtgtgtgtgtgtgtgtgtgtgtgtgtgtgtgtgtctgagggtaaataacaggtctctaaatcatatccctctccccagctttaagtggccagggaccctcttcctaggggaagctctcactgggaactgtccttctgcttggccccccacccaggggtccagggctttccctgctggggggccacctggtaccccactgtctctcctaagttcatcttccaggtctgtctggcctgactgctctcctgccccaccagctcccagatgccaggccttccctgccccacacacccatccctcagtcctccaccccctccctagcgtaggggcagggggtgtcatcatacccgtgcatcatgggatgactgcaggcatacaggggcctgggggtttgggccactgggcctcaggccaggagccataggaatgtgtctacctctgggcccgagagtagagcagacagttctcacccaggcccaccaggtggcagcagcaatccactgtacagcagccctgtcctctgaaccggcgcaagacagggctgctagccggcctcagacacctctaatcccatacaactccggatggagtgtaggcatgggcatatgtccagcctggagcctgtggctgggtgccgcaagacctggtcatggggctggggactaggagcccttggagttctctctttgcctcatctctggacctcacccacaaagtggggagagcagtatgtctcctcttctggaggtcaatggaggaggctgttctaggaagggggaagggggcaaagaccgtattccctagtaacctactgccattgctgctccagtctggcctgaaactcttttgtctctcccctgctctgggctgtattgactcaccttatgacctgttttgtggactttgtcaccatccagcagtagtaaaagcacagccaccccaacttggggacattcaaggaggctgtggggaaaaggccaaggataactggtttacttttctctttgcagctttttaatcagcactgtgaccagggctgcactggggcatggagtggggagaagactggggagacagcccctggggctgagatatcttctgaggccctcctagttttgcaaaagcattaacgcacacaccatgccctgggggctcagtcccaagtgctggaagaagaggtgctggtgcttggttgagtgtggtccttggcatggcaactgggtctactttcaggttctgctgataatgggataatggaataatgatggacccaaggggctaggggctgaatgaaaccaaaaaactgagtttggctgggcacggtggctcatgcctgtaatcccaacactttgggaggctgaggcaggtggatcacctgaggtcaggagtttgagaccagcctggccaacagggtgaaaccccatctctactaaaaatacaaaaattagccgggtgtgatgttgtgcacttgtaatcccagctacttgggaggctgaggcaggagaatcacttgagcccaggaggcggaagttgcagtgagctgagatcgcaccactgcactccagcctgggcaacagagcaagactccatcccaaaaaaaaaaaactgagtttgggtcttggggaaagcagaatttcagattcccagagtgaaatctaggagaagagaagatatgtcttggagggcctcaggagcttgggcctgaggaaagtgtcccaaggaggggccgtgttaggatcctggtgatgaaaatgtatatgtcagggtcctggcaggaaaaagacagctacttgatgatttaattgaagactttaacaaagggactgctgacagagctgggggcagggttaaggaaaccaataagggggactgaggcagtgagcagtactaggaaatcgttatcacttctaggctgaagaagcacaaaagaagacagtgctctgtagggagccctggcaggatctgtaatcatggagggcctaaggcactactagagctacagaggggcgagggctggggaaggattcataccccaatctttcctcctgccttctgagccattaccaatacctcccaactgtcaaccccaactagaagcccatgcaggtggcaaaggagctcaggcgatgcaccctaccaggaacagttttccagggcacacagagggcaagaaagggtgagaaacaggtgggagaggggagcaaatggagaatgggctgcacgggaggaaccattcccaaagggtgttgagattccaacagctggggtggctaggaacagcccttggtgagtagagggtgctggcaggactcttaggctctccactctgccctcgccaggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactggtacgtcacccacttcaggggcccctctgcatggctctaggccccagcctctgccaggggattcctgggcttcactgtgagacctgggcagggcccgggctttcccctctccctccagcatctcaccatctctatcactgactctacctgacttccacactcacatctctctggctcccacttcctggttcagttactctccaaggtaaccagccatcctcttccatcaacgccgccgccactctataaataactccctctcttctcgggctgcctgcctgtctggtctcggggggccttggggcagagagagatgggggaaaagggaaaaagggagtgggagaaatggagagcatctgaaacagtgacactctgggagaaagtatttgaaacatcaagatgcagagcagaagccaggtaagaaaagaagtgtgtaggatacaggggtcatcggagcagctcagagctggtaaacccagaagggggctagggggtgggctaggaccctatagacttcccccaccccagccccagtgcaccctatgcttatttccaggagaggtaggatgcccccaggtctgaggggtgttagggagtcaggagccctcccaacccacacactcctcattcccctagacgagacgtccttcgaagcaggcatcaaagtgcagatccatagtcaggatgaacctcctttcatcgaccagctgggctttggcgtggccccaggcttccagacctttgtggcctgccaggagcagcgggtgagagggccatgggaggctggtcctggggtggggtattgaggggtccagatggagtggtgggcaatcagtaatgggaaggacaggtgagcaaggacctgggtggtaatctggctagtcagaagcatgagtgatcgaatgaacaagaatgctctgtaaactctgagacctttggaggctgcagagggagaggggagcagaactccagagatctgcatcttgtcagaggagtccatcaagctgatttggggagaagtccccgcactcccccagctccccggctctcccagcagctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggtcaggcctggggctccgagcatactcctggggtccctgggcctttgctgcccttcactagctccccatccatatcaatctcccaaccccagttccagcccaccccatcccacacccacctggctcatgtctctctgacctcagttcccgcctgcacccccagggatgggtgggaagggtctagaaggtatggacctggagtgggtcacttctggggcagcatgggggcctgccagtcctcccttcccatcttctcccagcttacaccttctaggcctttggtactaccaccatcaccagaccccttgaattcccatcctgcatcattgtcttttctcctctgtaggggatgccccatactgtactccagagcagtacaaggagtgtgcagatcctgctctgggtgagcgcccctggcctggggcagtctgggggagggaaaaggtgctgccagccacgtgcgcaggagtttcaggtcacgctcccagaagcctcacataactcctggactgggctgcaccctctcttgtgtctgacattaaagctgagaatggtcagtcatggtggcttacacctgtaatcccagcactttgggaggctgaggtgggcaaattgcttgagcccaggagttcgagaccagcctggtttcatggtgaaaccctgactctatgaaaaattaaaaaaaaattatgtgggcatggtggcatgtgcctctagtcccagctactctggaggctgaggtgggagaattccttgaaccggggaggtgaggttgcagtgagccgagattgcaccactgcactccagcctgggtgacagagcaagaccctgtctgagaataataataataatcaataaagttgagaatagcatcttcagaggcccctatgaaaaatgaacagaggtcacctgggaatggccttcatcttctttcatcagcccctcagctggttgaccctggagggtcctgaggaagtgagatataagagtaagaaatatccatggggaggcttggtgagaattagcacatggtagacacagctgtgagggggcagctggggttctcctcactttcctagttctctccatctacatcgttggttcagtggcctgcagggttcagcaggtaaagtcctcaaacatgcctcaggctggatggtgaggtaggatgttggcagagtttagcatccaggcagggtgaagggcaggtcacggaaagagaaaggggcccagagtttctctgggcagagctaggatgtgcatgtgggaaggtgctggcagaagggcaccactcaactgggacctctcacctggctgagtgcagacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacatagggtaagggctctggctgggtagagcaaggcccttgggttgggactgtggaatggatgagtggggtttgatgggggcgggggctggcaggcagggggaacttgagataacacggggaaggtccaaaaggcaagcaaagagtctagggtgggtatgcagggaagatcaagccagaataagcagggaagcacccctttctcctccctcttcatcctcattgttgtaaccggagtcactttatacttgatgcatactgcatatggtacagaacattttttcatatatgccatctcatttaatcctaaaaggcaggtatctccatcagcatctcattttatggatatggaaactgagattcagagaggctgccttgccaaggtcacctggttagtaagagatagagatatgacttgaacctaggtctcctcccccaatccctgtgcagggagaacatcctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtaagtggtgagggaagggaactgagccttctcttagggcaaagtggaaaagagaaaagacaggcctgtgggcatgagggaggggtaggcatggaagtggagactatttcatatgcccctaaactaagagggttgtggtattttgtaaacgattatttttcttgaaaaacacctgcttgttttagaaaggtagaaaaacgcagaaaagcatagagaagaaaacaaaaattccacctgaatctggctttgcgatccttctgtgcgaaggctaccaatccctttgagaatacaacttgcctgccccagtcccagtaaaccctgctgcccccacgatgtcctgaccccactgacccccctggcgcctgcccccgcaggtgacatcgggggccagatggggctgttcatcggggccagcatcctcacggtgctggagctctttgactacgcctacgaggtaagcgggggcgaggcccggcacggggccacgtgggggcggggtccagcccgcccacctgccccgtccccgtcctaggtcattaagcacaagctgtgccgacgaggaaaatgccagaaggaggccaaaaggagcagtgcggacaagggcgtggccctcagcctggacgacgtcaaaagacacgtgagggagcgagcgagggcgccctccagcccgcctgtgcctccaccgccccaggaaccccgtccacccccgcccacccgcctctgccaccaccttctctcctttgcctcccgaatgccccagcactacctgaagcccttccgagggataacccgtccctgtcctgtccccttcccccagaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatctcctcttcagtgttgttctcttatttgaaaaagtatttagatattctcactaagtgcctaaagctgagcttggtttggggccaattaggggatgagtaaggagaaggtttgagtagggacactgtggtccccctgggatgggacaggctgaccattatatcaggaatagtttgaaccactgggcagggaaagagggagaagtcaaaggcaacaaagttccaaaacagaatccccaatacaaaggatgctttagagagagagagcagagtcaaaattcaagataaactggaacttatcataaaatctggaagcaggctggcacggtggctcatgcccgtaatcccaacactttgggaggctgagacaggtggatcacttgcggccaggagttcgagatcagcctatgcaacatagtgaaacccccatccctattttttttttcttttttgagatggagtctcgctctgtcgcccaggctggagtgcagtggcgcgatctcggctcactgcaagctccgcctcccgggttcacaccattcccctgcctcagcctcccgagtagctgggactacaggcgcccgccaccacgcccggctaatttttttgtgtttttagtagagacggggtttcaccgtgttagccaggatggtctcgatctcctgacctcatgatccacccgcctgggcctcccaagtgctgggattacaggcatgagccaccgtgcccagccccccatccctattttttaatattaaaaaaaaaaaaaatctgaggccaggcacaatggctcacacctgtaatcccagcattttgggaggctgaggagcacagatcgcttgagctcaggagttcgagaccaacctgggcaacatggcgaaaccccatccctaccaaaaatacaaaacagtctggcatggtggtgcatgcctgtggtcccagctacttggtaggctgaggtgggaggatcacttgagcctgggaggcggaggttgcagtgagctgagatggtgccactgcactccagcttgggcgagagagagacagacctcatctcaaaaaaaataaaaaataaaaaataataatccggaagcaggttaggtcagagagaaagttaggatgaagttcccacgtgaggtacttattgaggcactttatctgtggaatgagtcccgggctatgagcaagggtatctggaatcttggcttcggctttatggctaacttgctggttgacctttgccaagtcattcacctgtgagttcagctttcccatttgtaaaatggaataaactgtgtttccctcctcagcccctgatagttatagcagtaagaaaacgaaacgaaaagcagtcaaagcgttttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccggtgagtggggcaggaggaggggcgcgcgggccgggggcggggccgagcggggacatgggagtgac

SEQ ID NO: 17570 - DNA, 29909 bp, Human; identical to SEQ ID NO: 17569

SEQ ID NO: 17571 - DNA, 9968 bp, Human
gtaaacccagttactcgggagggtgaggcaggagaatcgcttgaacccaggaggcggaggttgcagtgagccaagatcgtgccattgcactccagcctgggcaacagagcgagactccgtctcaaagaaaaaaaaaaaagaaagaaagaaagaaaaaagaaaacctcttgccaatatatccttattgccccaactccacaatctcctgggttcccccagcactcatagaagctgataatagggaaaggtaggctgtaaagggcaatggtgatgagctcaggcagcactactgtcttctttacaaaagcacattaatgatgagcctggagaacatattagatgtcaggatggcaaatacagttttggttgtaacatgaccgctgcgcaaaacaaaatacatccatgtaagaggctttcaacctggagtccatgacctctctgaaattagatgcaaaacttggtctctgtgtgcatttttcatggtagagggtccattgcttttgtctgattcataaccttaaaatgtcttaagtaagagggttaagaacccatgacctattcagtacaatgttccctgagtgtaaaaagttcctgtggcatccagcacccccgtgggagtccatcaaaattccagggttcaccgactgcagaactatggggatgcaaatgcatttgcaactctttggaagtaaagtacacacgggaaaccaagaaatactaagagggaaaaagcattttagtttaatgggtacaactgctgaggttttgaggcctccatcaagaaggaaaagagagcccagattgcaggtctgttgcgagtaagtgtgtctgcaggttgtattaggcatgtggtgatggtgatggggggttataggagcttacagtgaacttccatcactcctacccatcattgtctagttattttatcatccattgattcttctcttccggcagctctgaggaccgtagactaaactgaaacacaaaaggggagggcaaaagaaaagacagttccaaagggagccgagcgcccgttctttcatcctgcggtccctttaagagaagaacctcttgggacctgcagtcccaaccgaccccagttttaaccgaaacccaacccggacttccccctcttgactcaaataagaccaactttggattttccctcccctattgaccaatcagattctgttaccaggcagacttcagcggccgccggtacgagcccggcgccttctgtctccgggtggcagcagtgaccaatgacagagcaggccgcccgtgtatctaggcagatcgcggctgttacaaccattcagaaaaaggaaaataaagcaacgcacgagccggctgggccaggaccttggggctgggctggagtgaaggtggctacgaggtagtttctctttctcccttacctttattgttgcttgtgttggaaggcgactgttcagaggtagggaggggcaagatgagttgggaggagagcagaaaaagattgtagctgtattttcaacagcttcttcacccatgtgcacgtgcccggaatctgggaccccattcccctgccgggtttctgacgcccagcgcatgagttccgctaccccgccccacccccgctccactttgcagaaaccggggattgaatggagggggaagggaaggaggtgggggcgcgcctcaggatgggctgttgtgggagatgacgtaggggccggcgacgtggggagggggagcagcgggggaagtcgtggcgagattaagtaatgagaacttgggcccagttttttttccaagcctagaagggcagaatatgttcgtatcctttctgacctcccaggcatatgcaatggtgaggagtatttttgagaattagagaactttgttttgtggctgttattgttgtttttgagggggaggagggcagtatggggtcagaggcagaaatgaaaatttcttgctaacatggattcccaatccccctatctcttcctttacagttttccagatttaggagacttcagaaaggtggggcagatagaatggagatggcaaagatctctttgggcatatatgggcctggcgaagtaatggaataatttctaattttcggagaaggcaagtggtgagaaaaagaccaccggggaaattcggaggctttgtttctgtttctctgcctttctgggtaaagagatgaggagtgccctggggccttctggggaagggaaggccagtgtgagttacatctttatgcctgtccctctcaattctagccctcatgccgggatggcagaagatgagcctgatgctaagagccccaagactgggggaagggcccccccaggtggtgctgaggctggggaacctaccacccttcttcagaggctccgaggtaccatttcgtaagtactcatcacatctccaagtcctgtccaagacctgagtatagatccctgcagcacttcactttggctgtagatgaactgcctctcagcaagggcatgggagcagagggagatttttggccatggtagcaattcttgagcacctgctgggcatttcagtccttttccctccctagcagtcagataaagagacagggaaaatcttgtgtgtgacctccagctttctcctcttccccacagcaaggccgtgcagaacaaagtagaggggatcctggtaagtgtgttggggaagagggcaagagagggatggaaatgctgagggaggaggatgtgaggatgatgggcatcaacaaaacattgatgtgggagaggtagggtcctctgccttgtcagaagatagttggctttgcaaacttgctgccagtttgactttgtgcctctcacttgatctctgtgagcacttgcatagaagcccagcagagatgaagtcagagctgatcccctctacttccctcctctccatggtagcctatagggctcctcagagcacctagcatcaaataatttctttcttttttttttttttttttgagatggagtctcactctgtcgcctaggctggagtgcagtggcgcaatctcggctcactgcaagctccgcctcccaggttcacgccattctcctgcctcagcctcccaagtagctgggactacaggcgcccgtcaccacacccagctaatttttttttgtatttttagtagaaacggggtttcaccatgttagccaggatggtctcgatctcctgaccttgtgatcagcctgccttggccttccaaagtgctgggattgtaggcgtgagccaccgtgcccggccttgtcaaataatttctaaggtcctttttcagtctgacaccctgtaagtcagctagactttggtgtggggatcagagggtcctatattgggtccttcttggccttattatttctcctgcctctgttctctcctacctcagcaagatgtacagaaattttctgacaatgacaagctgtatctctaccttcagctcccctcaggacccaccactggagacaaaaggtaggtttgatagtagttttagatggcagaggttctgattcttagagaaaggttcactgggaaggggtgaggtgaataggaatactcgtaaatgctgtccttgatgaagaggaaaggtcctcgccctgacttggtttaccagggaaagttagattctgggtgaactaaatttggtccagcactactgaagtggtagtttgggaagaaccaggacaactgttagggtcttagtaatgcttgttccttttgtttctgtagctcagagccaagtacactgagcaatgaggagtacatgtatgcctataggtggatccgcaaccacctggaagagcacactgacacctgtctgccaaagcaaagtgtttatgatgcctatcggtgggtggaggggtgggtggtgggatgagtggattggtgggcataggaccccctcacccatgaagagcttcctgccttgataaagcctgccttcttaaagggttcctcacacttgatccctagggactcttcgagcctacccatggcctccttctctgagtatcttcccactctgctcccctctcactcaggaagtactgtgagagtcttgcctgttgccgcccactcagcacagccaactttggcaagatcatcagagagatcttccctgacatcaaagctcgaaggcttggtggccggggccagtccaagtatccttgactagagaggttgggggtggaggacctgggaggaagacttaggatgtggagagcaaggagtggaacagcttaacttgctcgaggggcttggagatcgccatgtgttggctgctctttaacttgcatcagatattgctacagtggcataaggaggaagaccttggtgtctatgccacccctgcctggacttgacctaaagggttctgagagtgtaagtaccaaatcaccttccaattccactcttctctcccaggtaaaagtcagaggtctttggggcatgttttgagggctaacagcctcagtcattatgtacatagcttctaggtatgatgttcccttctgccaaccctgtagctgaggcagaggatgaagagaacttgtgggcttctgcaatgggataggtagaggctactcccatccccagtctggtctcagctttggtcaatagtctttgatctctgacaagagaggaggcaagggttctttaatttggagtgtgattgggcatgtccttccccacttcagccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctggtgtgttgaccctctcttatgtctcagcaaccctgagccactttcagcttcagtggccctcccacacactagaatagagacaccttggatttgccccctcttcctggagacccttctaagacatgctttagcaccccatttcctgtctctaccagtcagtcaatcagaattgcctcactcccctattcctcagtttcctcctcaccttcactctattacctttttggtacctctgcagaagaggacgaacatgcacctcgggaacggtcatctaaaccaaagaatggtttagagaacccagagggtggagcccacaagaagccagagagactggcccaggtaaggaagtcagtggccctgactttgctgtcctgggctgggggcttagtatatccttctccaattgggtcccttgcttttccacctcctgtgcctctggcgtctatgtttcccccaatactcattcttcacaccttactgtgttcctctctttactttttagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatatataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaataccattgtgtttgtgttcctccctagcctgtcccccgcctcttcttagcggtaaccactgtccttaattttcgtgtctattatctgctatagatattttttaaccatatatgtatatataattttaaaaatgtgtttaattttgcttgttttttagctttacagaaaatgttatactttttttttttttttttgagacacagtctcactctattgtgaaggctgtagtgcagtggtgtgatctcagctcactgcaacctccacttcctgggctcaagcaatcctcccacctcaccctccctagtagctgggactacaggtgcctgccaccatgcctgaagttttgtatttttagtagagatggggtttcaccatgttgcccaggctggtcttgaactcctgggctcaagccatctgcccaccttgggctcccaaagcgctgggattacaggcatgagccacctgtgcccagctatgttatactctaatagtcccctgcagtttgctttttctcacttaccattgtttctaagattcatccatgctgttgtagatagctatgattcattcattttcatctgcataatattttatcaagttcataaaccacaagttatttatccattcacctatcaatggatctttggatattttcagtattttgctatttcaaactgctgctatgaacattcttgtacatgttagtgcctttgttttcagtaagatttctaaagaggcttctaccatggtcctttggtttatataacctctaagttgggaactgttccctcttgtcttattctctggaagagtttatatcagattgaaacaaactgttccttgaaagtttggtaaaactcacctgtaaagctatctgagattgatgtttctttgtgggaataattttaactattgattccatttctttaataattatagactgggctttctattcttcttgagtcagcttaggtaaagtattattctagggttttgtgcatttcatgtattttttttaacacaaaatgcatatatttcttctagtttctttttttttttttttctttgagacagagtctcgctctgtctcccaggctggagtgcagtggcgtgatctcggctcactgcaagctctgcctcctgggttttacgccattctcctgcctcagcctcccgagtagctgggactacaggcatgcaccacgtacacctggctaatttttttttgtatttttagtagagatggggtttcaccgtgtcagccaggatggtctcgaactcctgaccttgtgatccgcccgcctcagccttccaaagtgctgggattacaggcgtgagccaccgtgcccggctcttctttttttttttttttttttttttgagacagagtcccgctctgtcgcccaggctggagggcagtggcgcagtcttggctcactgtaacctctgccttccgggttcaagcgattctcctgcctcagcctccggagtagctgggattacaggtgtgtgctaccacggccagctaattcttgtattttcagtagagaggtggtttcaccatgttggtcaggctggtctcaaactcctgatctcaagtgatcagcctgcctttgcctctcaaagtgcttggattacaggcgtgagccactgctcctggccttgtttcttttttatctctgctctgtggataggcatatcttccttttcatttctgttgtttacttgtgcctccttttttggtcttgatcagttgcaccagcaatttattttacctatatatcttcagatgctactttgagctttgttgatcctctcccttatgtatttgttttccatttcattaattatggatcttatctatagctatcttttttatgctttctttaggtttaattttatgttcctttacaacatattcattttgacacttagccaattaattttcaggctatcttcttcactattttaagtttttaataacctgtttctctacatcccacaag

SEQ ID NO: 17572 - DNA, 113186 bp, Human
aaacgtgcagggtctatttataagaagaggtagctatgcggtcaagttcagggtgggttcggtggaatcagaccaaccagcagctcaagcagagtttaacgctgcaaatctgtgccacgttcttcttcctgcgtgcaatttgcaggcaaggacatctgcttaattgggtgtgaaacccgggccttgattaaaaggactttatgaggccgcagccttgcatttccaaggtcaggccctagtggagagggcgcgcgttccgcggggagacacgaacttttcctgagtgcgcgttccttgctggccctgaacccctcggccaggcagggcttggcagggccgtttcctgtcctaaccaggatcaagggattgcgcggcttgctggtgaagcttggcagggccgtgacctgtcctaaccaggctcaggggatggcaggggcctgctggtgtcgcatatgttttgcattccagctcaggattttgcagagcatagggagcgggtgtcacccccggggggaaatgccacccacaaaatgcaggtggaggctgggcgaggctggcagccaggggccagaaatccaaagcctgagccaggttcagacttcctgactccccctccccgttagctgtggaaggatggctcggcctggtccccctaaaaatgtgtccgttctgacttagaggccgctttggctctcagaaagcccccctgacctgcggactgagggactggagaccccctccaatcgcagaatcgctgagatccctcaaaacaaaggcgtttgcagtttgaccccttgctgctcaaactgtggtcggcgaaccggcagcctgggccgccctggtcgcgggtcaggggcgcagcgtccaggccgtgccaggcccgcaagttaagcactgtctgcatttccctggggaaaggggtgaccaaatatctagctatatttgcatttcaaatccacacggatatgggttttaaatataagtatgtccaactattgcctgagccacacttaagccaggaaaaaaaaatctttggggtttctgaaattgaaatgcctctgcacaattctttatagggttgtcgccggggtgtttgaaacagtgaccaatcaagtttcacgcactacatttggtcgggcgatctctcaaatctgtctttccctagttttttaaaggaatgtttatttgtaaagaattctagatccacaggaagctgcaaagaaacgcacagggtcgagcccgcccttccccgccccttccaagtagaaatctagaatcaccagagtcctacagcaaaaccaggacgctgaactcatcccgaagacccggcagcccctcttggggatccgccctcattccaaattctctcaggtcccaaacaagcacccgcaggagtactgaactttttggggggagggcagaggggatctgtatgcagattgccagctgagcaatcctattttctatgacttaaagccaatcagaggctgggcgtggtggcttatacctgtagtcccagcactttgggagaacgaggcaggcggttcacttgtgctcaggagttccagaccagcctggccaacatggtgaaaccctgtctctactgagaaaatacaaaaattagccgggctaatccgagcccctctcttcaccaaacgccagtttcactttttagttttgaacttcacttctgctgagctacgccctccctgtccccgggccccctcgcctccccatcttccgggcttgggtgcagcgacgcgggtggcccgccagtgcgtccccgaggagaagtcagcctgggtcccaccccaggggtgccccgggcgcggagggggcgtgggcacctccccagcgccgcacgcccgggtctccggctcctgggctgggtcggggcgggggcggagcgcgcgcgaaggcgacgcccccagccccgcggccgggttagggcggggagaggcgcggtcacgcccaggcggcttccgcccgccccaacagcgcgcacgcggctaccgagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggtgagtgagtgcgggcggggactcggcccacaggggcgcgcggcgtggccgggacgttgtagtaggacaaagggccctgggtgccgacctcctggggagggccctgacccgctacttcggctcggagtccccgtgcggggctgcacctgcgccccgggtcttcccgggtggagcgcactccccagccccccagcccaggcaagtacccccgaccggccgggtgcctaacctgaaatgccgacggctcctctcggagaccaccctccacccccagcacacacagcactctggggcctgggccgtccgacgtcacaaaacctcctgcgggtcacctcgcctgggggacctcgtgctccctccctggcagcggccccagggacactggcgcggggtgcgaagacccctgcaggcctcccctaggccagcctccctgtgtgcccagaggcagggaatgtacagatttctccaggggctgcaggagcagctgggctgtgggggacaggtgtcccggggcgctgtggggacgaggacggcagcgctggggacggatcctaacatgtcctgacaccgcctgtgctcttcgtcttgtgcctctgaaatgggtaattcttgtatcggacgctttatccgtttcctttgtcctctgtctttgaacttaaccccgaatgggcagcttgacagagaggtttcgagttctcggtgctcttgcatccggacacgcgctgctttatggagcagccctgagtgggtcagaatatcccaactgaacgtgggcgctggatttaaacagttgtcatcggcccgcctgtgccacttagggactccgtatggctaagtggggtgttggctgtcaagaaaataaatgggagagtagagggggctgtcctgggtgtgttggtgaggcgtcggctctcaggccctctaactcctgtttgtcctcattttggaaaggaggaagctgggctgggaagcccaagggctcgaggccatagcttatgacttaggaagaccagcgggcatagccagtggggcctttagaaccgctgaggaagaggggacttagcttccttcagtgacctctttgccacttagaccttgaggaagggcccacgaggaaagcctgaatttggaaggacagagtgggaggaggccctctctctttctcctctccctccctcctcctctttatctcattctctctctcttttctctgtttctcttctctctccctctttctgtctctgttcaagtctctctgcatttctcctcctctgtctcttggtgtctctctccctgtccccttccggtcttggtttttctgtctccctccctcctctctctctgccttcccccttgtcttggtccccccggaaagctgtcctggtctaatcttagagctgggtgtgttttgcgcggaagaagggtggggcaggaaccctgactggcgcagccgccacagtaggtggaaatacaactcgacaatggaaaattgatgaggtccagccgttccttggcactcagcaccagcgtttgtcattctttggggcacccacatgggtcccttgggaaaggtggagctggggctggaggccggggcagagagcaggatgcgggcaggagggcggcagaggtgaggggttctggtgtcacagggggccactcagtttgacgtcaagtcagcttagggtgcccagcgggtaacctcatctttaaaaatagagtgtcgctgcctctggggaccaagctggctgggcggggagtcagctttttttttcagtccagtcagtgctctcttaatgaggatgaggatgatgctcctttctcaaggataacttcctgtgagctccaacgatgtgacaggagggctaggtatcccacactcattggacagcaggggaccaggacccaggggtgtgtgtgtgtatgtttgcatgcacgtctggaacactctctcatgacaactgcacagctttggtgacattatctgcaaccttttatccaagcccgtttctttattgttggttaaagagcaatctgagtgtgattcacctaaaataatacattttataaaatcctaagccttttagatccttcacgattgtgtctctaagccacaatctacagcagctttggactgttttccaaggcgtgatggagaatagtgaggggtgagcttgagtctcagtctggagttgaaacccagtctgggtgggtgtgacctctcttcatcctaaactgtcactacaggaacataagtttgcttttaagtgctctttcgccctcattccgaattctctcaggccccaaacaagcacccgcaggagtactgaactttttggggggtgggcagaggggatctgtatgcagattgccagctgagcaatcctattttctatgacttaaagccaatcacaggctgggcgtggtggctcatacctgtagtcccagcactttgggaggccgaggcaggcggatcacttgtgctcaggagttccagaccagcctggccaacatggtgaaaccctgtctctactgagaaaatacaaaaattagccgggcgtggtggcgggcgcctgtaatcccagcttctcaggaggctgaggcagaggaattgcttgcacccaggaggcagaggttgcagtaagccaagatcacaccactgcgctccagcctgggcgacagagagaaaaagaaacttgtcagcgttctagattgaccagttttcctcaaggtcaggtagttaggaagaaagagtgcagtttgcagttgtgaaaagtctgataatggattctttttttcttttttatgcgtgaagggattctggagtacgtctggtctaaaggccgatttcgttttaggaactttggatcagaacagtcatactagtcctcagagaaaaaatggttttcaatctggttcttcaaatttcttgttcatataaccaagccatgcttgttcctatgatggagaacaattgtgctttaaaaaaagaaatttcagggccaggtacagtggtgcgtgcctgtagtcccagctatttgggaggtcgcggtgggaggatgacttgaggccgggagttccagaccagcctgggcaatatagtgagaccctcatctcttaaaaaaaatagtagtaatagttagctgggcatggtggcgcatacctgagttacctgggaagctgaggcaagaggatcacttgagcccaggaggtcaaggctgcagtcaaccacaatcgcgccaccgtactccagcctgggtgatagagcgagatcctctctataaaaaataaaataagaaaatgatattatggaaatgaaaaactcaccctatgtagagagaagaggatgaatctgtgcagccatctaccagccttattttaccaatttcctacttaaaatgaccacttgagaattcctttctctatatatcagataaaaaatacttgggttttttcccagaagtgtccttatggaatcatttggcatctacaacccagtgcttgcttgtcatgggtaccccaagtgttaacctgtcaggaaggaggtaattcaacaggtaaaccagtggccaggccttgggtccacatttcattttccttttctcagcctagttctgcatttactcatctacagagggaaataatgacggaacctgtcctacacgatgacgatgaggaagactccaaagttcctagacccctattaaaaatatatattttttgaaatacagactcacaggggatttcaaaaacagtacctggagtctcatggacccttcagccaacttccccatggtgacgtcttcatatccgtgggacaatatcagaaccatgtcatcgatgttggtatatccttattaaagagaacacatacctcgttcagcttttttttttttttttttttgagacagggtctcactctgttgcccagtctggagtgcagtggtgcgatctcggctcactccagccttgaactcctgggctcaagcaatcctcctgccttggcctcccaaagtgctgggactatatacaggcatgagccatcgtgcccggcttgttcaggctttattagttttcaaaaggtgctcatttgtgtttgcgagtgtgtgtgtagagttctgtgcagttttacccagtgtgtggatttggcagctaccaccctccaaaccatggtgcaggatgaattccctcaccacagaacacccctcggtcttgctcgacactttttttttttttttgagacagagtttcactcttgttgcccagcctggagtgtattgaccacaacctctgcttcccgggttcaagcgattctcctgcctcagcctcccgaggagctgggattacaggcatgtgccaccatgcctggctaattttatatttttagtagagatggggtttctccatgttgattaggctggtctcaaactcctgacctcaggcgatccgcccgccttggcctcccaaagaggtgggattgcaggtgtgagccaccgtgcctggccagacactttttttttttttaaactttcacacactatacaatctgaaaatattttattttcttaagagctaggagatcttcataattaatgatacatggttctcagatctaaagtgcttatactggtaggttttctcttgtccttggttctcctgaattggccagaatttcctttcctctccttgttgctgggttcttattaatgcctcaagttagtcggttcaggcagttgtagcaaaacaccaccgactgggtggcttataaaccacagacatttattcacagttcagaggctggaggtccaagatgaaggcatggcagatttggtgtctggtggggacctgcttcctggttcatagatggtgccttctcgctgtgtcctcacatggtggaaggggtgagggagctctctggggcccctttataagggcagtgatcccattcatgaggctccaacctcacgacctcatcacctccctagggcctcacctcctgacaccattaccttgcaggtgaggatttcaacacaggaattttagggggacacagacattgagtccacggcatccccaccctgtctgtcacacagcatgctgccgggacgaatggcatctgaactggtgagattctactgtgtgcataaatcagcagccttgtgggcagtgttgacatagcaattaggagtgttgtttgtagcctaacaatacacagaaagtggagctcagccctttgatcttatttaccttatgtgggtgctccgtgtgagacaggctcatgcatgtgtgaatgacagtttcctttaagtgcatcacgcaaatgccaagagatgagatcaaatattacacatcagagaacatttccaaggatagaagtcctgccggtttctcctcttcattgtttatttcattttatttttttaatttaagttaaaatacatgttaaattaaatttaagttaaattaagatacatgtgcaggacttattttaaataaaagagacagggtctcgctgtgttgcccaggctagacttgaacccctgggctcaagcattctgcctgcctccgctgctggcacataaatgccaagtgtgcagggacctctgtgtgttggagccactttcatctcccacatccaaagaacagacccggcacttagtgtgtgcccaagaccatccaccgcatgaatagagaaatcaaccctcctcatgtgcctggggtttcctgaggtgggaaaccttcagtgctagctgggaaagtcgcaggcagagacagggacaagctggtcactctgtgtgtgaataaataaatgaatggatgatggcattatcggcagttgttctttatgacactcactgatgccaagtactggacgggtacaatatgtacattagtttctctatgggcagaagctccaccatgacaacattagtgttattttctttttgcttttttgtttagagacagggtcttactctgtcgcccaggctggggtgccgtggtgcaatcaacagctcactgcagcctcgacctcccaggctcaagcaatcttcccacctcagtctcccaagtagctgggactgcagacgtgcaccaccacactcagctaatttatgtatttatttttgtagagatgggcattgctatgttgcccaggctggtctcgagctcctgggctcaagtgatcctcccgcctcagcctcccacgtagctgggactacaggtgcatccaccatgcttgtagccttattttcttaatgggaaagagggtctgagagaagggatgctgtgtgcccaatgggtttcgcctgcagcacgctgcctcctccccgggaaagcagggcgtgcacattgggattggacgacaaaagcagagtcatctacagttcatgggcacgctgcaaagaagggagacgttaaactctcgaaagcagcagacaccccccaccaggaagagacatacttgtaaaaatcaaaggagggcgaaggcatgagaatcgcttgagcccaggaggttgaggttgcagtgggctgagatcgtgctactgcattccagcctgggtgacagagaccttgtctcaaaaaataaaaattcaagggaggccaggtgtggaggctcacgcctgtacccagcactttgggactctgaggtgggaggatcacttgagcccaagagctcaagatctgtctggacaatatagcactaccccatcgctacaaaaaaaaatttttttaagtagctgggtgtgatggaatgcacctgtagtcccagctactagggaggctgaggcaggaggattgcttgagcccaggaggtggagactgcactgagccatgatggtgccactgtgttccagcctgggcaacagagcaagaccctatgtcaaaaataaagaaagtatcaagggagatgagtacacagtgcctggcacactgtagggtctccaaaaagtaaaccttttctatccatcagtttcctcttctctccagcatgaaatcgcatatgtaaagttgaaaaaaagagtgagagatatatcttaaaaaggtagtaatgttgatgacattgtggttttttttttttttttaaagaaaaaccggccgggtgcggtggctcatgcctgtaatcccagcactttgggaggctgaggcaggcgggtcatgaagtgtcaggagatcgagaccatcctggctaacacggtgaaaccccgtctctactaaaaatacaaaaaaaaattagccgggtgtggtggcgggcgcctgttagtcccagctgctggggaggctgaggcagcggaatggcatgaacccgggaggtggagcttgcagtgagccgagatcacaccactgcactccagcctgggcgacagagcaagactctgtctcaaaaaaaaaaaaagaaaagaaaaaccttgggggaaatacagaggaagccctaaggcatcccttccaaaaagctgaaagtgctttacttagaattgtgacctcgttttccctgttagaaaagtctgtggttagaagcttcctggtaagcccagtgtgagaaggtggaaccgatgtttctgtgtgacgggttccctctgcctgtttctccaggtggcctccccgtggtcctctactgtggtgggtccagtcccaaaaccaagtctggggccaccatcatcatatttgtgtcccccaccccaagattcttatgtcaaaaccctaatccccaaggtaatggtgttaggaggtggggcttttaggaggtgatggggtcactagggtggggtctcatgaatgggatcaatgtccttataaaagggaccccagagagctccctcaccccttccactatatgaggacacagtgagatggcaccgtctgttaattagaaagccggtccccaccaaactctgaatctcccataccttcatcttggacttgtagcctccaggactgacagcggtaaatgtctgttgtttctaagccccagtctgccgtgttttgtgatggcagccgaaatggatttagatggggctctattcaccccacgcggcagggtccatggaaaggcagctgcaatgcgctggtctatcattacctcttttatgctctttcacactgtcttagtcttgcgtggctgctggaatgaaggaccgcaaatatagtagcttaaaaccacatacagtgaagagatacctgcactcccaggttcactgcagcacgagtcacacaacagccaagatagggcaacaacccacttgcccgtcagcagatgactgggtgaagaaaatgtggtctctacacaatggagtactattcagcctgtaaaaagaataaagtcctgtcatttgcaacaatgtggatgcaactggaggtcattatgctctgagaaatgagccaggcacagagagacaaatacggcattatctcactccttttttttttggacagggtctcactcggacacccaggctggagtgcagtgacgtggtgtcactgcagcattgacgtcccaggctcaagggatcctctcacctcagcctcctgaggagctgggactgcaggtgtgcatcaccacgccaggctattgttttgatttttttttggtagagatagtctcgtcatgttgcccaggctggtcttgaactcttggcctcgagtgatcctcccagtttagcctcccaaagtgctgggattacaggcgtgagccaccacgccctgcctgacctatgtactttagaatcccagaagcaaatcttgtatcctactggaggagcaagacagaaacacaggtgctagagggcagattgtttgcacagaaacctgggcatgtggatgaatttggtaatacgtgtgtgcgggtaaacttggcaggcccctttttttccagggttcccttgtgcaagaagaatgaaactaatgcaaccaatactttcaagaagctcctcctttctggagcgttttcacgctgcatttcttgggtgggcatgttttcccggcgtctccgattctgtgctgtgttgggtgagacaggatgatggacattttgcttccccattaggatcttaagtgaaagtccagttggcatttgcatttgatctgagtaggagaaaacatgataaatagccattagaggccgggtgtgggggctcacacctgtaattccagcaatttgggggccgaggtgggcagatcacttgagatcaggagttcgaaaccagccttgccaacatgacgaaaccccgtttgtacccaaaaatacaaaaattagctgggcaccgtagtgggtgcctgtcatcccagctactcaggaggctgaggcaggagaatcacttgaacccgggagatagaggttgcagtgagccgagtctgtgccactgcactccaacctggggtgatagagtgagactccatctcaaaaaaaaaaaaaaaaaaacaaccaaaaaaacccaaaaacacattagatgcatttgaagcctcccagcaattctcccatgatggcagaataggcatccaggagactcaccctaccctgtctgaacacctttagcgaagatgtaaatgatctgcagaggatactcaggtgcgaggatggaaattccttctccctccagcactgatggcttccaccttcctgtggtctaaggagaccacacagaggttgtcagtgtgggaggctgttgccagtatggtgagtttcctatggaggaatttcctgtgggacacctctgggcagttcttccagcctttcatgtcttctgtcagatgatacagtggccaggtcaagggattatcatgattttatttgttttgttttttagagacaaggtgttgctctgtcgcccaggctggagtgcagtaggggtgcaatcaatagctcagctgcagcctcaaactacagggctcaagtgatcctcctgcctcagtctcccaagtagctgggactacagggacacaccaccatgcccagctcattctctcataaggtggagagaagagaagagaggaggacataaaactgtccatatgactagtttgggcctttccatcctgcttaatccagaactgtcaaggttagaccctggtcattctttaatatgtttgaaaaatacggctgggctttggctcacacgtgtaatcccagcactttggaaggccagggtgagaggatcacttgagtccagacgtttgagaccagcctgggcaacataagaagaccccactgctacaaagggggaaaacaagtcagccacgcatggggacgcatgcctgtggtcccagctattcggggggctgagacgggaggattgcttgagctcgggaggtagaggcttcagtgagctgcgattgtgctactgcactctagcttgtgtgacagagtgagaccctgcctcaattaaaaaaaaaaaaaagaaaaatagaccttccttctatacaatgtcttccctgctggcctccatgccctcgtacctgtttaaaaatccactggaatttttcaccaggacatagaaaaaggaagttgtctcacgcagttcctgttaaattgcacaagtccacacagatccttgcaacccacgctaccatttacttagcatgcgttgtgtgtgggcattacattattctccgaggtagttattttggatgttatactggggaggtaccccatcaaagagatttggagggcagcctgtggagggttcttttaaaatcgttgacaactaatttggtggatgttttcaccttggtgaatcattcccttgggagtcattttgcagaacaaaagggttgcacacaggtgtggccagagaaaccttggcacagaagaaagaagtgctttgtcatgcttagggcacctgggatctctttggatgggcaggcagagggggaccctgtgaagcctgcctgcgtttatttgggtatgcatgcttatgttggagtcttggcaatgagaggacaagagtggagggaacagagctgttaacagaaaggggtccatatccagacaccaagagagggttcttggatcttgtgcaagaaaaaattcaaggcaaatccatagagtaaagtgaaagcaagtttattgagaaagtagaggaataaaagaatggctcctccatagacagagtggcctcgagggctgctggttgcccatttttatggctatttcttgattatatggtaaacgaaaggtgaattattcgtgcctcccctttttagaccaaatagggtaacttcctgacgttgccgtggcatttgtaaactgtcatggcgctgatgggagtgtagcagtgaggacaaccagaggtcactcttgtcaccatcttggtttgggtgggatttggccagcttctttaccgcaacctgttttatcagcaagctccttatgaccggcatcttgtgctgacctcctatctcatcccgtgacttagaatgccttaaccatctgggcatgcagcccaacaggcttcagcttcattttacccagctcctcttcaagatggagttgctctggttcagatgccgctgacagaactagcttatggttggagacaatgtcatagggaattattcttcaaagatcgcaaaatccagcttggatgagattccaaaaatcaaaaggtgctgagaaagcaacttgtctagaatttcctcttcatgggctggttgattttgtttacaatgacaccttcagaaaaagtaggcgacacacagtggctcacgcctataatcctagtgctttgggaggtcaaggagggagaatcatttgaggctagcagttctagactagcctggacaacatagtgagaccttgtctttacaaaaaataaaatcagccgtgtgtggtggcgcatacctataatcccagctgttcaggaggctgaggcaggaggatcatttgagcccaggagttggaggctgcagtgagctatgatggcgccactgcactccagccttagtgacagagcaacattctgaaagaaaagaaagaaaagaaaaaaagaaaaggaaataaaagatgaagaaagaaaacagaagaaaaaaataatttatatagaaaaaaagtccataatgactcaaaatattccctggacactggaatagaatgattttgtttattaaagcttttctttagttcgtccttaaacagtttagtattttcttttgaaaacagattgtgtcttgtcaacttcattgattttcgggctgggcttggtggctgaacacctgtaatcccccaacactttgggaggttgaggtgggtggagcgcttgaggccaggggttcgagactagcctctagcctcggcaacatggtgaaaacctgtctctacaaacaacaacaacaacaacaacaaacaattagctgggcgtggtggcacgtgcctgtagtcccagcaacttgggaggccgaggtgggaggatcacttgagcccaagaggtcgaggtcgaagtgagctatgattgcaccattgtactccagcctgggtgacagagtgagaccatgaaagaaaagaaagaaaagaaaaaagagaaagaagaaggaaaaaaaaagagaagaaaaaagtaaaagaaaaacatagaaaaaaaatcagtaacgactcaaaatattccctggatagttgaatacaaatagttgttgttggacgtgattttatgtattaaggcttttgtttagtttatccttaaataggttaggattttattttgagaatagattctggtttatcaatttcatcagtctttgcaaagaaacagcttagggtttcctttatgtttctccgttaacttcctgttttcagttacattgcgttttgctctggtttttctttcgttttttccactcgttttaggtttctggaatttcctgaaacattgtattttgatacagattctgagctggtgctttggctgtcacaagccagagggtcctagaagaagtagaattgtaaccgaggaaaactgttaggaaactccatcccttttgaccttcaaaggtcaccgcctaattttggtgttttgtagtctgatgtgttcatagcttgtgactattaggctctgattgagctctgcttttttttaagtttctcttactcagctggtgctgttttagctccagcttcctcctctgtgtaatcaacactcccagtctcctcttcacccaaaaagccacagaaataagtgcagaaaacaaggcagccgccacctgctacagaggcatgtccttaaatacgatgcatttcaggacagctgtgtgagttccgggagcttgtcttccttcaaagggaaaagtaaaaataaacaggaaggttgcactgaaagcattctcaattgaaattgtgccatttggctgtagtgtttctgatgctcatttagaactttggaagttgtgggatggtgggcaagtgtgtgacctgggatggagattctctacctctttaagagtgaaaccctggctgggcgccgtggctcactcctgtcatcccagcactttgggaggccaaggcgggtggatcacctgaggtcaggagtttgagaccatcctggccataatggtgaaaccccgtctctactaaaaatacaaaaaaatagctgggcgtggtggcaggtgcttgtaatcccagctacttgggaggctgacgtgagagaatcacttgaacccggcaggcggtggttgcagtgagctgagattgtgccactgcactccagcctgggtgacagagtgagactccacctcaaaaaaagaaaagaaaaagaaaaactttaaaaaatgccgggcacggtggctcccgcctgtaatcccagcactttgggaggctgaggtgggtggattgcctgagcttaggagtttgagaccagcctgggcaacatggtgaaaccccgtctctcctaaaatgcaaaaaattagccgggcgtagtggtgcacgcctgtagtcccagctgcttgggaagctgaggcaggagaattgcttgaacctgggaggcagagattgcagtgaaccgagatggtgccgctgtactccagcctgggcgacagagtgacactctgtctcaaaaaaaaaaataaaataaaaattagctgggcgtggtggcacacatctgtgacagagcgagactccatctcaaaaaaaaaaaaaaaagaattttggaagttgtgggatggtgggcgagtgtgtggtctgggatagattctccacctctctaaaagtgaaaacctggttgggtggggtggctcacatctgtaatcccagcactttgggaagctgaggtgggcggatcacttgaagtcaggagtttgagaccagcctggccaacatggtgaaactctgtctctaccaaaactacaaaaattagccgggtgtgtggtggcgggcatctgtaatcccagctactcgggaggctgagacacgaaaatcgcttcaacccggaaggcggaggttgcagtgagccgagatcacaccactgtgtatgccactgcactccagcctgagcggcagtgagaccctgtctcaaaaaatacacacacacacaaaaacaaaaaacaaaacacatgtagaaaaaaccacaaagacaaaaacaaaacaacaacaacaacaacaaaaagtgaaaacctacttctttttctggacacggtggctcatgcctgtaattgcaccattttgggaggccgaggtgggaggatcactctcacctttcaaggcccaggagttcgagaccagcctgggcaacacagcaaaaccccatctctctaaaaataaaaaagagaaaaagagaaaaattgcttctttctatgtagttggtgagttttttcagtaggatgctttgcatttcttcctgcgtctgtggctctgtggtatgccagcatatacgatagtcactacaagatccgtagttgtacacccagccatacgcatcacaggtttttggctgatttcatgacaacgcttaaggctgctgaaaacactctaattctttggatgttggcaaatgttcagatgaaactaagcggctggcccacccacctgctcaggaaagaatggccgcattgtgtgggaaaggaatcctctgttccctagctggctgcctggtgttcttgttgagtgagcagaacagagagtgcccctgggtagacctgtgtgtgctccaaaaggcgattttgtcaattgttcccttgggatgcccttgttccagaaagcatgttctgtgtgactctcagctggggttcccagactgtgtaaagaaaacatggtgattcatggctgtgtgcggttgcccatgcctgtcatcccagcattttgcgcggccgaggcgggaggactgcttgagcctgggaggtcaacgccagcctaggcaacacagtaagaacctgtctctacaaaaacaaaacaaaaaaagtgtagccgggcatggcgacgagcacctgtggtcccagctactcaggaggctgacgcaggacgatcgcctgagcctggaagttggaactgcagtgagccataatcacaccactctactccagcctgggtgacagagtgagaccgcatcttaaaaaaaaaagaaaaaaaaaaggacattgtgattaatgaaaacaaacattgcctggtgataaggaaagtaagaagtaggattgttctcagattagtgacccaggagataaaggagtaacagagtgtgcaggaagcaggtctccaatttaatagcaggatggtgaagatagagcaagtgacttctttctattttttttagaaactgggtgttgctttgtcacccaggctggagtgcagtggcgtaatcatagctgactgcagccttcacctcctgggctcaagcagtcctcgtgccgcaccttcccgagtagctgagactacaggcacataccaccatacttggttaattttttgtatttttagtagacatgggggtgtggggatggtttgccgtattatccaagctggtctcagacttctggcctcaaataatcctcctgcctcggcctcccaaagtgttgggattacaggcatgagccactgtgcctggtgagtaggtagctttttgtttgtctgtttgtttgttctgtttgtttgtttttgagacagtctcgctctgtcgcccaggctggagtgcagtgatgcaatcttggctcaccccaacctccacctcccgggttcaagtgattctcgtgcctcagcctctcaagtaggtgggattacaggcacatgccaccatgcttggctattttttgtttttttagtagggacagagttttgccttgttggccaggctggtctcaaactcctgacctcaagtgatccgcctccctcggcctcccaaagagctgggattacagttgtgagccaccgtgtccagccaaacaaaaaaaagtctgtcttataaagaagatccctaatttatgatgattccatttatgatggtttgagttatggtagtttgagttaggatagttcgattgaagattttttgattttacgatggtgagaaagacacagtccgtggaacccgggcttcgagtacccatgcaactgttctgtttttaacttgcagtgcagtattcagtaaattacatgaggcattcaatacttgattgtaaactaggcttcacgttaggtgattttgcccagttgtaggctaatgtaaatgttgcgagcacgtttagggcaggctgggctaagctgtgatgttcgtaagttaggtgtattcgatgcatttttgacttaccatattttcaacttacaaagggtttatggggtgtaatgtcatcattgtaagttgaggagtgtctgtatcatagactggggggcttaaacagacatttattgctcccagttctggaggctgggagtcacagatcaaggcgtggcacattcggtgtctggtgagggcttcctggttcatagacggcgccttctcactgtgtcctcacatggtggaaagggtgagggagctctctagggtccctttaataaggacattgatcccattcatgaggctccaccctcatgacctcaacacctcccaaaggccccacctgctaacatcatcatcttggggatgaggattcaacacgggaattttgggaggatgcaagctttcaccagtagggttttctttgtaaagaaatagaaggaaatgaaaaggcaggcactgggtaggagagagctacagaagacagcggggtggtggcactccaggatagtgctgtcccccagcatcatttacaccgaagaaacctgaggcagtctttctgatgtgtcattcttaggaaaaccaccatgaatctggcatctagctatcagtgaaactgtgggagagcttaatggaagtaaagacatgtggtcccagaaatgacagatcattcggagaacctaagagaggattaaaagcaaaagggggtcatgtgcgctgtgactcaaactttgggaggtcgagtgggaagattgcttgagcccagaagtttgagaccagcctgggcaacatagggagaccctatctctacaaaaaatacaaaaattagctgagtgtggtggcacacaccttagtcccagctactcaggagtctgaggtgggaggattgcttgagcctgggagttcaaggctgcactgagctaagattgcgccactgcactccagcctgggcgacagaacaagatcctgtctcaaaaacaaaaacaaaagcaaaacaaaacaagaaaatccaaaagggaaatataagagaaaacaaaaaatctcactttgagacatcttttttgaagagttggagaggatattgtctccatccacaaaaataggatgttacaataaaagagaaagaggaaggaagagctttatatgggactgctgaaagttaaaagaaaaacattgcattaaataaattagaagggtgatctcatctgtgcctgtgacttcagttatcatcttaaggctttgggtctcaaagcacacatctagtttagacctttcttaggagccctgaagggtgcattgccaactactgcccgttggagggtccatttttcccaagatatccagcaacactcttatatgagtgtcctgctccattgtctcaaattaccataaactggggaacgcaagcaacagaaatttatgctctcccaggcctggacaccaggagtctgaaatcaaagtgcaggcaggattgtgctccctctggaggctctgggggaggaagcttcctgcctctcccggctcctgggggctccaggcatccctgggcttgtggccacagcactccagtctctgcctctgtctccacgtggccttctcatctgtgcctgtgtctcctcttctgtctcttagaagtacactggtcattggatttagggcccacccttttccagcgcgatctcatctcaagatccctagcttaatcacgtttgcaaagttccttatttccaaataagttcccattccaggttctggacatgaggatgtgaatatatctttgtggggaccacagttcagtctactagagttgtatgcagttccttctggaggctctaggggaggatcctttctgcatctcccagctcctgggggctccaggcatccctgggcttgtggctgtatcactccagtctgcctccgtctccatgtggccttctcctctgtgtctgtgtctcctcatctggctctttatttttttaaattatttatttatttatttattttttattttttttggtgacggagtttcgctcttttgcccaggctggagtgcagtggcatcatctcggctcactgtaacctctgcctcccgggttcaaatgattctcctgcctcagcctcctcagtagctgggattataggcacccgacaccacgcctggcttattttttatgtttttagtggagacgggatttcaccatgttggccaggctggtctcgaactcctgtcctcaggtgatccgcccgccttggcctcccaaagtgctgggattacaggtgtgagccaccatgctcactggccattttttattattactcttttttcctcttctgtctcttagaaggacacccgttgttggatttaggtcccaccctaaatccaggatggccttatctggagattgtttacttaatagaaactacaaagaccctattttcttttcttttttttttttttttttttgagacggagtctccctctgttgtccaggctggagtgcagtggcgcaatctcggctcactgcaagctccacctcccgggttcacgccattctcctgcctcagcctcccaagtagctgggactacaggcacccgccaccacacccggctaatttttttttgtatttttagtagagacgcggtttcacctcgttagccaggatggtctctatctcctgacctcgtgatccgtccgcctcggcctcccaaagtgctgggattacaggcgtgagccaccgcgcccggcctcaaaaaccctattttcaaataagacgccattcacaggcaccaggggttaggatgtagacatatttttggggggcaccattcaacctagtctatccctcaatctcaatacatcccctgggttaaacatgaaatgtgtccccttcttcccccaaatcaaagcaacccaaaagacccctgtgcacctgcacaccttgcctaagtcggcagcactcactgcgtagatgcccaaaccctaagctgtgatcatctccaccctccctcttgcagcctaattgagcccattctctgcccaagcaccttatgaacaggactttaaccctccatctccaccaccttcccattttcactggaaattttacttcttaaagaggccttccctgaccccttgaccaaggttagatgcatcccaatgttctcctatggatatgttgtttgaagtcctcaagtctgaacaaactcatgtgaggtcacccaagttgttagacttactgtcattaatgcttcctgccctccttccagcccgactggaactaaacaaaactaaatgagggaccaaccttgtgttgttcattgcagtttctcggaggtagacagcacctgagacccaggaaaatatcaatcatgatggaagtgatgcattcatttattatattgactccttttttttcccaaaagctattttgtgttcaaaacctggactgcataaaccacttcattgtggttatggagtgttagaagccgacacctaatcaaagaattcagtgtgtctcagtggtaggaactctaaagccatctaacattaaatgcaataaaagttcagttgcttacgacctggcgccgtggctcacgcctgtaatcccagcactttgggaggctgaggcgggtggaccacgaggtcaggagattgagaccatcctggctaacgtggtgaaactctgtctctactagaaatacaaaaaattagccaggcgtggtggtgggtgcctgtagtcccagctactcaggaggctgaggcaggagaatggcgtgaacctgggagacggagcttgcagtgagctgagatcgcgccactgcactccagcctgggtgacagagcgagactccgtctcaaaaaaaaaaaaaaaaaagttcagttgcttactctccatagcctcaattcaaatcctcagtagccacttgtgagcttgtggctaccattttggacagtgcagatagagaacattcctatcattgcaggcgatactacgggcagtgcttgctccaaaacagggggtctcaactgggggccggccttcccccacagggcacttgacagtgtctggggacagttgtggttgtcactactgggggtggatgctgatggcgtgtggtgagtggagcccagggacgccgctctgcaggtttgcagtgcacaggatggccctacagagaatcatccagcctcaaatgtcggcagtgctaggctgagagaacctgctttagcgtgagagtcagtctctctctttctgtctctctctctctctccccctctctcccctccccactctcgctctccctccctcccccctccacccatcccatctgttatctacctacctacctacctatcaattatctaaccatcctaattatctatgtatcacctatctatcctatctgttacctatctacctacccacctacccatccatccatccatccaatcaattaatcagtgtatcatctttctctttccatgtatgtatcatacccattgtccatccatccatccatccatccagtcagtcattcaatcaatcaatcaatcatctttctatctatccatctatctgtctatcatacccatctacctatctttctatctgtctgtggcagagattctctgccaatggcaattcagctccatcagggagatacttcttccctggacaagtctggagacatttttgttgtcacagctcaggtaggtgctactgataacaggtgggtggagtccagggtcactgcttgccaccttacagtgcacaggatggccccaccacagagaatcatccagctccaaatgttaatggactcagtttgagaagctgatctcaagggtaattcgggggagtcctgcgggattgttgcatcctattgaaggggaaattaatgaattttgtaagtgtaatggggcggggggactgggttaagagagaatactaactgcttatccctcctctatgcccagagaggcttatctgtgttccatcgttttacattccttgaggcacggcgagttcttgcttccctccctagtgcagctgtaaagtcacaaggttgacaagcaattgctgcaaaagtatgtattcccaagaatgtaagacgtacggtgtaacaaatgcaaaagagtaattaactgcctttgttctcgcttctgcaagtatgctttctgcagcacgtaactcccgccacaaactgcttaaaaggtgattgatccctctgtacggggctcagactttctagaccctagtccgactgagctggtgatcaccttaataattataattataatggtcatctcctaactgtgctcggtctctaccgtctctgatttatcccgcaacactatcgtggaggtaggctaggatgtatctttaacctggctggattgtattgtagatgtgtgaaaaccagcccttgtttttcttggtagagttgcactcaaatgttattgaaagctgcacatactgtgcttgtataaatacactgagccagaaatcacgaacctttccctggcttcacatctgttagtgttgtgggagaagatgagaatttcttgtttttcttttcacttctgtgattatacattttgtattttgttgttgttttttgggacagggtctcgctctgtcacctaggctggagtgcagtggtgtgatcatagctcactgcaacccccgcccccaggctcaagtgatcctcctgcctcagcctcccaagtagctgggactatagtcgcatgccaccatgcctggctgttttttgtgtttttagtagagatggggttttgctttgttgtctagcctggtcttgaactcctgtgctcaagtgatccgcccaccttggcttcccaactgtggggattacaggtgtgagccactactcacggccacattttgtatttctgatgagaaagtgtaatttaatacactgtacatcggagagtgtagttctgaaacatctgcatcttttaaattaggacagtgtaaaaatggaatgttgtttgactcagcaaaattttgagggagtttgtttccaactgtctagaccagtgaactcaccaaactatctaccacacactgcttggctgaattggctctactgtttttaactgaagtttgaagtaaatattccaagcttaaaaatatatcttgttcctcccccacccactggttatagcagcaatataaataaaaaataccttcccaagaatatccaaagcatacattcttttctaaagtaaacattgtttatagagatacaatttctataccataagattcaccctttaaaaacacatagttctttagttttcagtttattcacagagtaagcacactgttttttgtttgttttgtttttttcgagacagagtcttgctctgtcacgcaggctggagtgcagtggtgccatctcggctcactgcaagctctgcctcccgggttcacgccatcctcctgccccagcctcccgagtagctgggactacaggcttccgccaccacactcggctaattttttgtatttttagtggagacagggtttcaccgtgttagccaggatggtctcgatctcctgaccttgtgatccgcccgccttggcctcccaaagtgttgggattacaggtgtgagccaccgcgcccagcccattcattcattttttgagacagagtcttgctctctcacccaagttagagcacaggggtgcgatcactactcactgctgtcttgaactcctgggctcaagtgatcctcctgcctcagcttcccaggtaacttggactgcaggtgtgtaaccaccacgccctgctaattttttgatcttttaatagagacggggtctcgttatgttacccaggctggtctaggactcctgaactgatgtccttccgtggcctcccaaagttctgggattataggcacgagccaccatgcctggcaacacacactcttttttaaaaatactttttaacagctttttttcctgtctataaaatagaaggtcattatacttgtttgcagcagtaattccaaaaatcgacttcgtaaagaagaactgcgtgtttcacacacttatttcctccatggtagcatttaatgttcttttattgattttacccaggggggaaaatgtcaaggaaaagaactgagtttgaggatgataaatgtgtacgttctgatatcattattttgaaacaattatttaatgcaatgcgtcggtttcacttatcaatttaacataaattgaacctatgttgatgaactatttctatagtcataaattttaaaaggtgagaaagttatatagtgaaatgcatctgtttttgtgcctcacctgtgcagaatttgccctctccttccacccaggtgcccatattaatgtgtcttgtatatttctccaaagtcctttctcaatatagaagcaaattatcacttatggagaagagcctcactttttttttttttttttaaacagatgggggtcccgctcttttgcccaggctggaatgcagtggtactatcataattcactgcagcctccaactcccgggctcaagcaattctcccatctctgcctcatgagtagctgggactactggagcataccaccacacccggctcattaaaaaaaattttttttttttatagatggtgtctggctatgttgcccaggctagtctcgatctcctgggctcaagtgatccttctgcttcagccttctaaagtgctgggattacaggcatgagccactgctcctggcctccacccatctataggtgtggaacaagagcatgttccctcccaagctaatgtggcaggtaactggcctcccaggctgtagacaagatggatgggggctgtgcccacttcttgagttaaccttttttttttctttggagacagagtctcgctctgtcgcccaggctggaatgcagtggtgtgatcttggctcactgcagcctccgcttcccaggtttaagcaattctcctgcctcagcctcctgagtagctggggttacaggtgcctgccaccatgcccggctaatcgttgtatttttagtagagatggggtttcaccatgttggctgggctggtctcgaactcttggcctcagatcatccacctgcctcggcctcccaaagtgctgggattacaggcgtgagccagcgcgcccagctgggttttaccttttttgtttgtttgttttttgagacagagtcttgctctgtcgcccaggctggagtgcagtggtgtgatcttgcctcattgtagtctctgcctcctgggttcaagcaattctcctgcctcagcctcccaagtagctgggattacaggcatgtgctgtcacgcccagccaattttttgtatttttagtagagatggggttttcccatgttggccaggatggggttttaccttttttgaagtgtattttccatgtagccacctctcttggagtgtccatgaggaacacgatgctgtccttggtgtctcagcggagccactgtgacgctctcctcttgcaaagatttctggtcatgatgtctcaacattggcctgtttggggttttttttctcctgcattttagggagaattagggctcatccaccctcaccttctctcccccattgaattggtgcatcctgtttttttttagcccctgggatgcccatgttcaagattccttaagcatcacagtttaaggaaagaaatgcagattatttaaaatatgtggggtgagtgtgcagggtggtgatggacaatgcatgtgtttaattcagggactgttgtgccagctgtgtttgagccttaggaattcttatagttgactggcatttacagtttattaaggcacttacctcttaggtgtataatcctcaaaacatctaaaaaattagtgatttttgttatccaagttactttgacatcagccatttgctgtctcacccacatgatttctcattatgttaccttattattggctaagttaatctgcttactgaggacctgcatgtgacttttcccattaaaagtaagttaagtctgggcgcagtggctcatgcctgtaattctagcactttgggaggctgaggtgggaggatcccttgactttgagaccagcctgggtgaaaaagtgagatctcaaaaacaaaattagccagacatggtggcgcatgcctgtagtaccagctacttgggaggctgaggtgggctgatggcttgagcccaggagtttatgctgcagtgagccgagattgcatcactgcactctagcctgtggcacagagtgagacctgtctcttaaaaaaaattaattaattaattaaaaataaataaaagtaagtccaagtggagatggttggtggtgttggttggataacattgtgaatgtatttaacaccgttaatctgtacacttcaaaatggttaattaagatggtaaattttatgttgtgcgtattttaccataattaaaaaatagatttggtctgcgtgatggctcacgcctgtgatcccagcactttgggaggcgaggtgggcggatcacctgaggtcaggagttggagaccagcctggccaacatggtgaaaccccgtgtctactaaaactacaagaattagtcgggcgtagtggcaggcacctgtaatcccagctactctggaggctgaggcagaaaaatcgcttgaacccaggaggtggaggttgcagtgagctgagatcgcgccactgaactccagcctgggtgacagaatgagactctgtctcaaaaaaaaaaaaagatttaaaacaaagtaactatgttcaaggccaggtgtagtggctcacgcttgcaattctgacactttggggcgctgaggtggaagattgcttgaagccaggagttcaagaccagcctgggcaacagagtgagaccccatgtccaaaaaaaaaaaaaaaatcatcagctttcattctgggatcgtaagtagagacattgtttcccagacctggtacagatggaacctgcctacgtgtcttcaatgggcatcttaagacttatgttttggacatatcagacttttggaataaaggagctgagttgggagtacaaactcctcttcttatccatttccctgtggcaggagattttgctctcagcccccacttactggtgtgagatccttgattctggaaggtgagctgtgctgttcagcccacaggtcctcatgaatgtctacattcagtgccacgcagaataagaagaaacacacaccagctctgcttctgtgaagcttactttttgttgttgttgttgagagggggtcttgctctgtctcccaggctggagtgcagtggtgcagtcatggcactcattgcagcctctacctcctgggctcaagagatcctccctgctcagcctcctgcgtaactgggaccacagatgtgcgccaccatgcccagctaatttttaaattttttgtagagacagggtttcaccatgttgcctgggctggtcttggacgcctgggctccagtgatccacctgccttggccttccaaagtgctgggattacagacatgcgccaccgagcctggttttgcttactttttctttttttttttaaattcctcttagcctatcttgggggaggcgggtcagtgttattccggtgtacatacaacaaaatcacccatttgaagtgcacactgggaggagtccttgccaaatggatagggctgggtaaccactgccacatgggacatttgggaagccgatgtttgaatgttttcacgcttacagatgcattcatttactacgtttattattctgtgtgatgtgctttctgtgtgttatttcacttaaacccagtgggggtaaagattatgatccctatttggtagatgaattttagagaggttagggggcttgtcaaggtcacacagcttttaaccgtgatgggatgacgcctcttgaatgaggcttagtagtgagatggctgaggaaggaaaaaagtaggaaggagagaaagagagaaggagggaaggaagaaagtagggagaaaggaaggaaaggagagggaaggaagggagaaaggaggatggaaagatggaatgagaggaaagaaggaaggaaaccgatgaaagaaggagggaagggctgaaggaaggaacaggtgccctgttcaggtgggtttatcctcaggaaggacccaagatggaaagtgtgtatgcaagaattattttaggccaggcgttgtggctcatgcgtgtaatcccagcactttgagaggctgaggcaggcgaatcacttgaggtcaggagtttgagaccagcctggccaacatggttaaaccccatctctactaaaaatacaaaaattagctggctgtggtggcacatgcctgtaatcccagctacttgggaggctgaggccggaggatcgcttgaacccaggaggtggaggttgcagtgagctgtgatcgtgccactacactccagtctgggccacagagcaggactctatctcacaaagtagaaataaataaaaaataaataaaaacagagatgaggacacagacgcacatagaggacgaccctgtgaggacacagggagaagatggcatcgacaagcctaggagagaggcctcaggaggaaccagccctgcccacacctgggtctccgacttccagcctccaggactgtgagagaagaaagttctctttaagtcctccagtctgtgttaggttattacagtagttcgagcaaagtactttatttacatagaagtctgccacaattatgagccctgaaaccctttcccaggatgaaccgaggtcagagtgtaattaataggtactttttttcatttacgtttagccactagattttttttttcaacagagagtagcgaatactgcagaagctgaatgagatgaagcttaagtcagatctttatgcacctcagaatatttgtactgatgaaaagaaataaccaacacttgatagagggaaagattgagacccagaaagtaatctctccctgtgaccactcctaccaaattcttgcttaactaccttattttgttcgtttgtttgtttttgtttttttgagacggagtctcgctctgttgcccaggctggagtgcagtggcgcaatcttggctcactgtaacctccacctcccgggttcaagcgattctcctgtctcagcctcctgagtagctgggattacaggagcgcgccactaccacccggctaatttttgtatttttagtagagacggggtttcaccatgttggtcaggctgatcttgaactcctgaccttgtgatccacctgccttggcctcccgaagtgctgggattacaggtgtgagccactgtgcctggccaactaccttgttttttttggatgaaaatgtggttcttacctcagtaaagattatgaagggatttatgtacagatgactaaaatatcagccattagtttcctatttgtttttgttgttgtcattttttgttttgagacagggtcttgctctgttgcccaggctggagtgcagtgatgcgatcttagctcactgcagcctcgacctcccaggctcaggcaatcctcccacctcagcctcccaagtagttgggacgacggctgtgcaccaccacacctgggtaattttttatttttatttttgtagctgggatctcgctatgttgcccaggcaggtcttgaactcccggcctcaagtgatcccaccatctaggcctcccaaagtgctggacttacaagcgtgagccaccctgcccagcctagtttacaatttgaacttggtttttcatctcggctcctttgaagacttctgtcttctcccatgtttggggcggctctgcgttgtggacattccttagtgatcggcctgggaaggctcagacatgtctaggctgcctttgtaggaatagggattagtagctccttagccccactctttcctgggatgttgctgtttgctgaggtctgcacagttcagaccaccctggaagcctctctcaggttctcagagatggtggagttatacctttgaccgtgagctcgcagcattgctagggaatgtacttggctaaatttggaactatttggttgaatttgtaccccttgggcatatttgctttggtaacataccacagactgggtgccttaaaataacagaagttaattgtttcacagtcctggagaccacaactctgaagtgcagatgcagcagggctgtgctccctctgcgggctctaggggaggctccttcctgcctctcccagctcctgggggctccaggcgtccctgagcttgtggccgcatcactgcggtctctgcctccgtctccacatggccttctcctctgtgtctgtgtcttctcttcttctcttacaggaacacccgtcattgtgtttagggtccactccaattttggatgacctcaccttgagatctttaacttaattacatctgcaaagacccttttcccaaatgaggtctcatttacaggttctgtgggtcaggacatggacatatctttctgggagaccatagttcagtccactacagttgtatccagttgtttctggaggctccaggggaagctccttcctgcctctcccagctgctgggggctccaagtgtccctgggcttgtggccgcatcactgtactctctgcctctttctccacgtggccttcccctctgcgtctgtgtctccttattagttcaccactcatattgcaccaccttcaggatgacctcaccttaatatatacctttttttttatttcattttttaaaaaagtggagctgaggtcttgctgtgttgcccaggctggtctcaaactcctgtgctgggattacaggggtgagccactgtgcccagcctttgtgtatatcttaatcacatctgcaaagaccctgtttgcaactaaggtcccattcacaggtaccaaggattaggatgtcaacgtatcttttccagggcaccccattcaatgcacacaaagtggggagaggggagattggctgtgtttaggtgacctgtgaaaggccgagctagctgtgcggcgttgctcttgcagcacagaggaagaactgggctcagatggtgtcagctgttggtgtctgagatcatccgtgaatctactcccgggaatgtgctgcagtgagacacggtccttctcccgtcaccttcctgaccccatcccatatacccacggaccccaagggaaagtactcagggttggttggtttcttttccgttttgtgaccgcgtgaaattccatgtcacggtccctgtgtttattccatacagctctcctgaagtgttttgagttctagcaaaatttaaaaatataaccaaagaaacttaaatccgtgtttctcctctttctggacacttctttagtatgaatgggcatcgtgatgataaacacggtggcctgctgtctttgcttctctctctgctggccgcctccttccttccctccaaagtcacaggcaagagggatttagggtttgctgggcttgaggaagagaggaaaaggccatctcttttcacagtgagaaatgtgttttctgttctttctcatacctcgctttgtacatttaaaaaaattatttctctttagatttttgaaccaagagagatatatttattatttaaaaaaaatttttttttgagacaaaatctccctctgttgcccaggctgcagtgcagtggtgcaatctcagctctctgcaacctcctgctccctggttcaagacattctcatgcctttggagtagctgggattacaggtacccgccaccatgcctggctaatttttttgtatttttagtagaggctggggtctcactgtgttgtccaggctgatctcaaactcctgggctcaagcgatcctcccatgttggcctcccaaagcactgggattacaggtgtgagctactgtgcccggcctatttcttttctaaatagaggcagggtctcactatgttgccctggctggtctcaacctcctgggctcaagcaatcctcctgcttcggcctcttgagcagttgggactccaggtgcacacaaccatgcctggctaatttttgtattttttcgtagagatagggatctcaccatgttgcccaggctggtcgggaattcctgggctcaagcagtcctctgacctcagccttccagtgtgctgggattacaggtgtgcaccactgtgcctggccttatttattttttatttatttatttttggagacagggtttcattctgttgcccagactgcagtgcggtggcaaccatagctcactgcagcctccacctcctgggctcaagtgatcctcccacttcagcctccccagtagctgggactgcaggagtgcatcatgactcctggctaatttcttttaatagggatgagatctctatgtttttgtagacaaggggctctcgctgtgttgcccaagctggtcgagaactcctggcctgaagccatcctcttgccttggcctcccaaagtgctgggattacagttgcgagctacggtgcctggctgtagattccccccagcccccaagccgccagttgtgagtcttcactaacaagggaacctttcagcattttccatggtcatggtgattcacctaatattttagttctgctgagttgtctaaacattcgggataaaggctgtcattttttggtgaccgtaatgtgtatgtgtatgtttacagttacacatgcctgtatttgggtggagctcagaagatgcccatggcatttttctgggaaagttgaagtttatgatgtttgctctttattgggagtgtggaggtcgtctttctccttcttcccatccctccagacagaaagctgggatgtggccaggtgcagtggctcatgcctgtactcctagcactttgggaggccgaggtgggtggatcacttgaggtcaggagtttgagaccagcctggccaacatggtgaaaccctgtcactactaaaaatacaaaaattagccaggcggggtggcgggcaccggtaatcccagctactttggaggctgaggcaggagaatcgcttgaacccaggaggcagaggttgcagtgaactgagattgcgccattgcactccagcctgggcgacagagtgagactctgtaacaacaacaacaacaacaacaacaacaacaacaggccaggatgtgtttgtgtgtgagttggacccaagggcttgggaaggatggatagggtaggggaggagggatagatggatgagggaatgcagagagagtggccacactgtcagaggctttcaaaaagcaggaggttctccagtgggagagaggagacctgagtccaccccgcattaatgtttacagatcagaattgcacacatagaatggctcataaatctgatccaccttcctcgtctggcacttggctggagaaacaactctttgaatgttggaggaaaagcccactgtattgcacctgctataaaaagggcgtgcccaccttaaaagtagccacaccttcccgagattgccatggtccttctaagtctctgaaatgtatagatcaggtatatttgggaatttggggatttttctaaatttgggatgagaatgggtgcatgtcctttttaattatacaacaccctcagcagagtctgggctggatgttgttatcaagacaagaatatttctgtagtgaaataggtagatattcaccccaaggaggatcaagcctgaacagtctcacgttaggcaaggtccagttttgcggccaggtgtgttgatgaagacactttgagtattcagagcctttagctttagccactgtgggtaagggattgtagaacccatacttaagctttccccttaaagctttgactttaatctccacattgcagccctgcaaaagaacagaatcgtgtcctttgcagcaaagtggatgcagctggaggctgctatcctaaacaaattcatgcaaaaaatcgagagccagatattgcatgttctcacttataagtgggatctaaacactgagtacttcatggacacaaagatgggaacaataaacactggggattccaaaaagaggaagggagggagtggggaaaagactgaaaaacttcctattagaaactgtttactacttgggcaacgggatcattagaagccgaaacctcagcatcatgcaatatacccatgtaatgaacctgcacatggaccccctgaatctaaaattaaaagaaaagacataaactccacatctgatttccctcgtgcataacactactacttagcttggagagagatggaggggatctctagggtggggaatggaccacttaccttcaagatctcccttatcaggaaggaaagagctgacctgcctagaaacacttgaaaacactctttttttatgtcttattgggcaaagctgggtcagatggccacccttagctgcagagaaggctacaaatagacattttctcctcaagtgggataatgataactggggaatgtgtactggagagccttccaacaccaagcggggaagatctaccagcaccattaaatgttgcctttgtcttctgtgcacttaagctgataaaccttaaacattacagcatgccacttctgtctgctttgaataaggttgtttaccgacatacttctgcagtctgattgtggcgttggcgggactgacaatatctcccagggtagcgcaaagatccgctgcagtgcataagtaacgtgttttgagttttgtatgtttataatgcacacagctcagagaaagctttaaagaagtcacagaagtgtaaaaaatctgttgagtcatagctgttgttcttaaagtaggcatggagaattctctctgttgagggtcaaatacaagtactaagacagaatgttatgcagtaaacacagccaagtaatgaatgggttccttggggtgggtgatagagaaagataaataaggaggaaggaaccagatagaggaagaaaagtcaaggaccatattcattgcattattagaattttagggtgtggcaagaatttaatgtttcctaataatatgcaagttctgttggaaagaagagcaacaggagactaaaaggttaaaaggttactctgttgcccatttcataggtccaatggcaggataagcttgggttggatgccagtgttcctgattcctaattgtgttttatccaattgaaacatcagtggccatagtcaaacacctaaactgtatcagttcacagtcctcaaagcccttctcccacttcctgtctttgacctgattccacctaattttgtccacaccatgttgtactgtaataaaacctattttatttccaaattaactaagagaatatactttaaaaatgtgttactatttcattatttgtttactttttttaaagaaatatttaacacctgtcagctattgacattgtttccttcttacactttttctttatcttgtagttcactttctatttctgccataataaaatattcagtatcggaaacttcacttaaaaagcaaaggttacttctcctcctcccttcccagtctgccctataagctagtaaattcatcattcattagcttagatattttacaacatggggattttagtttacagcaaatactctaagtaaaattggtagcttaagtacaactttttcttttcacgttaccatgtgcaatcaatggcattccagactcttggaaggaaatccattgtatggttgtggtctttttttttccttctcaaaccagtcaaaaatacccagtcacaatttaaaaaattatccgcccttggtggtgcacgcctgtagtcccaactatttgggctgaggtgggagggtcacttgagcctggcaggtcaaggctgcagtgagctattgattgtgccattgcacttcagcctgggcaacagagagagaccctgtctcaaaaaaaaaaaaaaaaaaagacaaaacaatataatgtgatctaccctctaagcaaattttcatatatacaattttactattgtatatgtgagctatttatatataaaatttcatttatcagttcagtattgttaactatatgaactaggtgtatggtagatctccatggtttatcttgttcaactaaaactttgtatcctttgaccaatatatttccccttccccctcaagccctaccctctgataactacctctctactctctgcttctatgagtttgactattgtagattctgcattagtccattctcatgctgttaatgaagacatacctgagactggttaatttataaaggaaagaggtttaatggactcacagttccacatggctgcggaggttccgacagtcatggcagaaggtaaaaggaggagcaaagtcacgtcttacatgacagcaggcaagaagagagcccgagcagggaaactcccatttattaaaacatctgatctcgtgagacttattcactatcaggaggacagcatgggaaaacccacccccatgattcagttacctcccacctggtctctcccacaacacatggggattatgggagccacacttcaagattagacttgggtggggacacagccaagccatgtcagattccttgtataagtgagatcatgcaatatttaatatttgtttttctgtgcctatcttatttcactgaacataatggcctccagttccatccatgttgctgcaaatgccagagtttccttcttttttagggctgaatggtattccatcgtgtatatgtaccatgttttctttatccatttgcccttggacggacactgaggttgtttccacgccttggctgttgtgaatagtgctgtcataaacatgggagtgcaggtgtctggaagatcctggttctcttgggttttgcaatctagcataaagcaggcacaggagtaccagccaatgaatggataggtaaatggatcaatattgatcggtgagatttgctcgtcaacagatgttggttcctcagaaggatacacttccaaaccatcctttctctgaatgtcagtttctgagaagcctctctgctgtttggggtgggtgtgatcacataatacgggagggcagttttgttttagttgctcatctctgtctgcagctgtgaatgcgttgtttaaaaatattgctgaggaatgacttgcatgtcagtaaggggctgctgacgctgggatcaaggtacgtcaaaggcaatttagggatactctagaaatcctgcatcagttgcagtggctcatgcctgtagtcccagcactttgggaggccgaagcaggaggatcacttgagcccaggagttcaaggctagcctgagcaacgcagtgtgaccccctctttacaaaaagtacaaaaattaactgggtaggctgaggcgggaagattgcttgagcccaggaggtagaggctacagtgagctgtgatggcgccactgcactattcgttccattaacccaagaacatttatgctacgtgaagaatatttcaatatgtgcgtgaacacgtgcacaccttgtaggatcagtgtgttacaggaagaggaggaggatgaagaggaagaagaggagagggaggaggagaaaggaggaggaggaacaagcaaagcttgtttagagattttgattttcttttatatctcattgactattagatttcttcatttacatgcaccccagtgggaggaagaggagggagaggaggaggagatggaggaggaggaagaagtggaaaagaaaaggatgtagaggagaaggaagagatgaaagagaaggaggagaagattgaggaagagaaaaaagagaaggaagagatggaggaggggaaggaggagaagagagtgtttggattgaaaatgtcccagcagaatacagtagagctattggttttcttttatatttgtagtggttgcagttgttgttgttgttttgttttctgtttgtgggcacctatatagcacttcatcccaacccacgccagattgtagaatacggactccgtactttgagcaagccttaatgtgcgttaaggaaacagccgtgttgaggagggctgtgtgttttacaccctgtctgtatttctgataaaaccagagagcctgaagagaaaaaggcatgttatataaatacatttactattactctaatgcttctccatgtgggtgtgtggggcgtgtgggtgtgctgtgtgcgaagactgatctgcagaaattatggccagtttgtccccaaattgaggaaccattcagaggcagatggctctctctgtctccctctctctccctctttctctctctgcaatttctgtattcagtggaaaattccaggtgagcgcctctcactaaatgccatcagcccacgtgcaccatgacacaaagtctctgaaagtttcacttggggtctgtgtttgccgtcctggtgcagccccccgctgattgcatggctgtggtggtttcttcctttgtcggaagacttaatgacctctgtcgatttcttctctctccaggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgtgagtcccctcctgaagcctctccccacgcactctccctagacccctgtgtgtctcttcttataagaagctgggtgggccgagaccatggcctgcgtgcaaagccttaggccacagcagtctccacctgtcaggtcttatcagcctctgatcttagagctggaatacctccagggctcctgacctccatggctgaccaggtccaaaaagaaacgctctgtgttcagaagtccgtgcccaaggccccttgctcctctcctgggtgaaccaagtatctctgcccggaaaaggatgcagaaatctttgtctcctcacctccttgggttctgcatctatagctctcggcagaactggttaagttggtttttaagggaccacagtcacgtggacggggctgggcttcaggtttcgttgggtttctggttgactgtggatgagagataccccgttgagatgcagcccacacacttccagctgatggtacacaacagtcttatgtcctagggtaggtgtgatagtccattcaggctgctataacaaaggatcctagactcggtaatttacaaatgacagacatttgcctcatggttctggaggctggaaagtccaagatcaagacacggtggattcagtgtctggcgaggacccgcttcctggttcatagatggcgccttttcactgtgtcctcacatggtggaaggggtgagggatctctctggggtcccttttataagggcactcgtcccattcatgagacttcaccctcatgacctcccaaaggacacaacacctaacaccatcaccttgggggtgaggatccaacatagggatttgggaggacacaagatattcagaccattccagcagggtaattccatttccacccagatgccttagacaaggatgtcctgcgtgtctctcctttccctccatgggtgccttccatccaattcccacgtcttccctccgccatcttgctaccatgcctctcctgtccacctatccatcttctgctttatctgggtcccgtctctctgccctgattttctgtactggcttccctcctacctggtctttctctcccagccttgctccccttgaagacattcctcactttatagcctcactggtcctcccaggtacctctgcaatgacctgcctctctcctttcatcctcagggtactcctgaagtatcccatataaagccccagcaatgcagcatcctcctaccagtatcctcgtggactggccccctgccaccacctccctacaggagaaggtagaaggtgctgttcacacactcattccggggcttctcccaggccacccttctttgacaggcctccttctttgctctcatcattgtccttcacttcccccatctaagaaacacctacctgttttccctcattcacctgctgtccccgggacacagggtgcctcccatcatgttcttgaagcacctcgtgtgtactggaacaagtgcacctgccttctcctctagacccaatgctgcctaagctccgaacaaaatcatatgcagaggatgggcgcggtggctcccttcctcccttcctttcttcctttctgcatttctctttctttcttgacagggtctcactccttcttgcccaggctggaattcagtggcacaatcatggcccactgcagcctctgccgcctcccaactagttgagactacaggtatatgccaccatgcctgaccaacttttaaaagtttttgtaggatgaagtcttgctgtgttgcccaggctggtctcaaactcctggcctgaagcagtcctccagcctcagcctcccaaagtgctgggattgcaggtgtcagcccctgcacctggactgagaatgcatgtctgttgtctgccgcgtccctccaccccaacccccagtttgtggtactttgttaatgatagccctgaggaactcacacacaccccctgcgcctcctggagcaggagagcagccgagacgatgggctcctgagtactctacagttcagaaatctaaaatcccacagaagaaccgcatggacatgggagtgggtggagtatacaagtgagagaattccccaggatggaattcttgagctcccgcaagttaaaaaatagggaggagcttgtagaacagagctttagttaggtagttctcctttcttcaaggcaggatagctcaagactgttttccttggcagataaggtgcattcctgcagggacgtggattctgattttgatattccctgctttcaattaaggaacaaagtcgtttatatttcttaagtcttatataaagccctagagactttagaaattctattcaaagttacctatgttggtttatttttatcttttatataaaaaagtatatatatagatttacatttagagacgggttttgctctgtggcccatcttggagtgcaacggtgcaatcacagctcactgcggccccaacctcccgggcttaagccatcctccttcctcagcctccagagtagccgggactacaggcacccatcactacaccctgctaatgtttttatttatttttaatttttaaaaaacatatgtatatatttttcacaacctctttggtgaagataatgtttttgttttttctctatgaacagggtcttgctatgttgcccaggctggtcttgaactttaggctgcaagcaatccacttgccttggcctcctgacatgctgggattacaggtgtgcaccaccacacctacctcattttaaaattttctgtagagatgggatcttactttgctgcccaggctagtctcaaactcctgggctcaaatgatcttcccacctcggcctcccaacatgctgagattatagatgtgagccaccgtgcctggcctatttctaacttttaaggagtgaaatttctctgcaccgtgacagcttttgaagaggacattttggatgcttcatgggttgtcctttgcccgtacagctcaccggctcctccgagtgctggttacagtcgaatgtgagctgttatttgtatgtcaggtccgcctggtggtgttgccaaaaagcatgaatttttcctcatcatttaaagtctacatggaatttaaggccactttcgatattattcttgggaggattttattcagtgttttgggagaacatggcaggggctcatttcagaattctctgatttggggccgagctcggtggctcacacctgtaatccctgcatttttggaggccaaggcggaaggatcacttgagaccaggagttccagaccagcctgggcaacatagtgagatctcgtctcttaagaaaaaaaattaaaaagaaaattctagcctggccaatatggggaaaccctgtctctactaaaaatacaaaaattagctgggcgtggtggcgcacgtctataacccagctacttgggaggctggggcactagaatctcttgagcctgggaggcagagcttgcagtgagccaagatcgtgccactgcactgcagcctgggtgacagagcaagactttgtctcaaaaaataataataaataaaaataaataaataaatacagttctttgattttgaaatagtgcagaaaacaaggcaggccctgaagtccacagctctcatgaaaagttttggatctagggaagtgattgtcaacaatgagcctttaaagacttaatggtgatagcaatttacaggtgacttttcccaaaaaatgacagaaaatgagtttgccacttgggcatgttgactcacacttataatcccagcattttaggaagctgaggtgggagtgtcccttgcacccaggagtttgagaccagcctgggcaacatggcaagaccctgtctctacaaaaagtacaaaaattagctgggtgtggtgggggggcctgtagtccctgctactcaggaggctgaggtagggggatcgcttgatcctgggaggcggagattgcagtgagccgagattgtgccactgcactccagcctgggggacagagcaagaccctgtctcaaaaaagaatccgaaaaacaatgtagacttggagggggtgatgtaacttagcccatgagaccgccttagtgacttgctgataattgatctttcggtgccctgcagtattatgataacctgctatagcattttgctttttctgtgcattaacactttagggaccaagtggctttaagaactggattaaagttgatccagtgcattcagacacttggcattccctgtacataacacgagagagcacgccgggtctggccagccccatggataagatgctggagggtgtccaacgttgcatgctgaggagcatgtcttagaggagaatcctagatcctctgtgaagaatgaatttcatcctcccagctgtgcagcttctcttctaaatgtaagttgccttgctcaacatctgcttcccatacgggcagttttaggccttggacttcttgatgaaggtataaaacgaggactttcagcggaggtgcctcccatttatggctggaggagtctctggggtggggccgtcctgcacacttcagggtgttggggagtgtccctgggctccacccaccagcggccaggagcagcaacctcagttatgaaaagcagaaatgtctccatacataaccaagtgttccttcagggagggagggcaaagttttctccactagtgaaccactgtgatagacagacgacggacagagagagatgatagatacgataggtaggtatatgttgagatggataggtgatagataatagatattaagataggtgtaaatgatgggtgattgataggtgagtagatagatgatgggtagctaatagatgatattaagataggtgatagataatagatactaatatatacagctatagatgatagatgatattgaggtgggtaggtgattgattgatagattaatgaccgattgcatgtaggcagagctctcatgctaaaagagagtttctcaacctcagcagtgctgacacatggggcgggatcatggaggactctgtggtggggcatcctgtgcactgtagggtgttgagcagcgtccctggactccacccagcagatgccaagagcacccatcccatctatgacgagtatctaaagatgtctctagatactgctaagttccccctatggggggacaaaaagttatccccagttgtgaaccactgtgacagatagttgatggatggatggatggatggatggatggatggatggatggatggagatcaacattgagacagatatttgatagatgacagatattgaggtagatgatagctatagatgatagatggttgatagatattagataagtgattgatagatgatagctatagatgatagctgattgatagatagctggtagctatagatggtagatggttgatagatattgagatagataggtgattgattgatagattgatgatggaacgtattagtagagtttctcaacctcagcactgctgacatttggggctggaggattctctgcggtggaaccgccctgtgcactgtagggtgctgagcaatgtctctgggctccacccaccagatgcctctagcacccccactccagcgtgacagccaaagatgtctccagacattgtccagtgtttattgtggggagcagaatcagctccattgacacccactgtagcggatgcacagacagataaatacctgtgcgtgtggagtccctttctcccttttctgccccagcccctgagcctgcagccccactcttctgtcatgattgattggcttatgggccaaacagtggttccagtgccatattatctatggcacagcagccgagccaagccagtgggtttggtctgtggttgcagggcttagccagctttcttctacagaacttggaaggcaagaggtctctccactccgggccacatccttctagttcctggatgaccgctcgtttctccatggagaggagttcatgccagaacctcttcttcggggagagtggatgcatctcttggaaacatctttttttaaagtctgcagacttgagtgtggtccccattgtcattggtacttgttgggggtaggagtaaaatcattcctttgttttactgagagttcaggaagaaagaacaccatgttctctccttttatttatttatttattttgctctctatttgaattttaaaggcaaaaatctagaaatagcgcttcttgctctgtcatcactgcctgcaaagcacagagaccagagtgaaggcaggcagctcctgggtcttctcttcctcttctttgtccaaaaaatgatacattgcatgtttagtatttggggcaaagcagacgcttcaaaaagggaggcttattttattatctatatttttcttttttattattttttaccttgattccctttttctatgtatgaaaagggaggtttaagttcttgcaagagaatgcaactgtagtgtcttctgaatggagttttccatttgatgccaagccttccagtgccttggtctaaggagaactgcgtagggtgagaagagtcccagcgatacgtggaaaaggggccttaccagctctggagggcaagaggtagggggtgaagacgcagtggacacctaaggagaattttgcaggaggagtaggggtttattggctgaaaggggtgggtggtggaaactcattctagacagggagtgacacggaagccatgggtcactacggggcaggagggacatgggggagaaactcaaatctgagttcagccaggaggtggacacaggaatgcagtgaacccagatgtgtaggagactgccatggggactggggtatgaggaaggactggctctggctcggctgtgcatataaggaaggactggctctggctcagctgtgcatttgggctgctggacagtgaggagatccagggagagagagtgcattccaatttgggaaactttgagggcaaaacatctgcagcaactgtctcagaagagagcctgaggcagggtccttggagggaggaagccacaggtggatggagccaccgagggctgctaggtcaccttggttaagggctagttgcagtgcagccaggtcggaaagtagagccgttctggagcctcacatggcatagatgttggaggagatgggatgaggatggctcattttcttcttctcaccacaaaagcccagctttatggcgggctctggagagaggaggaccaacttctacggtaaggcgtctccaaattagtgaggctgatttgcctgttcataaaaacaaaaacaaaagcaaaaaaatcccttagaggacaagccatccccgcagaccctgcaaataaaagactgcagatcagcttcgcggatggaaaagtgctgctgtcagctaaagatgaggacagagctgctcagctgaggtcactggagaggatggggaggggacttggaaacctcccttgtctcagtcgttgttgacgacattgactctttcttcatgttgactttccccccgttcatagattcatagattgctctctatgctggaaaacattctttaaaatttaatttttttattttgttaacatatatcacataacagtttactattttaacttcctttttttttttttttttttttaaaagaaatgaggtcttgctctgttgcccaggctgcagtgtactggtgcaatcatggcccactgcagcctcaacctcctgggctcaggtgatcctcctgcctcagcctcccaagtagctgggactacaggtgcgcactaccacgcctggctaattttttaatttttggtagagacagggtctcgctgtgttgcacaggctgatctccaactaccaggctcaagcagtcctcctacctcaggctctcaagttgagctgggactataggcacatgccaccatgcccagttaatattttaatttttggcaaacatgtgatcttgctttgttgcccaggctgttctcaaactcctgatctcactcaatcctcctgccttggcctctcaaagtgctgagattacaggcatgagcgtccatgcccggcctcattttaaccatttttaaaatgtacagttcacggctgggcgtggtggctcacgcctgtaatcccagcactttgggaggccgaggtggacggatcacgaggtcaggagatcaagaccatcctggctaacacagtgagaccccgtctctactaaaaatacaaaaaaattagctgggcgtggtggcgggtgcctgtagtcctcagctacttgggaggctgaggcaggagaacggcatgaacctgggaggcagagtttgcagtgagccaagatcgcaccactgcactccagcctgagtaacagagcgagactctgtctcaaaaaaaaaaaaaaaaaaaatgtacagttcactactcgggaggctgaggcaggaggatcacttcaacccaggaggcggagattgcagtgagctgagattgtgtcgctgcactctatcctgggcaacagagtaagactctgtctcaaaaaaaaaaaacagaaaacaaaaaaaacaaaacactgtttagtggcatggagcacattcatgtttctgtgcaacccgccaccccatccccatccccatccccatccatctccagaactccttttcatcttccccaactgaaactctgtcctcatgaaacacgccttattgcccctccctccagccctgccctggcaacctccctcgtactctctgctctatgaatttggtgattctaggagccttatataggcagaatcatacggcatttgtccttttgcgactggcttctttcagttactgtaatgtccttcagattcccccgtcctgtagaaaggaatttccctcctttctaagcctgagtactattccatcgtatagaggatacagcatgttgtgtttacccattcattcatccttggacactggggtgccttccacctcttggctgtagtgaataatgctgctatgaacaaggtttggcaaatatctgtccagtgcctgatttcagctgcttgaatacattgttttaatttattattattattttttagagatggagtctcgctctgtcaccccagctggagtgcagtgttgtgatcttgggtcactgcaacctgtgcctcctgggttcaagcgattcttccaactcagcctcctgagtagctgggattacaggcatgcaccaccacccccagctaattttgtacttttagtaaatatgggttttcaccttgttgactgggctgatctggaattcctcattgccaggtaactatttcacagcctggtatggatccttctgtacttttctttgtgttaaaaaagccccctcacacaaacgcacacacacaagcacgcacacacacaagcacacacacgtgcacgtgcacacacacatgcacgcacacatatatgcatgcacacacacacacgcgcgcgccccgtgcagttttggcctcatgccactagagtatgcatcatttttgtctcttgttttcttggagatccctctggggtattttgaggaggagaagttgtattattattgtgttgttgttaatctttagacattcagggatacacgtggacgtttggtacatggatgtatcatgttatggtgagctttgggcttctagggtaccccttacccgaatagtgaacattgtacccaataggttatttctcagccctcaaccccttcccagccttccccttttgggagtccccgtatctgttatttccatttctgtgtccatgtggacccactgttgagctcctacttttgagtgagactatgcggtatttgactttctgtgtctcagttattttacttaggatagtggtttccagttccatccctgtcgttgcaaaagacatgattttattttttatggtggtgtcgatatactacattttctgtgacttttatatactaaattttctttatccagtcatctattggaatggctgttacaaaaactcaaaaaaatccaggcatggtggcccacgcctataatcccagcactttgagagacccaggcaggaggatcgcttgagcccaggagttttagaacagcctgggcaatatagggagaccctgtctctacaaaaagctcgaagaaatagcgagggatggtgttgcacgcctatagtcacagttcttcaggaggctgaggtgggagaattgctcgagctcaggagttgaaggttgcagtgatctatggttgcgccactgcactccagcctatgcaacaacagagcgagaccctatctaggaaaaaaacaaaaaagtaagaaaacaacagatgttggtgtggaagtggaggaaaggggccatggatgcgctgctggtgcggaggaggtcttccagtgcgtgcagcaggggaggtgacctcacttctcctcgagaggagctcagctgtgcaaggcagtgttgcagaggatgggagggtgcatgtgaccctaggagcaaggctgtgtgcctgtgggcatgtacttcctggtgacgtttccttggaccccacagtgggaaacaggagcccctctgccctctcattcctctttctctgtatttgcattcgctgtcttgctggtctcaagattcccaagcgctgctgccagcccaccccttcagcctgccaagctacatgtgtgcgcccacttgaccactctctgagccttctgctcagatgcctctcaccaaaaatgagttcctgctcttcctccttgcccctcagccctaatcagttcctcatttgcacttccccatttcataggtggtccttccagctcttggggctcacccaggaaccattttttattccttttctttgactctgcattcactgtaatcctgagtcctgcccttttaacttttttttttttttttttttttaagagatgtggtcttgccgtctcatccaggctggagtgcagtggtgcaatcatggctcactgcatccttgacctcctgggctcaagagatcctcccacctcagcctcccaagtagctgggaccacaagtgcacaccactatgtccagctaattgaatttttgtgtgtgtgtgtgtgtgtgtgtgtgtgtgtgtgtgtgtgtgtgtagggacaagatctcactgtgttgctcaggctggtctcaaactcataatttcaagcatttcccctgcctcagcctcctaagtagctaggattataggtgcacaccgccatgccttgcccctttccaattctcaaacacatctccagagcccatccacatcaatgatgtcttcacagaagctgccatagcttatctaaattccctccccttctctccactgatctctgatctctgctgaactcaccccttcctgctgtatcagcccaaacgtttctgatgtgaaaataggcagggcgtagtggctcatgcctataatctcagcactgtcagaggctgaggtgagaggattgcttgaggccaggagtttgagaccaacctgggcatcttagtgagaccccatctctaattttttttttttttttttttttaaagacagggcctttctctgttgcccaagatggagtgcagtggtgccatcatagttcactgcagcctcattctcctgggcccaagttatcctcccacctcagcctcccagatagttgggactacaggcctgcaccaccaagcctggctgatttttaaattttgggggtcttgctatgttgcccaggctgatcttgaactcctgggcacaagtgattctgctacctctgtctctcaagtagataggagtacaggtgcatatcaccatgcccacctaatttttaatttttttttttttttttttttgagatggagtctcactctgtcccccaggctggagtgcagtggtgtgatcttggttcactgcaagctccgcctcccaggttcacgccattctcctgcctcagcctcccaagtagctgggactacaggcgcccgccaccacatccagctaatactttgtatttttagtagagatggggtttcaccatgttagccaggatggtctcgatctcctgacctcgtgatccacctaccttggcctcccaaagtgctgggattacaggcatgagccactgcgcctggccctaatttttaattttttgtagagacgtgatcttgctttgttgcctaggctggttttgagctcctgggctcaagcgatctgccaccttggccccgcaaagtgccggaattacagacgtgagccaccgcacctggcctccagctcttttgtgtccctccccaatcttcctttggccttcagctgtggggacagagatgccccctgcctccctgtccccaccttctacctggtcttacaggaccccctccagccatccttccaagtttactatgtaatgtctgttccacatcaagcctgcaaagctcatgacagtcacaagatctgccgttcctgatactatgtaccgagaacattacttggcacataaggggcccttgtccaaaacatttggaaaccaataaagaatgtggctggtgagttactgattaatgtgttgatgaattcattgattgctgaggctagtatgtacagtaagtgttagatcttgaacatacttctcatatccattgtgataaaccctcttatcttctattgcttttgaacttttatagacttgatgtcaggggcagagtccctcaggtaactggaatcattgaactgatgcattggtttctaattttctaagctcagatttgaaatcacctgtggtcactaaactcgtcctatcccacagcccctgcacatgatgacttaagttttgtgaatgttttttggagatagtaaagtcagtatctctttcaacattttgttccttatctttagtgatacccagctctgtacaaattctgtccacgtaagcaaagtctttttttttttttccagatagggtctggctctgtcactgaggctggagtgcagaggttcagtcatagcttcaactcctgggctcaggctgtcctgctgcctcagcctcttaagtacctgggactacaggcctgcacaaccacacctagctaatctttttattttttgcagagacagagtctccctattttgcccaggctagtctcaaactcttggtctcaagtgatcctcctgcctcagtttcccaaagtgctgggattacaggtgtgagccaccacactcgcctgcaaagtcttactgataaaagatttgaaggaaggatgtgtcagagaacttcttttttcttataatatttacttaatcttattggtttggggaagggcaagagaatcccagttatctagatttttctttttcttaaaggagtatgtttttacttgctaactctctttgtaaactgttacttcttaaagatgctgaagggtgatcccgcattagtgtataggtaaaaatgatgtctccatttcatatatactgataaggtgactttattaagccttgtggtttgttgatgttgattttactgagacacttgtggaacagatgtattttcatacaaccttacacatctcagtagttttccccactcgtgcagtaactttttctcccctgctttctctcctcctctccccacctcttcttccttcccctcctctcctcgtcccttccctcctcttctcatttgatacaaagccctaactctcttcctctacagatcatcctacccatggttgaaattgcaacttcccctgcaagccaagtgaccgaacctgagatgtttgtattgtcagggcttgcgtattctacatgcctgtgtaatcctcaaagttctttcattccttgcttctaacctacccaaatccttctaatctcccaccatggttaattatctctgatgctcctgaaaggtgacctgctgctacattgtgacaaggtgatgcattattcttaagaggatctgtgcagattattatcccagagtgaggtagatgggggaggatacaggatatatccaaaaatgtgttgcaagctaattgatagagagagagagagtgtgtttgtatgtgtgtgtgtaagcatgcgtccatctttttcttacatatttgagccatagggaagtagagccatgtatattctcttcaaccaaattaacagttgtagacagtggtcttgctattgctttgactattaatggtattttcaagagctcagtgttacccccaaatgttcagtatcacaccttggctggtcagtcgtagctaaattttccttccaccttgcgccctgaagaaatttagaaagtcaccagctgacacagaagtttattgtaaaagttcactagtacgatagtatttggaccttggaaaatatttccccaccagaacagtgaaatcatgaaatcatggttgtcttctaagctcatccacaaaagtacagtttgactgtcatgcatttgagatgccatgtgcttaatcacgaaatattactgagaggaacactcttgcccaaccaataacggtgcaaagcagaaaaacagggcatttagctgggagaaaatgagtcgagatgtcagtgataagatggaaggaatgtgggtatgtgctgggtcttttagaactccagcagattgctctggaaaacagccactacataccaaaagtagccggtcatggtggcatgcgcctgtaatcccagctactcgggaggctgaggcgggagaatcacttgaactcgggaggcggaggttgcagtgagccaagatcgtgccattgcactccaagcctgggtgacagagcaagactgtctcaaaaaaaaaaaaaacaaaaaaaaaaacaaaaaaaacaccactccaacaaaatacttctccttcctcatatagtgtccctgcttccctttatgcctcaagaccacacattttgaacttgctgagctataagaagtgaatggagaggtgggacacaggtgcacagccttcagtaactgaaggaaaaaaaacagaagaaatgtctaaccctgagcttcctgagctcccttcagccacccagctgctgaggggcaggaatccagcagcaaggtggagagcagaaggcattcctgcaacctgtatgtgtgggtcattagtcccccacctccagcatcattgcagaatctgcaaatttaaaagtgcgttaggtaagagccttttttataagaggcccatatttttgctaatacataaaaacattgtgattagtcaaataaatgttcatttaaaattcacagtagcatgtgtctatttttttttttttttccttttagaaatgaggtcttgctctgtcacccaggttggagtacagtgatgttgtgatcatagctcactgcagcctccaattcctgggctcaaatgatcttcccacctcagcctcccgaattgctgggatgccaccatgcctggctgattcttttattgtagagacgggatcttgctgtgctgctcatgctgctttccaacacctggcctcaagtgatcctcctgccttggcttcccaaagtgctggaatgacaggcattgagccgccgtgcccagcctatgatttttcttagcattaatctctgtgtcattgcaagctgtctcccacgtccttgccttcattctacattgttttggtggaatggcctgtgctagcagacaagaccatccggtcgaccttgagcatccttccctgtcctcagggaaggtttcctgggcctcattttgttttctttgtataccagcggggtgcagctcatttgaatgagcttgcaggggagcatctgtgatagcatcatgatcagatgagacaaaactggcacgggtcctggtcatggttgaagacctttatgctcctgattctattgggtgtcttctactggtgaaggctcatgtgctcatgggaacacgggcatgctggtgtcttccgagtcctctccaaaaacaaagcccaggtcaggtacagtggctcacgtttgtaatcccagcacttcgggaggatgaggcgggaggattgctggagccctggagttcaaaaccagcctgggcaacacagtgagaccctgtctctacaaataacagtaaataaaaattagccaggcatggtggcatgcacctgtagtcctagctacttgggaggctgaggtgagaggattgctcgagcccgggaagttgaggctgcatgagccttacctgcaccactgcactccagcctggcagacagaataagaacctgtttcagaaacaaacagaccgggcacggtggctcatgcctgtaatcccagcatttctggaggccgaggcgggtggatcgcctgaggtcaggagttcgagaccggcctggccaacatggtgaagccccatctctactaaaaatacaaaaattagctgggcgtggtggtgggcgcctataatcccaactacttgggaggctgaggcaggagaatcgcttgcacccaggaggcggaggttgcagtgagccgagattgcaccgttgcactccagcctgggcaacaagagcaaaactctctgaaaaacaaacaaacaaaaatcccaaagcccttagttccaaatcttgcctcataccccacccgtcccatctttaggtgaaaacgttctttcattatcagtgcgtatctctccaaactgtatttgtaacttgtgctgagatgttgaatgcacagacgcacctcagtatcttctgttccttctttcatccctacccccaccttcctcaatctctcattgctgcgttttcttccattaatcaacacctttgtaaggagaagcacctcaggcaagctcccacaagcaagtgcttcgaaatacttcatttggggctttttaaaagggctaccttttcctagcaggtttgggatgcagtctgctagtttattgttaattctcaggcttaatgatagttccaggttactgaatcaggtgtgatctctgaagatgtgtgtgttgtaggttagttagttagtgctgccataacaaagtagcatagacggtgtggattaaacaacactgatttattgttttataatttttgaggctagaattttgagaagaacgtcttaacagggctggtgcctcctgagccctctctccttggcttgcagacgctgtcttctccctgtgtcctcacgtggtcgtccctctgtgtgtgtctgtgtcctcatctcctcttcttaggactccagtcctgttggaatagggcccattctagtgaccacattttaccgtaatcacctgtttacatgacctgtctccaaatacagtggatattggaaggacacagttcagcccatagcatactgttggctggtttattatgagaccatgatatttactattcattcatcccaagacaatgagaccttttacccatgtcccaggatacacatatcttaacatctgctgttgtctgaatacgtcctttccaaattcatatattgagacagtaacccccaaagctatggaattaaaaggtggagctttgggggaagtgattagatcgtgagggtgaagccgctgaacaggaccagtgccctcggtgaaggggcctgagggagcccgtttccccttggtccatgggaggacagcgagaagggcccttccctcaggaatgggcccttaccacgcagttcatcagcaggcgccccgacctcggacttccagcctccagaactgagggtaatacatttttcttatttgtaagaccccctagtatatggtatttttgtgatagcagccagaatggactaagacaacatctatgtaacatctgtggaacttgtactttaatgtccatctatatgcttatcccagtatctgattatacacctcttaacatctacacacgtcttagcatctacctatactgatgaattacacctttctatatgcagacctcagcacctgtctatacctgtagagtcacatctacacacacgcatatcctaacatctgtctgtatgcacaccttagcatctgtctatcacatatattagcatctatctacacctacatattaacatctacttccacccatatcctaatatctgtctgcacccacagagcaacaccggtctacacgtctatacccatatcctaacatctctctatacctctgttaatatctatctacgttcatattctaacatctgtctttacgtgtatattaacatctctctacacccatatcctactatccatctacacccatattgtaacatctgtctcttcctatatgttaacatctctctacacccatattctaacatctatgtccatatattaacctctgtctacacccgtatcctgacatccatctacacccatattgtaacatctatacgtatagatatcatctgtcttcacctatattgtaacattgatctctatccatattctaacgtctgcctacatccatatcctaacatctatacctacatattaacatctgtctacacctatattccaacatttatctatctgtattttatttgtctatgcccatacattaacacctgtctacacccataatctaacatccatctgcacccatatactaacacctgtctacatccatctacacccatatattaatacctgtctacatccatctacacccatatcctaacatctctctatacctacatattaacatctgtctacacctgtattccaacacttatccatatccatattgtaatatctgtctgcaaccatatcctaacatctatctataactacatattaacatctttctatacctatatgctaacatatatctatatccatatttaataccatatggtaacactgtttacacccatgtatcagccccgatgtacacccatatcctaacatctgtctctaagcacatcgtaacatctgtatgtacgtgcattcgaacacctatctgtacccatatattaacatccgtctttacccatgtgctgatatctgtgtgctccatgtcccgacatctgtccccagctattactgtctgtctgtacacacattttggtatctagctgcatctgtaccccaacacctagctgacggcgtaccccctgccctgccttggcggggccctgagcatgtgctgtctgtccccgcaggttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggtaagaggaacgtgaactccgatggaatctacactgcttggcaatgagaaaggtggtggtagttgtggcaggtcaggcagggaaagattgggaaccagagtttaactctcatgtgtaggagacacttgcaaccagggatgagagagccaggttgacccacagctcgttttaggtgggctgcgattgctggcaaagagccagtgggcaggaagtcagtctccttcactggcaccgtggaggaaatcagaacaccacatatccgctattgatccgaaatgatgaggaaatgagtcatatccaagtttgaattgccctgactataaaatagatctgcatcgaataggatacaatatctcttaaaattaaatgccaggtgctgtggctcacacctgtaatcccagcactttgggacgccgaggtgggagaatcatttgagcccaggagtttgagaccactgtggacaacctagtgagaccccgtctctacagaaatatatatatttaaaaaaaagttgattatggtggtggatccctgtagtcccagctacttaggaggctgaggttggaggattatttgagccccggaagttgaggctgcagtgagctgtgattataccactgcactccagcctgggtaaaagagcaagatcctatctcaaaaaaaaacaaaacaaaaaaaaaaaaaaaaaaaaccaaattgaatattccatacacacctgctcacacacacgtgcacttatttttttctgttatctatatttctattatgtatatatatatttccactatatatgtatattaaatagaaatatatataatactatattattgtatataacatatagtatattttatgtacatatgatatagtattatatatgtatagtatatattatactatatattatatagtatacaatgactatgatatagtatcatataggtatactatatattataatatataatatatattatatagcatacctatatcatactatatcatacatatcactatactctatatagtatatattatacgtattatatattacacatactacatatatatattatatagtatattatactatataatatatataatatatatattacatagtatataatatatatagtatatatcacatagtatataatatatataatatatatatcacatagtatataatatatattatatatatcacatagtatataatatatattatatatatcacatagtatataatatatataatatatatatcacatagtatataatatataatatatatatcacatagtatataatatataatatatatatcacatagtatataatatatattatatatatcacatagtatataatatatattatatatatcacatagtatattatatatattatatatatcacatagtatattatatatattatatatatcacatagtatattatatatattatatatatcacatagtatattatatatattatatatatcacatagtatattatatataatatatatattacatagtatataatatatatagtatacctatatcatactatatgacatgtatgatatatgtgtttcttttctggaaacacacagacataccccaaaacagtgtttgaacaaacatctgggcaccccacggcccatcaacacatgaaacaaaccattacatgtcgtctcagccagtgcgggctgcactaacacacactcatagactgggcagcctcaacagcagacattcatggctcacagctctggaggctggaagtccgagatcgaggtgcgacagattctgtacctggagggaaccagcttcctggttcgtagacggcgccttctcgctgtgtcctcacatggtggaaggggcgagggggctctctggggccccttttgtaagggcactcatcccattcatgagactccacctttgtgacctcatcacctcccaaaggccccacctcctaatcctatcactttggggatgatgatttcaacataggaattttggcggggggcacatacattcagcttataatacatgtatatgtatttttttttccatgattggattcatttaaccagtctgtcttgacaaaagaccacacactgggcattttaaagaatagaccttttcctctcactgtcatggaggctaaggtctgagatccaggtgtgggcagggctggttcctcctgaagcctctctccttggcttggagacgctgtctcctccctgtgtcctcacaggattgtcctctgtgcatgtctgtatcctcatctcctcttcttatgaggacaccagtcctcttggatcaggacccaccctagtgacctcgttttaccttaatgacctctttaaagatgctctttcccatatagtcacattctgaagttctgggggttaggactgcagcatataaggtttaagggatacatttcagcctggaacaagtatatatagatatgtttccgtacacacacatactccattgaggagaaaacagttatccttttttgtttgtttttttgtttttttttgggacgaagtctcgctctgtcgtccaggctggagtgcagtggcacaatctcggctcactgcaacctccgcctcccagattcaagtgattctcctgcctcagcctcccaagtagctgggattacaggtgcccgccaccaggcctagctaacttttttttttttttttgagatggagtctggctctgtcgcccaggctggagtatagtggcatgatctcagctcactgcaagctctgcctcccgagttcacgccattctcctgcctcagccccccaagtagctgggactacgggcgcccgccaccacgcccggctaattttttgtatttttagtagagacgggatttcactgtgttagccaggatggtctcaatctcctgaccttgtgatgcgcccaccttggcatcccaaagtgctaggattacaggtgtgagccaccgcacccggccccagtatgtagtcttttatctctcacccacctcccaccctttaccccaagtccttgaagtccgttgtatggttcttatgcctcagcgtcctcatagcttagctcccaatggatctttaatttacattcataaaatcaacagtcataaaaagtaaattcacacgcccaagctgctgaaaaatactcagaaagatttttggtaactacactgagtgtcagtttttcaattagattaaattaatgaaagtagaattagataatgacatccgttccttggtagacaagctacatttcaaatacccaggattgcacatggctatcggcttctgtcttggtcagacaagcctagaaaatacattttatatttccatattctttgatgtggtggggttgggtaaggtgataattacactaattatactcctaacattgtaaaaccgtctgcattttgagaaacttgatgtgggggcagttttacactaaatgactctcttctctggcagcttttagaaaagggctctcctaggaaaattttatgatgcgtttacattcaatctgattttcccctatagtatttcttgtactacatttccaaaaataaggcacatggaaattaggtgcattttacatggagtaggaaagatgcaggattttttaaaatattgatttatagcatctgtgctgccctctcttggcagcacacggtatattagtaaattcttttaaagtcattttatttgcaagtctaattcaaagaaaacagataaaatatttcatatattcacttgtttataagtttgacaaaccatgttactgtccagttaattcatcatatctatttaaatggacgaaaatggtttcgtatataacatgcagcaattattttacttaatgaacatgtgaaaatcttagaaaatgtctcattaccatattgatagattgcttttgcaaagaactgcatcttcctctgtatgggtagtgtagcttctggaaactttttttttgtgggggcttttttctcctttttttttttgaccatcattgtaacgaagcatctctctgctggcccggccccagggaagttgtgttcatgggggcagatacatggccctgcctctgattcaggattcaaacagtacctgtgccttttgaataaaactgaaattcaccactgtatcgtggaccactacagaatagatggaactaaacagggaggcctcatcttgaataatttttttttttttttttttttttttttaaagacagggtcttactctgtcactcaggctggagtgcagtggtgggatcttggctcactgcaaccttggcctcctgggctcaagcgatcctcccatttcagcctcccaagtagctgggattacaggcatgtaccaccacacctggctaatttttgtatttttagtagagacctggtttcaccatgttgcctaggctggtcttgaacagctggcctcaagtgatccacctgccgcgaccttccaaagcattgggattacaggcgtgagccaccgtgcccggccttgaataacatttttgaacatatcccagaaagaagtctgtttctcatttttctctcttttttttttttttttttttggagaggagtctcgctctgtcgcccaggctggagtgcagtggtgcgatctcggctcactgcaagctctgcctcccgggttcacgccattctcctgcctcagcctcccaagtagctgggactacaggcgcccaccaccacgcccggctaattttttgtgtttttagtagagacggggtttcactgtgttagccaggatggtctcgatctcctgacctcgtgatccgcccgcctcggcctcccagagtgctgggattacaggcgtgagccaccgtgccccgccatttttctcttatagcatggggtaaaaacatacttaagcatgttgtaatgtaatctactcactacatgaatttctttctttgttttttgtttcttttttgagacagggtctcactctgtcacccaggctggagtgcagtagtgcaaccatggctcaccacagcctcgaacttgcaggctcaagcaatcctcctgtctctcagcctcccaagtagctgcaactacaggcttgcacaccctgcctggctaatttttggattttttgtagagacggggtttcactatgttgccagggctggtcttgaactcctaaactgaagcagtcctccaaccttggccccccaaagttttgggattacaggcgggagctacggtactcagcctctccctcccttccttccttccttcctccctccctccctccctccctcctttcctctccctcccctccctcccttccttcctcccctcccctcccctcccattccttccccttccctcccctcccattctttccccttccctcccctcccattccttccccttccctcccctcccattccttcgcctcccctcccctcctctatcctcccctcccctcccctcgcctcctctaaccctcccctcccctcccctcccctcccctcccctagcaaccctgttaactggatgacttgtaccctacttattttaaaccactgctcttggtgacttgatttctgactttcctaggttgtcagtatgttcagatggtgttcttttgtgacttgcgttcaccaggctcttgttttctaacagcaatattacgtttgtattgtaaatattttgcacacacactttatgttatctagatagctcccctaaaagatttggtggcaaactagaattatttctggttttatgaaatggtcaaaataaaatactgatgtgtttaatttgattttataattcaaatgcataacacaagcatcccttacctgaaatacttcagaccagaattgttttggattttagatttttttcagattgtggaatatttgaattacacttacctgtgagcatccctaatttgaaaatctgaaatccaagatgctccagtgaggatttcctttgcgctgtgagcctcatgtcggtgctggaaaagtattgacttttggagcatttgggatttcagatttggattaaagatgctcaacctttatacatctgtctttaaaccataacagatggttttctttctctgcaacagctcttttttgtttgtttttggtgttttttatttctctgcgacagctttttgtttgtttgtgtttttttgtgtttcttttgagacagggtcccactatgttggccaggatagtcttgaactcctggcctcaagcaatccttccacctcggcctcccaaagtgccaggatggtagccgtgagccaccatgccaggtgcaacagctctttcctagttcctctgttgtagcattttaaatccagatgttacattgattactgtcctctggatttttatttctagccttatagggataacattgaacctagtctttcaaaattactacttacccctttcacacacacacacacacacacacacacacacacacacacacacacacacacaggagtagagagagtaattcacattgaaaccttatggccccatcacccagcttcgattgttatcaaagctttgtcactttgttttttttctctttgcccatttgtttcttgagttattttaaagcaggtgcactttatcctatctttaacagataactccctttaaaaaagaacttcagtgccattatcacatctgacaactatttaaaaaaaaaaaacccagcctgggtaacatagcaagacctcatctctacaaaacatcaaaaacaaaaaaattagccttgcataggttaaatccagccccctatgtgtctgttaataaagttttattggaacacagtcacatcttgggggcttttgagctaccgtagcagagctggatatttgtaacagagaccatgtgattcacaaggcctaaaatatttgccgtctggctctttacagaaaatatttgcccacccctgagccaggccatttgctttgtgaactggttaaaattggccaggagctctgtctgtgcagtggaatattatttggccttgaaaaggaatataattctgacacattctacgcgttgataaaccttgaaaacatgatattggacgaaataagccagaccaaaaaggtctcatgtcgtgtgattctacttgtaggagggccctagattcttccaaatcataaggacagaaagtagaatggtgggtgccaggggccggggaggtgcagggaaggggaagatgctgtttaatgaggatggagtttctgtttggaatgatgaagaagttccagcagtggacggtagggagggttgaacacgaaggtcagtggacttcccaccaccgaactatacaattaaaaatgcttaaaatggaaaattctatgctgtgtgtattttaccacattagaaaatcatacatataaaatcataattatgtatataattataaataactatataattgtaatatttacacataaataatatatccgacattaaatttatatatttaaatatatttatctctttaatatattaaatattttagtatattcatatataaatttaatacataaagatattaatgtaatgtgttaattactaatataacaatgtatgtatatattaatatactaatatattctaattataattatatattaaatatgtaatttttagttaaacataattatatttaaaaaataatttaatacaattaaatatataataaatggatacagttttatatttaatattacatatttaattttataaacatggctaccaaataattatatgtgctcataaattatggtataaatatgtttagaaagttatatgtagctataattatacattattatccatagttttatatataattttataaatatatatttatttttaaaatttaaatttatatattagtatgtgttacacatttagtgtttagattataagttcaaatttaaacatatacatttataaatacataatcgttttatatatatttcataacaccagaaaagtctttctagttactttagaccttttcccctagcttcttactttgagtatttaacggaagtcaaggagggcctgagatgtcgagtctgtttgcagtcggtgttgttactttcccttgagccccttttaattttgctgtagttcatactaggacgtgggtattactgtgccgaggttggtgacaggcacccttctccctgctgatcagtggtgcctaggagccattgtcaccgaggaaacccctcccagggcctgggctggccatcggaagctgtcccatgctcgcaaacacacaccttctcccttcacgggcctgaaattctcaactgtttgtccccatcagacagttctaggaactgtgattgtgtccccataaaaaaaaagatgacaaaatcttccctttttatgaaaaaccccacaccctgctgctttattgcaacccaagatcctataagaaaaggcaatgtagtattttcaccatgagtactgagcgaacatctatttcctgcattaccaaacccagacaaaacactggctcatacttttctgataaaaagggaaaaaatgcatttgtatctgtaatcaagtgtaaaagctgtaatcagctgtccttcctcctgagccctaccatgcccctgttagctgagtgacatgctcaccatgtcataaagccatgaggagagacagaaagtgaggctggtgacgccacctgctaggacgtaagagggactggactgaaactcagcttggagatgtcatccgtttctctctgtctctctctctttttttttgagacggagtctcactctgttgcccaggctggagtgcagtggtgcgatctcggctcactgcaacctctgccacccaggttcaagtgattctcctgcctcagcctccggagtagctgggattacaggtgcctgccaccgcgcccagctgatttttgtagtttttagtagagacagggtttcaccatcttggccaggctggtcttgaactcctgttcatgatccacttgcctcggcctcccaaagtgttgggattataggcatgaaccaccgtgcctggcctctttttctctttttattgtggtaaaatacacttaaaatgtaccatcgtaaccatctttattaacattttttatgtttcagaatagggtcttcctctgtcagccaggctggagtgcagtggtacgatcatggctcactgcagcttccaatgcctgggctgaagcaatcctcctccctcagcctcctgagtacttgagactagaggtgtgagccaccatgactggctaactttgaaatatttttgtacagacagggtcttgctatgttgccttggctggtctggaactctgaggctcaagtgatcctcccaccttggcctcccaaagcgttgagattataggcatgagccactgtacccagcctgtttgaaccatcttgccgtgcacaattgagtggcatttattgcatttaccatgtcgtgcaaccatcacctctctctagttccagaacattttcacgatcccaaaagagaacttgtatctgttaagcaattattccccatcctaagccaggatgatctcatcttaacttgattgcagctacaaagatcgtgtttgcacataaggtcccactcacaaatactggggtttaggactttggggggtgcacagttcaaccagtgcaggtgtggcggaaggcgtgggcattaagaacacaggagtcattggatatctatactttatagataatcctatccttagctctgtttctccttcgttaacatggcctcctccctcccctccccccggccatagtgaaactaagaacagtgagaaaactgagaacagcaggtgtcaccttccttctacccaaaagccaggtgagcaaaaggagacaggagcagggaagtggataattcactgcccagaccagtggtctcgacataacactcaggctgtctcatctcatattcattcacgcagtcagcatctctccatagcagcgtatgtctctctgtacattcagctaggcgttggggctttttgcaggaaggagtgactctaacagggcaggagtcctcctgaggcaagttagaacctggatacttatacagcctcatacaacctcaggtgtgtgtccttaccctaacacggagccaaaaagagcctcatctttcaaaaggtaagtggagaagttgcagctaatgcctgtagcatgacctgtggcctctacctgggcttcatatcagctaagatctaggcttttagctactttcaggccactttggatgggctagaaaggtggaaatacaaaactagcaggccagtaagtcgctcgtcttgcagaatgacagaagtgtcgtgcattgaagcagccagggtgtacttggagttgattcaactgctgggcagggcaggggagagcgtgtttctaaaatagtgcgcattgtactttccatttgtagacttaattctaatgagtgagaagcacttaacaggaccacaaggtggtccctgttccatacttagctctaacctgcagatagagagtaagtcccttccacatgcttccatgggaggagaactcaatttctctccttgtcttctttcctggtttcctgatttatatctgctacatcctgcagtaattttttttttttttttttttttttgagacagtgtcttgctctgttgctcaggctggagtacagtgacactatcatgctccctgcagtgttgacctcctgggctcaagtgatccttccatctcagcctcccgactagctgagactacaagtgcacttcagcacacctggctttttttttttttttttttttgtaaaggagtggtcttgctgtgttgtccaagctggtctgaaactcctagcctaaagcaatcctcctgcctcaacctcccaaagtactaggattacaggtgtgaactaccatgcctgaccttgtggtacttttatttcatggatggccgacagaatttgaaatttggatggcagccagtttgttgttatcccaagggcttacagattagtgtggaaaagtctgttgtctggaaagagatggggtatggaggtgtggtggggaagggaaggaaagataacagtaacaacattttgggtgggttcctgcaagcaggaagctgaggagctgaagccaagatacgtgcccacaccactgcaaacagtgcggactcaggcaagatgtgctgggtataaaataggctttgcacatgcttgatacattgtgcaaagaacttgagagtggataaacatgtatattaccagactctgtggaacttgttttttgttctctttacattcaacttacaaaataagggtttcttctttcattgatctgagtggtgggagggaagggtcttttgcaaagcatctatatattttttccctctgagggtgttgcttctttctgcctgtctacagacaggctccacacaccagggcagcacttggcaggaagggtggatgtggcccgcatttgtgctacaggtctgaattgctgaaagcccgaagcgacattctacccagcagtagagcgccaatggagtacggcccagacaaggccccctctctggggttactgatactcagctcctttccagcccatgagtcttccagcttctgctgcagtccttgttatcttgccctgactttatttagcagattcttctgtaaccaaaatgcaggttcagccgctcgccgtttgcagagtgcaattagcaagagcgaggtctagtgtaaagaaagtgattttttattccagagctttcttaggggaagaagtacaggcttcctgcttgaggccacccctttgcttttggagcacaaagcaggcacctttaaaggaaaatggtatgcaggggaggaagtgtatttctgtctttacactggtttccagggggcaagaaatgtttttttggggggtgggggtgtaaagagccaaagagaacatacgtaagctttgcaaaccatccagtctcagttacaagtacaaacccagctcttgcacctttttttttttttttttttttttttgagagagagtctcactctgtcgcccaggttggagtgtaaagtgcagtggcgcattcttggctcactgcaacctccgcctcctgggttcaaacatttctcctgcctcagcctccggagtagcttggactataggcatgcatcaccatgcctggctaattttgtatttttagtagagatggggtttcaccatgttggccaggctggtcttgaactcctggcctcaagtaatctgcccaccttggcttctcaaagtgctgggattataggtgtgagccaccatgcccggcctaagcgagttcttgaattattcttttcactgccacttttttttttggataaaggattttctttttacttaattttatttatttatttatttaaagaacttttaggttcaggggtacacgtgcaggtttgttacatgggtaaactgtatgacacttggtgtactgattattttgtcacctgggtaataagcatcatacctgacaggtagattttccatcctcatccttctcctgtgcttctccttccagcggccaggtgtctgcttttccccctctctgtgtctgtgtgtccccagtgtttagctcccacatacaagtgagaacatgtgagtccacttaggagaatggcctctccacctccgtccatgttgctgcagaggacatgatctcgttctttttcctttaattaattaattttattctttatgatttatactaaggtataaataactcaaaaaaaatgaggtttttttttgcttctgagtaacagtggtaacagtaccagcaacaggagcaaggatgataaaaccaattcttagcttccaagcccgttaagaaatgtttctatggaaaggaatcagcgaaaacaatgttactgtctttacacattaaaatatgtgcacaggagggtaaacggagcgtggttttactcaacgaagttattgtaacaatcagagcttctaaggtgactgcattagccaagcaccactgagtgttgtgggggcctgtctctgtcgcccatataggacttggaccctctgtggaacacccgagtacctagcccccgaagtcattcagagcaagggccacggaagggccgtggactggtgggccctcggcatcctgatattcgagatgctttcggggtaagtagagtctctgtagagaatcttcatcttacaggccagcacccccttcccccacccattcgtccactcggcatttctgtaaccttgaaaacagtacgtgagtgtcgcaaacacacagtgtggctgcacacacatctgctgccctgctgaggttggcaatgtgaattagcaattgagcttgtgtgaataagaggcaaaaaacccaaacttgtgaaggaaccacccatgcatgcccattgagatttttatattgaaatatccatatcttctttaaatatacaattaacattctgggctgctctgaaggtagtgagttatctcagttgattttcacagtcagctacagattgaactccttgctctactcttttccccccttatcacttctgcgcttgtttagtcttaaaaagaatttaaaaattaaattaaaaaatgaatcttctgcacagaccctttctgaagtaacctgcagagctcaggggggcacaggttgggtcaaggtaaatcagccaaatacagttcagtggtttctggatgaacagctggcaaggaaggcgagaatatgttctttcctaaaaccgtatgtctgtggtacaggaaaggggtcccgacccacaccccagcacagggttcttggatctctcgcaataaagaatttggggaaagtccataaagtgaaagcaagtttattaagaaagtaaaagaataaaagtatggttactccttaggcagagcagccctgagggctgctgtttggctatttcgatggttatttcttgactatatgctaaacaaggggtggatttttcgtgagttttccgggaaagtggtgggcaattcctggagctgagggttcctcccctttttagagcatacagggtaacatcctgaccttgtcatggcattcgtaaactgtcatggcccttgtgggagtgtcttttagtacctaatgcattataattaatgtataatgagccatgaagacgatcagaggtcacttgtcgccatcttggttttggtggcatttggccggctttactgcagtctgttttatcagcagggtctttgtgacctgtatcttgtgctgacctcctatcttgtcctgtgacttagaatgccttaaccgtctgggagtgcagcccagtaggtctcagcctcattttacccggcccctgttcaggatggagttactctcgttccaacgcctgtgatacctgtgttgggtgagatttggaagtcaggagaggtgccatccaccctgcaaccacataacagaggtcggtcatttgttgggacgtcagcatgattgagtgttcaagtctagcatatgcctgagacagctccactatgactagaccagaaacgcaaaggaagcacgcaacacttggaaacccaggacgtgggcgtcatcctcgttccgttgttagtgctaagatgacacagtagcgtggcacttttccagataggaacctgtaggaaggagtgagctacgtgtcagaggaactgttgcaccatgtggctctgcacgaaaggctcttctctctgggatgaagacgagaggaagcccagccagcgagggcccagaacaccggttgggggagcctctgccgcgctttgccacagccgacactctgcctcctaggttctctcttttcctgtttccttctttcttctgcttgcccctgagtctcaaagacagacaccagcgtatcctctgagtggcctccattgtcgcaaaagccagatcctctctcacatctctctgattccctgcagggggtaaagaccagagttttactggggaaccttccctttcagttggaaacaaaggagggaaggaagagaggcattctcctgcctggaaggcgtgtctaagccaggtcctgctggtggggagcaccgagcgcttgttcctgggggtgtggagcatgtgacattctaacatccacctcaggaaatccaggcagtcgctgactttgtttggggagcagacaggggtcatcgtcccatgtgcttatctctgccctcttttataaagaaagtgaatccgttaattcccacactagcttagggatcagaacgatgttgaacaagcactaccaaagaattccaccacaaaaccggagcctgagatgccgcaggaggagagtggaacccgtaaaaacctgtatttcattgtctagctatccatgtgtattgtttatcatccatccatccatctacccacctgtctatttatctatgtttatatacttttccatccatccacccacctaccccccaaccccttcatccatccacccacccaccccgtcatccatccacccacccactccttcatccatccatgtacccactcccccaccccctaccccttcatccatccacccccccaccccttcatccatccacccccaccccttcatccatccatgcacccacccccccacccctctaccccttcatccatctaccaccccaccccttcatccatccacccccaccccttcatccatctaccaccccaccccttcatccatccaccccccgacccccccaccccttcatccatccatccatccatccatccacccacctaccccttcatccatccacccacccaccccttcatccatccacccacctgcccacccaccgcttcatccatccacccaccccttcatccatccatccatccacccacccttccatccatccatccatccacccacccacccacccacacacctatccctgtctatctctatggtctacctattttgtaagtatgtatgtatctgtttatccatttatccttatctatcatctaagttgtcatttatatatttatatatccatctctctccatctctttatctctacgatctttttatctgcctacctacctgttatctatgtatttacctatcatctatctgtcattcatgtaccaatctatccatctacttcctatttatctatgtgcctatccatctatttatcatctgtctttctatgtaactgtttacctccctacctatccatctatcaatcatctatctacctattcatctatctgcttttctatatatctatgtatttatcaatcatctacttacctacctatccctctatctctacctttctgtctatctagctatcaataatctacctacctaccggcctgttggtcttttgaattttccattactctttgctgagacatgcctacaagtcatatagaaccaaacttctcaatatgcaccctagcccattatgtcctaggcaaacccaaaaggttaaaaataacttaggcatattgatcagcgtccacccaaggaaaagcaccacattttccttcggtgataacactgaccacacgagggcagcattgcctgaggatcgttgtatcctgtagtctaatggttttaaatagagtgaggttcgtgtgccccaaattttattgattctaggatagagtagactattattagaatacaatatactattaggacataatattgttagaatacaacatagaattattagactataattaaaacagaatattagtctcagggtacgctgaagttaaaaatacataaaaatacatttaaaaagaatagaatattacactcttagaatgactgtattcgaattatataaagttaccagaattgttaataggctataacattggaatatttaaatatattagaatacaatagaatagaaaataacctaattgtaatgtaataaatcattaggctaattgaaaatgaataattaggccaggcaccatggctcacacctgtaatcccaacactttgggaggccgaggtggttggatcacctgaggtcaggagttcgagaccagcctggccaaaatggtaaaaccccgtctctactacacatacaaaaaaaagccaggcatggtgcctgtaatcctagctactcgggagtctgaggcacgagaatcgcttgaacctaggaggcgggtaggttgcggtgagccgagatcgcaccactgcactccagcctgggcaacagaggtgagactccatctcaaaaagaaaaaaaaaaaaaagaaagaaaatgaataattaaattaaatgaataaccgtctcccaatcaaagcccagtctgctgacctgtgcatttcatgaggcagggagctattgattcacagtaagcctatttttattttccttttttctaattagagtctatttctgggtgaatattgttttttcaatttctcagcagccctgtgtctcttcacatgggtgggtgtcttgagagttaccagcttcgccgaccccaactctcccaggcattcctgtgctcttccccagctccagccggcctgagctcgcctggaccaccccaagccttctcagtctcctgcatcccctcctgcctgcagtacattttcctggaagcagctgcaggcatcctgtccacgtacccatcagctgtgtccctattccctgggagcccgcttgttgcttcccggatgactggagcagaatcggaggctcgttatcatatgaggttctgagacggtctgcctgtgggttgtccacccctcttagacaacagcctggcccctccttgtcttcccactgctttttaaacgtgccaggaagcctgacctgtccccctgcccaaaggctggcttccttcctccttcttttctttttccctttcctttccttccctttcctttcctccctccctccctctctccttccttcctctctccctccctctctctctctctctccttcctcccttccctttcccttcccttcttcctttccttttcctttcccgtctccctcttcctttcccctttcccttttcccctttcccctttttcctttcctttcctttcatttcctttccttcttcctttcctttctgttccgcctcgctctgtcacccaggctggagtgcagtggcacaatcttggctcactgtaacctctgctttcttgtctcgctctgtcacccaggctggactgcagtggcgcaaatcttggttcactgcaacctctgcttcccaggttcaagcaattctccttcctcagcctcctgagtagctgggattacaggtgtgcgccaccacgcccagctaatttttgtatttttagtagagagggggtttcaccatattggccaggctggcctcaaactcctgacctcaagtgatccacctgcttcggcctcccaaagtgctggggttacaggcgtgagccaccacacccagccagggctggccctttctcttccactgcacatgctgcaggctcacctgtcacctgctcccacagccctctggggcctcccctgttctcctgggccatgccctgtccgaccagcccatctgttttctttatactgattagcagctctgaaaccatctaaattttgtatgtgttgactgcctctgagagcaatgctcccaagctgctctcctcacctccttgaacccagaaacttctggtggctggagggagggcactgctgcacatacaagtggagccggcctgcagtcagagtcttcctgctcccttcgcagcctgtgtctgcacctttcctatcgcagctccatttgctggattcccactcttagcaggatcaagtgagactgtgccttgtctgtgttattgctttaagtgattatctcaatcttccactaagcacagggaaaaccatctatttggtaaaatctgccatgtgattaggaaggagatcatatcatgatgcagattttattttcatggaatgagacatgtttaggtcagatgaaaattgtgtggcacattctggaacaaaatcactcatgcactttccaaggacccaagctcagctccgatttcttccatcctattctctttcctcatccatttctgtggttttattctcccagagagtttaactcaagagtcaggtaaaggctggacgtggtggttcatgcctgtcatcccagcactttgggaggctgagacagaagaactgcttaagcccaagagttcaagaccagcctgggcaacatagtgggaccccatctctacaaaaaataaaaataaaactagctgggtgtggttgtatgttcctgtagtcccagctactcaggaggctgaggtgggaggattgcttcagcccaggaagtcgaggctgcagtgagctgagattgcaccagtgcacatcagcttgggtaacagagcaagacactgtctcagaaaaagaaaaaaaaaaatcagctaaagcatcaagaacaaaacacagggacacacaagacatacagcagagtgcagggtaagagaaagcccctgggccatcttgtcttagttgtgacagcagtgattctcaaagtggcatcccagaggactatggggttcccgaagtgtgtttcagcagatgagtgagatcatttttccaatgacagatctgaatagtgatgaattttcttcataggtgtcaactaagacaatacagcatagcagacagggtgcagaagatcctagagaaggtggaatttggctgcagtggagcctcttccacggggagcattaggcattgcgcagtggttctcaaacatgttggcctcgggaacccttcaacacacagctcaaagttattaacaacccacagaactttcatttctgtgtgttacagctgtccgcgctgactacatttgaaattaaagtagagactgaaatataaaccaacagaatacataaataatatatatgagaagttaaataatcagaggagaacataaatagcatttttaaatgaaaaaaatgtgtaaccacactttctagaattaaaaccattcaggctggacatggtggctcacgcctgtaatcctagcacttcaggaggctgaggtgggaggatcacttgagcccaggagttggaggccagcctgggcaacatagtgagaccccatttctacaaaaaataaaatgaaataaataaaccaattagctgagcatgatggtacacgcccagggtcccagtactttgggaggctgaggtgggaggatcactgaggctgggaggtcaacgctgcggtgagctgtggtctcgtcactacactccagcctgggtgacagagagaccctgtctctaaaaagagagaaaacatttgtgaggaggttggctgtattttctgggttttgtgaatctctttagtgtccagctttcacaagggctgctggcctctcctccctctgtctgcagcctgtctgctgtgctgcgtggcacgttgtttagttgaggcataggagaaaattcatcactattctgaactggagtcagaaaaacgatctcagccatccctaaactgaggtcgggaagccaccctgggactccactttgagggccactgctgtgatgcccaagtcaacgtgcccggggctatattttcaccctctactctgccccaaccctcacacaccccagtgcctgctccttccgctttaactggccctcaagttcccctttctcatctcccacctcagcctccctgattcatctgaggagcacagattttatatttatttattaattattattattttttttctttagagggacccctgctctgtcacccaggctggagtgtagtggcgcgatctcggctcactgcaacctctgtctcctgggttcaagcaattctcctgcctcagcctgccgagtagctggggttacaggtgcgtgccaccgtgcctggctaatttttgtatttttagtagagatggggtttcgccatgttggccagcctgctctcaaactcctgacctcgagtgattcacctgcctcagcctcacaaagtgctgagattacaggtgtgagccaccacgcctggcctaaattttagtttttaatctgaaggtatcgggacaaggatttttgaggaagaagtcaaggtgggatgaaattctagtgaaattctagtgacggctttcttcttttctctaaaaacctctgccttccttttcttgaatgcatttccaaagcacctgtcttccaaggccagccccggtcctcagaactggagcaggtagtgtgtcagctgatagtttaggagggtgtttttccagctgagtaggagggagaacatcagctcacagcgcccagggtatctctgcctgcaccatccactttactggaagatgtaaataggcggaatggttacattcaaattttactggcaaatgatagagctagtggcacaattggtgtaaatttttttcatttttctttttttgtttttgcagacagttttgctctgttgcccagtcaggagtgcagtggtgcagtcacagctcactgcagcctggacctcctgggctcaagcaaacccccacctccgcctcttgagtagctgggatgacaggtacacgtcactgtgcctggctaagtttttaaaatttttttgtagagatagggtcttgctatgttacccaggctgatttcaaattcctaggctcaagtgatccacctgcctcggcctcccaaagtgctgggatgacagccgtgagccactgcatgagcgttttttttgttttttttttttttcttttgagacagggtcttgttctgtgtccagattggaatgcagtggtgcagtcatagcttactgaagcctcgacctcctgggctcaagcgatcctcctgcctcagcctcctgggactacagaggctgtagctggggaccgcagaggctgtagctgggaacacaggcacacaccagcacgtccagataatttttaaattttttgtagagacgaggtctcactgtgttgtccaggctggtcttgaactcctgggctcaagcagtcctcccgcgttggcctccccaaatgctgggatgacaggcatgagccactgtgcctagcctgggcatgaatttttcaggcgaaaatctggagcttgcattcatgctgattagcagattgtccttgcaagtgtagctgtcaccacagatcaatttaacttgcttaataatgccaaatgccatataatgagaatttattctccacttggtaagaattggaagcagtctgtatgtttagagacagaaatttgagggtttcagagggcactgcccaggcgtccgggggagtgctgtttctcagacacacacacacactgtctctgctttttctttcaggcaagatcatcagttagtgctcacttattatttatctttttccgcttattaatacctttcccatgatcttatgtaatgtctactgtccaagagcacttcgtttaatattctccataaatgtttttaggtatgtatggcacatttcctcctggagtttaatgctccattcctgtatttgtgcattattcacacagctgagtcgccacccaaacccagagagaaacaggaatacaactcccccaactactgttacagagaacgctgcgggcaggtgagggaggacgggctcgggaggttgttaacgtctgaggcggcagggttggcgcagatcgcatgagtgtctgtactcagagctctgcttcccagcctggcctgggtggtttttcagtacgttgtggtggctcgtaactccaggaccagcggcccaaagagataccctattgggaaactcaccttcatgctaaagtgcaaaacaagcaactgaaatgttatttaagaaggaagaaatgctgtgttagggccacgtcgcacgcacctaatcatttacctttctctggtaactttcatttcctcatgtaacccacccccacttctctgtcacctctcccattgatttccatttttgtacttcgtatttctcctctttgtttttctttgaatttttctccactgcagtgtattggacagttcatgtgtgtagttctacgtatgaatgtcctgacgctgctgttagaaactaccacagactgaaaggtttaaacaagagaactttatcctctcttagtccgggagaccagaagtttgagatcaaagtgtctcaggactgtactccagggaaggatcctttctgcctctcccagttcctgggggctccagcatccctgggcttgtggccacatcactgcagtctctgcctccaccttcatgtggccttctcctctatgtctctgtctcctcttcagtctcttagaaggaaggccacctgtcattggatttagggccatcctaatccaggacgatctcatctcaagatccttcaattaatcacatctgcaaagaccctattgctgaataaggtctcattccaggtctgggcattaggacgtggacagatctttctgagggccacagttcaatccactacacgtgtatccagttccctctggaggctctaggggaggatactccctgcctctcccagctcctgggggctccaggcatccctgggcttgtggccgcatcactgctgtctctgcctctgtccccatgtggccttctcctctgtgtgtgtgcctcctcttgagtctcttatgaggatacctgtcattggatttgggcctaccctgttccaggatgatctcatctgaagctccttaattctatctgtgaaaaccctgtttcccaataaggtcccattcacaggttgttggggtaagatcatggatgtatctttttggggacctctcattccgtccactccactgaattttgttaaggtcaggaagtgatttggaatctacaggagaattatttttgctcatggacatttctgataatcaatgagggtgtcatttgaaagctccgttttataaggtatttccgttgctagcatacctgaattagaatatcttaagtcaaaagaagctaaatggaaaacatgactttgagccaatatgagtatctgtcctgatcaatatgagaaaatctcagaagtacaacttgtgccacggacatgtaagtgtctagtatacacttactggttgatgaaatggtttggctttgtgtccccacccaaatctcatgtttaaatgtaatccccagtgttggaggtgggacctggtgagaggtggttggatcatgggagtggtttctgacagtttagcaacattgccctagtacagtctcatgatagagttctcaggagatctgatggttttaaagtgtagtacttgcccctttgctcgctttcactcatctgccaccatgtaaatgtgccttgcttccccttcgccttccaccatgattgtaagtttcctgaggcctccccagccatgcggaactgtgagtcaactcaatctcttttcttttcttttttgttttttgagacagagtcttgctctgtcgcccaggctcgagtgcagtggcgtgatctcggctcactgcaagctccgcctcccgggttcacgccattctgctgcctcagcctcctgagtggctgggattacaggcttccgccaccacgcctggctaattttttgtatttttagtagagacagggtttcactgtgttagccaggatggtctcgatctcctgacctcgtgatccgcccaccttggcctcccaaagtgttgggattacaggcgtgagccaccgcacctggcctaaatcttttttctttataaattacccagtctcaggtagttctttatagcagactgaaaatggactaatacagttgacttctagatgttcttggatttatcttggtctttgcagttttaagtatatatatttttttagtttgtttcacatattttgaacatttctaggtattagtaaagtctgctggtttctgcagcaggactgtaatctttttactacagtcaacaaagcatagtatgacaatcttgtttttacacatgcaccattttcaaggctgtatttgcatgtatttctgtctttttcctggtctccaggggtcaagaaatggttttcttggggcaaagagcttcggtcagctttgcagactacccagtctcagttacaagtacagactctgctcctgcaccttaaaaagtagtcacatagtgagaccgcatccctatagaaagtcaaaaaattagccagacatggtggcacacacctgtggtccccgctacatgggagcctgaggtgggaggatggcctcctgggggaggtcaaggctacagtgagctatgattgcaccactgcactccagcctgggtgacagagtcaaaccctgtctcaaaacaaaagaaaaatatgatatctcaggctctttcatttggcctgtacacatttattgagcacctgttgtgtgccacatactgttccatgaatgaggaatataaagaaattcagtaatgggtgtggtggctcacatctgtagtcccattactttggaaggctgaagtgggaggatcacttgagcccaagcgtttgagaccagcctgggcaacatagtgagaccttgtctctaccaaaaattaaaaaaaaaaaaaaaacaaaaccctggcgtggtggtgcagacctgtagccccagctgctcaggaggctgaagtaggagcatagcttgagccctggaggtgaaggctgagtgcactgagccaggatcacgctgcagtactccagcctgggggcaacagagcaagaccctgtctcaaaaaaaaaaagtagttcactgacattcacttgcagtttattgaggatgccttatagtgccgtgcaagcaggctcagtaccgggctggacataatcaggtattgctcgtgctgtagagtgaaggaagcctcgagaaaggtgtcctgttcttggccatagtggcgtattcaccactgtaaactttattttaacaattattttatatttcatttcatttatgtactccatctctctctgtcacccaggctggagtgcagtggcacgatctcagctcactgcaacctctgcctctcaggttcaagcaattctcctggcccagcctcctgagtagctgagattacaagcaccggggaccatgcccagctaatttttgtatttttagtagagacgggtttcaccatgttggccaggctggtctggaactcctgacctaaagtgacctgcctgcctcagcctctcaaagtgttgggattgcaggcatgacccacagcatccagcctattttatattttattttattttgagacaaggtctcactctgtcacccaggctggagtgtggtggtgtgatcacagctcactgcagccttgacctcctgtgctcaagcgatcctcccccctcagcctcccaagtagctgggaccacacatatgcaccaccacactcagctaatatatatttttttaagactgggttttgccatatttcccaggcttattttattttttaaattgacacataataattgtacatattcatggggtagacagtgatgctttgatacaaagaatggagtaatcagatcagggtaattagcatatccatttcaattatttaccatttctttgtgttaggaacattcaatatcctctatgtatttgaaacaatacgacatgttattgctaattatagtcaccctacaagactatagaacactggaacatattcctcctatctgcttgtaattttgtatcctttaacaaacctctccctatctctcacttcttcccttcccagcgtctagtatcctctgttcttctttatcctttcaggagatcagcttttttttagctttcatgtatgagtaagcacaagtgctgtttaatgttcttttcctggcttatttcacctaacataatgtcctccagtttcatccatgttgctgccagtcagaggattgtattccttttcatggctgaatagtattctactgtgtgtagataccaccttttctttacctatctgctcatctgttgatggacatctacgctgattccctatcttggctgttgtgaatggtgctgtggtaaacatgggcgtgccgatgtctctccagtatcatgacttcctttcctttgaacagatacctagtaatgtgatggctgggtcatatgggagttctatttctagcttttctgaggaacctccatactcttctctatggtggctctactagtttacgttcccaccaacattgcgtaagagttccctttttggccaggcacagtggctcacgctggtaatcctagcactttgagagaccaagctgggtggatcacttgagcccaggacttcaagaccagcctaggcaacatggtgaaacccccgctctacaaaaaaaaatacaaaaattagctggcatggtggcagatacctgtgatcccagctacttggaaggctgaggcaggtagatcgcttgagcctgggaggcagaggttgcagtgagctgagattgcaccgctgcactccagcctgggagacagagcgagatcctgtctcaaaaaaaaaaagagttcccttttctccacatcctcaccagcatttcttatttttgtgtgtatgtgtcttttttttttttttttttaattttttttgagacagagtttcactcttgtttcccaggctgaagtgcaatggcacgatctcggctcactgcaacctccaccttccgggttcaagtgattctcctgcctcagcctcccaagtagctgggattacggacgcgtgccaccacgcctggctaatttttgtatttttagtagagatggggtttcaccatgtcggccagactggtctcaaactcctgacgtcaggttatccacccgcctcggcctcccaaagtgctgggattacagtgtctttttgataatggccgtcttaattgggttgagatgattgacacctcattgaggttttgatttgcatttccctgatgattagtgacgttgagcattttttttcatatacatgttggccttttccatgtcttcttttgagaaatgtctgtgaagaccacctgtccattttttaattggagtgcttatcttttcgctcttgagacatttgagttccatgcttggtcatggtggtggattcaccccggtaaacatgagagagcattgctgtccagtgtttagtgcacagttaaggaatgggctggtggcccctcaataagatgcccaaaggagttgccttctgctcagcagacgcctctcaaatggtctttatattctctccaagggagcttcccctgcatcggactgtggcacacgatgccttgcctcttagaaccatctgactgtcacgtgctttcagatcgtgacaacttcagtgtgcggggaagagcatgtgaaataaattaccttctgcctgtgtgaagcagaaatagctatcgttacaaagcagggatttttttccatgcttactccccactaaaaatacatgtttgtttttctaacaggtttcctccgttttttgatgacaacccgtttggcatttatcagaaaattcttgcaggcaaaatagatttccccagacatttggatttccatgtaaagtaagtaaaccgtttgcctcatcatgaggtgtgtttatttttaaagtgtctaaaatcaccgtgaaagcacgcactcagcaggataccatattgtgttattaaatgtgctgcgcataaactattttggacagttgtcttttccacaagaaaagaaaaagattttcagtattctactttaatgatagcttcacattttaatgagtcttggccgtattgtgttcttttggtggtatgttatatttaaaatgagccaatgaacgagtttgtcatcgtattttataagagagcagttttggaatttgacaagaaggatcctcctagttctgtggctaacagaactgttgatgggtttagcagagttttatcctttctctcctgcttaaattatgctcaacctctaagtcctttttaacgtcaacattttcagttctgagcatgttgcttcaaggatatttacagttgctggatattggcaactttggatgcacattttataaaggtcgtggcagtagggaaaaaatatattattttcttaaatataagaacgcggctgggcgtggtggctcatgcctgtaatcccagcactttgggaggttgaggtgggtggaacacgaggtcaggagatcgagaccatcctgggaaacacggtgaaacctcggctctactgaaaatataaaaaattagctgggtgtggtggtgggcgcctgtagtctcagctacttgggaggctgagacagcggaatcgcttgaacccaggaggcggaggttgcagtgagctgagatcgcaccactacattccagcctgggcgacagagcaagattctgtctcaaaaaaaaaagaatgcttttggttttctggctaccttacccaatctggtcaactggtagccatttttactgtaataagcactgatttctgtttgtttcactgtatttttcagatgagttgatgggtgcaccagccccctgggcacaaactagagctaaatgcatctagttgagaattaaacttttcttttccatggtctattttcttatgagccggtggaagttcagttcagagaagacttatttcagggcgatggagcaggttgttttgaatatgccccttatggggccactggctacgttcagttgagtttcttggtggtgaacgcaccccatcctaaccagaggttcttagtctgaacagaagataaggtcgtgttttattggcttgagcatgtgttgtgtttgacacactaagaggcaggctttaaaagactttagcaagaaaacgaggctccgcttaacaatgagtcgcctagaagggacaccctgtccagtgaatggtaagacagggaggtgtcaggggaaacagcacctcagaagccgactgctctggaaggaaatagaaaggattatatagaacctctctctcaggccccaaatcccatctgagttgagtgacattatattaagtggatggcaaagcacttttatgatcgagtttggccaggtgaggtgctcatgcctgtaatcccagcacttcaggagcaatccgaagtgggaggattgcttggggccaatccaatagtttgaggccagcctggacaatgtagcaagaccccatgtctacaaaaaatttaaaaattagctgggcatggtagcaagtgcctgtagtcccagctactagggaggctgagatgggaggactgcttgagcccaggaagtcgaggctgcagtgacctatgattgcaccactgcactccagactggatgaaagagtgaaactctgtgtcaagaaaagaaaaaataataaaattaaaagatataattatatatatatatggggggggtttccaatgttctgtggaaacaacaacaaaaaaaggaattgcagaaatagaataaaccagaagcgtaatcaaagtctggtctcttgccacttgtccttctttctctcctagtttatcttctttgagagtagggaaccagcagcgaccatcttggtactgtctgatctaacatgcctctctttatgcagctcccagccccttccagtgttccccacagtgcccctgtttctttacatacccagtgtgggttccccaagagcagaaacagtgatagatagaagtgaactgacagttcacttcttcccattatttgttaaatcttatcaaattggctgagaagcaagacctcaatgactcatatctttcctttttttggtagagatgggtatggggatcttgctgcattgcctaggctgcttttgaactcctgggctcaactgatcctcctgccttgtcctccccaagtgttgggattacaggcgtgaaccactgcacctggccttaatgaggcatttttcttatccaaatcactgtccctggttgtccatgatgctagaattttgattctctgctttttaaagtcatatgttggttcctgcaacttttatcatttgaccaggtaaacatgtcgcctgggcaaatggcacatcaggattgacattccttatagaaataaatatcatttaaaacaaaacaccaaaacaaagctttgggacttgttgccaattcagtagaggtattatctgccggtgttttttacaacacctgaaagtacctgcatctgagaggagccagctggtgccaggatcgtaaataaaatgtagaattttggctacagtgcatcaaaagagtgccggcagatgtgtcgcttatcccggggtcaagggacccatctacagctgtggacacttctgtcgttcctttatagggctttgcatcttcaggggcctcttctcatccatactctttactttctagactgctttataagagtttgctttggtattttactttttcttttaaagagacgggtgtcttgctctgtcaccccggctggagtgcagtggcacaatcatagctcactgcagcctcgacgtcctgggctcaaatgacactcccacctcagcctcccgagtaactggtgctacaggcatgcaccaccatgcctggccaatgttttgatattttgtagaaacgagggtcttactatgttgcccatgctggtttcgaactcttggtctcacgtggtcttcccacttcagcccactgcatagctgggattacaagccactgtcccctgtattttaaataaatcttcattttcttacatgccaaacaccaaaaaaatttaaaaaaaaattcaaggtcatcaaacattttgttttcttacatgacacacacacacacacacacacacacacacacacacgttgaaatttatcaggtgatcaccaaaacattctgaaataaacatagggctttttttcccccctataatttacaccactgcctgccccattagcgtatacacttaaagctgattggactgggattataagaaaacaaaggtttatctaaaatataaaagcataaataaacctgtcttataattgcactccagtgagctttaagtgtgtgtggtaagggggcaggcagtggtgtaaatcacgtgggggacgaagccccacatttatttgggaatgttttgggggtatagtgtttgataaccttgatttttttttggcaggggggagcatgtcaaaataatgaaggagaaactcactaagtagtggaaaggtttctaacttttaggtgatttttatattccccatcctgctcaaagcttttcagccttacaggatggatacaaaatcctagccttaggtgggcggacagatggtctctgagttttactttgtggcagagaagcggtgaagtctgacaagcatcccatcctaattcagaaagcatggtggcaggaaactgtaaaatttccgatcagacagcactggcgagattcacaatctagatggtggagtctgaccctaggacgtcacctggcttgtcggagactccacagtctgtcacagaacctgggagtggctcagtccaagttcgtgctacttaccttggggcatagtttatgctgggaaagcctagacgcttacaccggggtcatgggtattggattgttttgggggacttcaatatattatattattatatcatattatgtatgttattatacataatgtactctgtgtattttatgtgtacacacagacacacatgatcatttctacttccataaatatgcatcttttagaactcacctaatctcctggaagtcttcaacatcatctccaactacccatcctaattgaagcagcttgctgttttttgttgtcgttgttgttgtttgtttttgtttttttttgagactgactctacctctgtcacccagactggagtgcagtggctcagtctcagctcactgcaaccttcgcctcctgggttcaagcggttcttgtgcctcagcctcccaagtagctgggaccacagttgtgtgccagcatgcccagcgaatttctttttctttttttttgtagagatggggtttcaccatgttggccaggctggtctcaaactcctcacgtcaagtgatccacccgcctcggcctccccacagtgctgggattactggtgtgagccagtatgcccaacctccccacctgctgtacttctgacatggtctgttatttaaaaggaagattataagtgaagaagcagacttaggagactcatcctaatgtgtgtgcttatgggaaagccagccttttaaaacaggaatcccatcaataagcagacccccaggacagcgcgtgagtgttgatgttggtgaaagcagatgtcttctattttgcagggacagcctgacaggcatgtttacgttaagtgtctggatcctccctgcaggcacatataaatttcacccttttctactcagaggtgtattttctttacaaagatgtaatcaacccccttcccttagcttcagccttgcacggggcaacccagccttgcataggtgatttaagagccggtgatggtaggaaataagcactagaaagtgttttgccaaagtggaaattgaactgcggtcctcatgtcagatagatcttatctctgttgccatgctgcgtttgctgatgttgatatataatctgtgtactttttttttttttgtctccttccccaacatagagacctcattaagaaactgctcgtggttgacagaacaaggcgattaggaaacatgaaggtcagtatttgatcccgtgggtattcagtggtacccgatgtgcgtgtctgccgtctaacacccacattggcatgtgcaggtataaaccaaggcttagcggtcgtatttaatcactgcccaaatttcaaatctggtgttttatttatttttttaaattttacttgaaactgccaggaaagatctatcaaatctcggtttctgggcccacaacgtcaaactgggtctacaccgtatctcccctcccctcaagcaaggttaatagagcaataacaatgtataagttattactcattattttgtttacttatttattttattttttaaacagttttacggagagtgaattcacacgccatgccatttacccatctaaaatgtgcaattcggtggcttttagtatacacacgattatgtacagccacccctgtggttaatcttagaacatcttcatcagttcaaaaaaagaaaccctgcacccttcagttatcactgtgctattctttcatcctctcttgccctaagccagcggtccccgacctttttggcaccaggggccagttttgtggaagacagtttttccacagaccgcacaacctaaatcccttagttgcgcagttcacaatagggtgtgtgctcctatgagaatctaatgccactgctgatctgacaggaggcggagctcaggtgctaatgccagccatggggagcagctgtcagtacaggtgaagcttcgctcacctgcctgctgctcacctcctggtgtgcggcccattttggttcctcataggccgtggaccactaccagtttgtggcccaggggctggggacccctaccctaagcagccactaatctactgactttctctgtagggttcggtgttctgggctctgctaaaaatggaattgtacaaaatgtaagcttttgcctctggcttctttctctgagcacgatgtcttcaaggttcatccaggctgtagcccgtgtcagagcttccttccttttcctgactgcatagtattcgattgtgtgggcagacctcgttttgtttatccattcatctatggatggacatctgggctgtttccaccttttggcttttgtgaatggttctgccatggacatgagagtaggtgttttgtgtgcgcaggtgatgattttaaaagttgtgcatcaggtatgatttccacaaactttttgtgtggaggcaagtatataattgacaaacagactattccttaagtagtatcatacctgatatgcgtgttttgacatccctgaatttgacagaattcatggactttttgttggccatttctagctctggacaacctcagagggacttatacatggaggaacttccatatacgtcttgaccctgtaaattacagtctggagagacacagtacaccggggtgtgaggcttgaaccacttggctctcttggggccctctgtgtggtttacgagtctccagtagctgccataagaactgaccacaaactaggggcttaaacaacaggaatttctgctttccccatcctggagacgaggagtctgagatcaaggtgtctcaggcctccagaggctctaggggaggatcattcctgcctctcccagcccctgggggctccgggcatccctgggcttatggccgcatcactccagtctctgtctttcttcacgtggccttctctgtgtctgtgtctcctcttctgtctctcagaaggatgcctgtcattgggtttagggtcatcctaatgcaggattatctcttctcaagagccttcccttaattacatttacaaagaccctatttgcatgtagggttccattcccaggtactgggagtcaggacatgggcatatattttgagggccactgcccaatgtgtgataattgtgtctgcttcctgctagaggctctagtgggggatccttcctgcctctcccagctcctgggggctccaggcatccctaggcttgtggccacaccactgcagtctccacctccattttcacatggccttctctatgtttgtgtctcctcctctgtctcttatgaggacacctgtcactggatttagggcccacccttctccaggatgatgtcatctcaagaaccttaatttagttacatctgcaaagaccctatttccaaataaagtgatattcacaggcactgggggataggatgtgcacatatctttttgagggacattgtttaccctataacagtagtcaagcttctgtcctttacattatttgcggacagcaacggataccttcaggtctccgaggagcctatccagccaggttgcacggtgtggactcatctgtgccacggctcttcataagattggacgagtcctgttttaatgccacagccatttagaaaagagctgggtctcttgctgggactgcagggaatcacagacgacccatatctagaatctgctgggaatggcgtagtgaccatcataggtaccttccaagggggaagaacaagtttcccaatcaaaggaattggggaaaagctcacaaactcccaagctaggtcttaaagtctagttaaagcttcctgatatggagataaactgaaagagactcaagaaaacactgactttatattttttttaaattaacacatgaaaatggtattatttagcatgtacaacatgaagttttgaaatatgtacccattgtggaatgggtccattgagttcattaacatatgcattacctcacataattaccatttatttgtggtgagaacacttaagatctactctttgaaaaaaattgtttttaagagttggggtcttgatgtgttgcccaggctggtctcgagctcctgagctcaagtgatccgcccaccttggcctcataaagtgctaggattacaggcaagagccactgcacccagcaagatctactcttccagagattcttgagaatacatcattagttatagtcaccgagctgtgcaagccactgactgaacttgttcctcctgtctctctcactttgtctcttttgaccaatgacttcccatctcagccccttcccagcccctggtatccaccattctactctctgcttctatgagttcaacttttttagatttcccatgtaagtgaggtcaggcggtatttgtctatctctacctggcttatttctctctctctctctctcttttttttttttttttttgagacacagcaaggcggaggttgcagtgagccaagatggcgccatgccctccagcctggatgatggagtgaaactctgtccattgccccgcccccccaaaaagaacatagagtatagtaaatagataaaccagggacatagtcatttattatcattaccaagtattaggtgccgtaggtaacgtatgtgttagactgttacacgcctggcagcgtaacaggagggatgcattgtcctgtggttacaatggccatggcgtcactaggggataggagtttttaagatcattataatcttacaggagcaacactgtatatgtcatccattgttgactgaagcatcattttgaggctcatgactgtagatacacacccacacacacactttttttatttttattttttcaagacaggatcttgctctgtcatccaggctggagtgcagtggtgcgatcacagctcactgcagccttgacctcctggcgtcaagtgatcctcccacctccgcctcccgagtagctgggactcagtgcatgcaccaccaaggctggctaattttttatgtttttttgtagagaccaggtcttactttgttgcccaggttagtctcaaactcctgggttcaagcagtcctcctgcctcggcctcccaaagtgctggaatataaacgtgagccactgctcccacccccctcacacacactttatataacacacacacactagtttggatactaatgtgaatctcggtatatacatatactttgtactctacatataaagtgtgtaaagtacatatgtatatgtgtatatatatatataatacatgtgtatatattaacgtgtatgtatataagtatgtgtatatttaatgtgtatatattaacgtgtgtatgtatataagtatgtgtatatataaatatatgtgtgtatatattaacgtgtatatgtgtataagtatgtatatattaacgtgtgtatgtctataagtatgtgtatatattaatgtgtgtatgtgtataagtatgtatatatcaatctatgtgtgtatatatgtatgtgtgtgtgtatatattactatgtatgcatgtgagtatatacagacacacacatcctttagtatccaaattagaattttatctgatggataaaatttattttattctcttattcacagcactcttatttattcttattcacaacattgctgaaggtaaaactcaacagctattgtttgttgcctgacttagctatagatcaaaaatacctgttttgcaataagaaaagaaaaagttgtcaaaacaactggatgggaaaacaatagaaaaaattcacattactgtttccttttgaagatatggttgtggacgtattcctctttaaggataagaaatttgaaactacagtaatgctaactgatagacgcgttaaattcagatgtactggcttctgtttcatggaacctacgtttatttcttctgctgtcccacatttaattgataacgacatcactacaagtataagaaaaggaagcagagtgaggtttacggatgagcacttgggagggatttcagaggtcgtgatggccacagtgtgagccagcgatgcctggtgctacccttgagcatgaagcaggccgacttgaacgcaccttgttaattgccaggccgtgcaatgtcgttcctaaggtctcttaaactggacatccttggtttgagttcccagtcttgttatttacttgctgggtcctacggagcaaattaacatcattccttgaaccctagtttctatgtctgtaaaatactgagtaagtttgccaagatgaaaacaggagacaaactgagaaactactggctgtccaattttatgtcgagagatggaatcgtatttacctttttcgtctttggtccggaatgcaaatgcattgcacaggagcagaatgactggatttgtttctgcggcaaaaaagggcaaacaaaacactaacagctttgcttgcaggttttcctggcagctcaccctccaggcacagttctccaaaatgcagcaaacttggtctgtttgtttcaatactaaaataatgtagagattctttggggtatttttctttcctgccctgtcaaaattctgtacgctgacgacatgtgttgtttcttttgaagaacggggcgaatgatgtgaagcatcatcggtggttccgctccgtggactgggaagctgttccgcagagaaaactgaaggtacaacacatatcagtgggtgactcagtatgcccgagctcttccattagcagggactgcctctgaatcctgggacttctttattgatggctgacatgtgattaatttatataatacaactatttgtctaaaactgttcataagccaagttccccactctttgagtgtcttagtgctaaccatctacctagctcccacaaaggcaggagccaccacacccagtcatataccacatgttctttgtccattcatccctggatggacacttatcccagattttgaagcagattttaggagacctggcctgattcctgactagctctgtgactgctaaaccctactccctcctctttagtggaaagcggtcaacaggattacagagataagcaagcgtctagcaccatggtcatcattcagtgatggtggtgtattacatggagaatattctttggaacgtttctggccaaactgcctatttttaaacatctggctttttggctgggtgctgtggctcacgcctataattccagtactttgagaggccaactcaggcagatcactggaacccacgagtttgagactagcctgggcaatatggtgaaatcccgcctctacagaaaataccaaaattagccaggcgtggtggcatatgcttgtggtaccagctacttgggaggctgaggcacaagaattgcttgataccaggaggcggaggttgcagtgagccaagattatgccactgcactccagcctgggcgacagagccagaccctgtctcaaaaaaaaaaaaaaaaaaaaaaaaatctggcatttttttcaatgtataatacttgtccattttataaatgaggagactgtgctcagagaagttaagcaatgtgtggaaggttacacagctgctaagcagtgtaactatcacaggtacatatttatgggggtacatgttatattttgacacacgcatagaatgtgtaatgatcaactgagggtaaccagggtatccatcagctcaaacatttatcatttttatgggttgggaatattgcaaatctagctattctgaaatatacaatatattgttaactctgcccacccaactatgctgtcaaacactggaacttattccttttatctaacattatgtttatgcaatatttcttcatctccccttcatcccctagctatacacacttcccaccctctggtaactatcattctactctcaaccttcatgacatccatttttttagctcccacatatgagtgggaacacgctgtgtttctcattctgcgtctggcttagtttattatttattatttattttttgagacagcgtcttgctctgttgcccaggctggagtgcagtggcacgatcttgctcactgcagcctccacctcctggcttcaagcagttctcatgcctcagccccctgagtagctgggattacagacgcccagctaatttttgtatttttactagagacggggtttcaccatgttggccaggctggtctcaatctcctaacctcaagtgatccaccagcctcagtctcccaaagaagtgctgggattacaggcatgagccgctgcacccggcctggcttagtttacttaacatgatggtctcccattccattcgtggtgctataaatgacaggatttcattccattttatggccggatagtttttcattgtgtgtatggaccacactttctttatcctttcatccattggtggacacttaggttgattccatatcttggcttttgtgaacactctgaactgcatatgttactgatgggagtggtcaatggtagtgttttcacctttgcacttcagagttaaaagaatggagaatgcttagaaatgcttattcctagtcctcagctcagaccagagtttctggggctggagcctgggatgatacgcttcttttttttttttttttttttttttttgagatggagtctcactttgtcgctcaggctcggggtgtagtgcagtggagtgatctcaactcactgcaacctccacctcttggattcaagtgattcttctgcctcagcctcccaagtagctgggattacaggtgtgcgccaccacatccagctaatttttttgtgtgtttttagaagagatggggtttcactatgttggccaggctggtttcgaactcatgacctcaaatgatccactctcctcggcctcccaaagtgctgggattacaggtgtcagccactgggcctgggctgatgcatcattttgttcaaagttttaccttttcaaatactttattgtattaaattgcattaaaaaaacaatttgaatacgttttatctatccacattggtcaaaaaccaagtcaatattaaaacagatatattgccaagtctccctcttaccccctccaagccacctgtaggtaatcaccttttattgtttttctgtgtatccttctagagtttctttgtgctaataaaaacccacatggatacatgcattcttatttttgccactcatttatacaaatctagagtagcgtagtatgtacattattatagtcttgctttttgcacttgactatataatctggagacctgtctacatacctggctagcttcctcattttttttttttttttttttttttttttttgagacgaagtcttgctccgttgcccaggctggagttcagtggtgcgatctcggctcactgcaacctccgcctcccaggttcaagcgattctcctgcctcagcctcccaagtagctgggattacaggcacccaccactatgcccggctaatttttgtcttttcggtagagacagggtttctccatgggccaggctgttctcgaactcctgacctcagatgatcctcccaccttggcctcccaaagtgctgggattacaggcatgagccactgcgcctagccagcttcctcattttaaaaaatactgcattgtattccatcacatgactgtaccatagcttacttaatactatatatatatattttgagacaggatctcactcagtcattcaggctggaatgcactggtgcaatcatggctcacttggagtatcgacctcctgggctcaagcagttctcccacctcagcctactgagtagctgagactgcaggcacacagcaccacacccggctagttgtattttttgtagagacaggggactccctgtgttccccaggctggtctcaaacttctgaggctcaagcaaccctcccgcctcaccttcttaaagtgttgggattacaggtgtgagtccccacacgcagcctcattcacaatattttaattcaaagattgccgctttcataaatgaagggaagacagctttagtgttttgcaaatcattttcatttttaggtacagtgacagaaataaagcggtgtgtgcagcatccaagtgtcccgtccctttctaaccatgcctttgtgcttcggccatgtctcacagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaaggtatatctttatatttagtaattcccaaaaaatgagactgactcgaccccacatccaggtgaggctgcgtttactgagtggggcttaacctcatgcacacagaggtcagcagtgaagcagagcaaaggggattgattgcaagggtcagcgaaataaacacagccatgcctgtgactccaggtcagcatgtgaccgtcagaggcatcagcatgacagtccagaatccatgttctgcatcagaacctgcacgtctaaataagaccgctaggtggtttgtgtgtgcctgaatatttgagaagcccagctcctctggtccctgttccagaaaccctgagtgacaggcgagcttccttagaataattaacaagtattttcaaaagtctctttaggtctcctttggttaaaaaataagaagaagaaatatgccctcataggaaatttgctaagcttaattgaagatgactggaaaaggattttgagtctattacttctttgagcctttgaaggtctattattagtttttaaataataataatattttttagaatccctcatgaaatttgctaagctttaatttaagatgactgaaaaagggttttgactgtgttatttccttgagcctttgaaaatctattattagtttttaagtatggattaaaaagagctttcagttactcctcaattctaaattgctcggttatatggcttcaattagatctttcttcctgtaacacacgagcaagaaacataccagtgaagcaaaatattgtcagtgatgtgtctattcattgacatagcttgtttttcccattttgatttccattcccgtaattttcctgtagtcttcccagttatgtgaagtggaaagccaattggctaaccaacaccattcgaaacagacaccaaatgtcacaattgctgactggggagaggaaccaacctgctgaaagacgtggtgaatgagagccctccatcctgggcaggtgtttacatggatgtaccaagaggaaagctggatacaaattgaaataatagacaacaaaatgatagaggaataggtggctatgacctcgagaagataacctgtctccatggcatggcttcacctctcagtgtgtgatgaacgctttcacagtggtgactggtttgtattaacatgagagcgtgtaactttaccaacttcataaacgctcatgaaatccagttgcgggttttaaaaatcataagatgttcctgaatgtgtttacttctttttgtttctctgctctactctggggcttacattttagctgactcgcccataacatcttacaaattgtgtctctccaggaaatctttaaaatgatgtaaagacttggtttgctttagtatgaaggacccctagttgataagccacaaaaatagaacctttctctaatagagacccctcaattgtaaaatttacttaaagaacaaaaaagcttccatttgatggatttttgtcatataatcagtgaacaatttcattacatcctgtccccagctgcccctactttccctgaaaaagattccacacgtaggaataacctttctccatctggtatgcattgttgagaaagtatgtgtaagtaagtattatttttgctaagtggaatcatttttaatatagtttggctagtggttggggctctgtttaatgaatttttttttctttttgagacagagtctcgctcggttgcccaggctggattgcagtggtgcgatctcagctcactgcaacctccgcctcctgggttcaagtgattctcctgcctcagcctcccgagtagctgggattacaggtgcctgccaccacaccaggctaattgttttgtatttttagtagagatgggttttgccatgttggccaggctggtcttgaactcctgaactcaggcaatctgcccacctcggcctcccaaagtgctgggattacaggcatgagccactgtgcctggcccagatgcaatattttaatccgtcttagtaattttatcaagtaatttgcacaccaaacacatccctggcattttcagcaacgagcgattagttgcaggaattttatgcaggaagatatttcttcatgaagccaaatcttctcctgtaaataagacaccagttcagatgaatcactgcacttgagggcagcttagaaactatgctgtagccgttcatctttgtttgaatcaccctgtatgcctttctgaatgtggaggaggaatttaagagaactgactcactatgtcttttattttactttgtaataaaatattttctgtcttgctgtaaggttctctgaggaagcatgttgaattggggatcccatttttcttgtgcagttcatcatctattggtggatacatttatctatttatggataagcgtatgatagaacattcttcaggctggatgtggtggctcctacctgtaatcccggcactttgggaggccgagttgggaggctcacttgaggtcaggagtttgagatcaagcctgggcaacatagtgagaccccatctctacaaaaaataaaaaagttagccaggcgtagtgatacatacctattgtcacagctattctagaggctgaggtgagaggctcgcttgggcctggaaagttgaggctgcagtgagccgtgattgtgcctgtactccggcctggatggcagagttagacctcatctcaaaaatgaaaacagggctgggcgaggtggctcatgcctgtaatcccagcaccttgggaggccgaggcgcatggatcatctgaggtcaggagttcgagaccagcctggcaaacatggtgaaatcccatctctaccaaaaatacaaaaattacccaggcgtggtggcgggcacctgtaaccccagctactcaggaggctgaggtaggagaatcacttgaacatggaggcggaggttgcagtgagctgagatcacaccactgtactccagcctgggcaacaagagcaagactccgtctcaaacaaacaaaccaaaaaaaccccttacctttaaaacattcttcatttcctttttattggcctctccttttagaattcaggcttatggatccttgcaaaaagaattacaaagagaggttttctttgttatcacttagggaaaggaaacctttgtattatcattgagatgatgattacaaaattcatccagttactgagcaactcacagaatcttttgtcctatttcatgctagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacagtggagctagaaggaaaagcttttaagtctcatgtttgctgactataaaaataaatcatagtaataatattattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtggctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctccaaacaagctgtggcttttctcctttggtctaatcgagggatgggcaattatctgtaggggccacatggcagatattttctgcattgtgggacacacagtctctgttgcacagagtgcaaaaaagctgctataattaggcacggaggtgcacgcttgtaattccagtgctttgggagaccaaggcaggaggatcgcttgagcccaggagtttgagaccagcctgcaacgtagcaagacccgatctctacaaaaattagaaaaatctgtcagtagtggtagcacgagcctgggattgctcaggaggctgaggtgggagggtcacttgagcccaggagtttgagcctgctttgagctgtaattgtgccaatgccctccagcctgggtgacagaacaagaacctgactcttaaaaaaacaaaaatcaaaaagccccatagacaatacgtaaacaagtgggcatggctgtgctccagtgaggttttattgacaaaaataatcagagggccggatttagtccaagggccagcatttgctgattcctgttgtagtgtgatgttgactttgcagattggcttcacaggttgttaaaaatgtgctgccctcatcatcatgaatgaataaaatattttattgcttactcttattactcacatatttgacacccaggtttctgagtgacattcgcagcttgctaaaaacatcctgacttcgtacattgtaaaatcaattgatttgtaatttttgacactcacatagcacttgctattagcagaggctgaaatattacacccagctaagggtcaaacacaggcctgtttacttatgaccaagctgtccctggtcccatcttggaattccctggggaagggagtcttcccgtgggctggtatggctgttcagggtctggttcagggaccactcgggagtttctgtagcgtaggttcttggtgagtgacagtctgatttgggaaaggatacggagtgtgtgtgtgttggaaggctaggggaggggtcttgaaccccttcagcagaacaaacatgctttgtactttggggtaagatcgctagagattgtccagggttgtgtcagttatgtgtcatagatatgtattaatatttagccacaccctgttggagctctctgactttcctaggagtcaggctcatcttgtatacttattgaaaggatcagataaccttcttccgagggtatgaaggaaaatcatagttaggtggaccccctcatcttaacaagaggctgtctcgggtatcgctttgcagagatggacaggaattgctggagttttttgttctgttttgttttgctttgttttgcggcagagtctccctctgttgcccaggctggagtaccctggtgcaatcgcagctcactgcagcctcgaagtccttctctcaagcgatcctcccacctcagcctcctgagtagctgggactacaggtgtgcgccaccacacccaattaatttattttttatttttattttgtagagatgaggtctccgtatgttgcccgggctgatctcaaactcctggcctcaagcaatcctcccaccttggccctgcaaagcgctgggactgcaggtgtgaggaactgcagtatggggagcacccgttttctgtgggcagtgacatgcacactgttacatgtgtgtgcaacaaagttatccttcaatccttcaaatactgcaacgcgtgggacacctgcccactctaaccactgctaaaagacaaagctgttgacacgagaactcagcagaaaacaaaatcacagagctaaggtttccattccatctgctcctgctcacaccaaggcgctaaacaacacttcaataataaatatgtgttacataagcataacagaataaatatatgactataatatgtaaatagattaatgtatatttattacatattaatgtaataaatacattaatataatttatgtaatatatatt

SEQ ID NO: 17573 - DNA, 48018 bp, Human
atcccagcactttgggaggccgaggcaggtggatcaggaggtcaggagttcaagaccagcctggccaacatagtgaaaccctgtctttactaaaaatacaaaaaaattagccaggcgtggcagtgggcacctgtaatcctagctacttggaaggctgaggcagagaataaaatttattttatttttaatttgttttagatggggtctctctctgttgcccaggatggagtgtagtggtgcaatcatggctcactgcagcctcaaactcctgggctcaaaggatcttcctgccccagcctcctgagtagctgggactacaggtgtgtgccaccatgcctgcctaatttttaaaatttttttgtagagattgggttttgctatgttacccaggctcaccatctcatcttttaaaagggaacagtatttccccatggattacatgagattgctgtcttttagccattttatcccctcagcctgattgtttctcccagctgaacttcatttatggctcccctactagattccatctaccaagcttcctccctttatttatttttgagacagggtattgctctgtcacctaggctggagtgaagtggtgcggacaccactcactacagcctcaacctcccaggctcaagtgatcctcctgcttcggcatcctgggtagaccagaggtgagagctgccacacccagctaattttttaatttttagtagagatagggtctcactatgttgcccaggctggtcttgaactgctggtctcaagtgatcctcctgccttggcctgcctccctcacgatgggattacagttgtcagccaccatgcccagccacttcctcactttcctggacttgtcctaagtctttaggactctttctagccttcggacataatttaataaatagttaaaggaataattatggcaaccaccagatcctttccatgtttaagtctgagaatggcaccaacttacctactggtttcacctgccattacagtataaggtcactgaaggggaagattcagctgacattttaagcttcttggattgctaaggcccctgccttattaatgatagagagcagagagggaagagaggtaaggtggcattgtggtatagagctgtgggaatgggatgggggagaggcatggaggcagaggtaggtggaggtggagagcgctggcttagggaccctgactcctgggggttcacacaaaatacctttctcagtaaggaatcccgattttgaagctcttaggttggctctgcatgcaactttgttcttgggttacggcggcagtttctgaactctgcttggtacaacaggagggaggcaggggataggggtagtatctcaggccgtagccttccccagcctgtatccctgttgcctgggagtagccccagtcccattcacaacccgtccgccttcgcaacccgtcccgccaccaatcccaccccaccattagcaaagtctgagctcacctaacactgaatcctcccgttggcccctccttcccgtccagctctccgctccccccgggtccttccaattcccgaccctgtccttgtcctagccttgaaagctggccaggctaaagccacagccgagctcccaccttcctcttgccctgaggggcataatcctgctgtgacttctgtctcagcaagcgtgagctcaggtctcccccgcctccttgaacctcaagaactgctctgactccgcccagcaacaactcctccggggatctggtccgcaggagcaagtgtttgttgttgccatgcaacaagaaaggggggcggaggcaccacgccagtcgtcagctcgctcctcgtatacgcaacatcagtccccgcccctggtcccactcctgccggaaggcgaaaatcccgttaggcctggacgtattctcgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtgagataaacctggccgcggccctgcgcacgtcccggcctggaccccttatccggtgccggagtagtacaacccagcccatgtaacctgaaacgtcgcggacccttacgggttccttgcccgtccagagggggttctgctcgaacccactctccccgcgcgggtgctctaactcgaaccccttccaggtgtcacttgccgcttcctgcgcggcccccgccccggcccagtggtacaggccgagctgccagttaccccgcctacttccccctcccgccaaaggagtcgcgtctggaaccagcttcccgccagctcagtcctccgccgcgcggctccccgccggaccggccggagccggcttcccagccttacttgaccccctccggagaatgtggggacgctggtagctctcccgtggccttcggtcccaaacggtgcacttctgtttcagcccagcgtcctctctcgcctcgcattggtacactccaactcctttctactcttctctggaggcggcacttttgaatttcagacccagcgctccagtctttagaatgcttgaggtgtcgatccccaccccccaccgctatgtcagaggtagttgcctcgaactcgcccttttcctaccaccgaaaccgtcaaaagccgaaattaactaatttaccaaatttgttgaatgcttattgtttatcaggagttattcagttgcaagttgtggaaacagcggagaatagaataaaccaactccatgctcacagggaacttatattccagaggggaaagaagataaggagaaaataagatggttttaggctgtcataagtgctatacaggaaatgagacaggtggatgtgataaagtgacttaggtggtgtctttagaaagggtggtcaggtaaagcctctattttgtgtcttcccaactctaaacgatacaccgtggattcctctcacctcagatgtccatttggaatcctgctgtattcttccaccccagagatgttctagctgaatgatatcctagcctaagaggctgcccttgctgaagtagcacatactgagtacctttcctggagactgagtgtctcaacagtggcactattgacatttccagcgagataatcctttgctgtgggatgtgctctgtgcattgtaggatgtttaacagcatctctggcatctacctgctagataacagtagcacccctgctccccaggcatgacaatcaaaactgtctctagacattgctagatgtcacagagggtgtgtgtgattcccccaaccccccaacttgtttgagaaccactggcctggagggctaatgcttggtgtccacccagtttcctcgggttttagtgtagtggcccctgttggaagagctaggatgtacctcttggcattcagtcccctcagcattagtagatttgtattcccagctgttctgaaaagggctatggcactcccccacttgcccccgttcttcaaggcccacctctacaagccattcctttagtccctttggtgagtgagtcttcctctgtggcataccgtagacacttggtacacgttaatgtttattaagtcctatattgatggtgcatgtttttgtatcttcattggcctgtgagtaccctaaagcagacattccttgaaacgttttactggtgttcagtccataatatatattacaaaaatgtttaccatattgattgtgattagagaggcttggggttgtgagatgatgttgtcctccctggaaatgatgggagaagcccaaaggttggatattggttcctaaaaggctgactcctggtctgcatgatgtgctagtcctgctgtgatgagggagacagctgagtccagacttaggataggactaattaattgagtacctactctgtgtgtcaagtactttatttattgggaccctgttttttctttttctttttcttttctttttttttttttttgagacagtcttgctctgttgtccaggctggagtgcagtggcatgatgttggctcactgcaacctctgcctcttgggttcaagtgattctcgtgcctcagcctcccaagtagctgggactacaggcgtgcgccaccccatctggctagttcttgtatttttagtagagttggtgtttctcccagttggccaggctggtctcaaactcctgggctcaagtgatctgcctgcctcagcctcccaaagtgctgggattacaggcatgagccactgcacccagccaagggaccctttacaattaaattctcaaaatgaccctaggaggaaaatgccaatagcttcgttttatacatgaggagactaaggcacagaggtgtgataacttgtccgtggttctcagaacccatgcctgtgctcctgccactccaatagagaagtatgtgccgcacatatttttagacccgtgagttgtggtttttttcatctttttccaggtgagggaatggaaggtcagctaagtggtagtgaaagtaagattagaacctggtctgttggttctaagcccaagtttgcaagcttttttagatggagtctcactctgacgcccacactggagtgcagtggcatgacctcggctcactgcaacttctgcctgctgggttcaagtgattcttttcttttttttcttttttttttttttgagatgaagtctttctctgtcgcccaggctggagtgcagtggcgtgatctcagctcactgcaacctctgcctcccaggttcaagctattctcctgcctcagcctcctgaggagctgggattacaggcgtgcaccactatgcccggccagtttttgtatttttagtagagacggggtttcaccacgttgttcaggctggtctcaaactcctgaccccgtgatctgcccacctgggcctcccaaagtgctgcgattacaggtgtgagccaccgcgcctggcctattttttttttttttggagtcagggtcttgctctgtcaccaaggctggcatacagtggcacaatcatggctcactgcagcctcaacttctcgggctcaagcaaccctcccatctcagccttcccagtagtcaggacaactggagtgtgccaccatgccgagccaatttttgtattttttgtagagatgggattttgccatgttgtccaggctggtctcaaactcccgaggtcaagtgatccacccacgtctgcttcccagagtgctgggattacaggcgtgagatgccgtgtccaacctaatcatagtcttataccgtctctatggaaggacttgggctgctgtttttatggctgagtagaaaggtgttggaaatcagatcttcagttcaaagtcatatataagttctttagggacagtcttgagatagaaattatagagactaaactgttcctccttatccaccagcccgactaaacttttttttttttttttttttttttgagacagagtctctctctgtcgcccaggttggagtgcagtggcgcgatctcagctcactgtaacctccacctcctgggtttaagcgattctcgtgcctcagcctcccgagtagctgggattataggcacacaaccgtgcctggctaatttttgtatttttagtagggacggggtttcaccatgttggccaggctggtctcaaactcctgacctcaggtgatccgcctgcctcggcctttcaaagtgctgggattacagtcatgagccactgcacccggcctaaacttttaaaacaatatctattttttggccaggaacggtggctcatgcctgtaaccccagcactttgggagtccaaggtggaggatctctggagctcaggagtttgagaccagcctaggcaacatagggagaccctgcttctgcaaaaatccaaaaactagctgggcatggtggcttatgcccatgcttcccgctacttgtgaggctgagacacgaggatcacttgagccaaggaggtcagcgctgcagagagctgtgatactgctactgcactccagcctgggttacagagtcagaccctgtctcaataaataaatgaataaggtctgggcgtggtagcttatgcctgtaatcccagcactttaggagaccgaggtgggtggatcacttgaggtcaggaattcgagaccagcctggctaacatgatgaaaccccatctctactaaaaatacaaaaattaactaggtgtggtggcacacgcttgtcgtcccagctattcaggagactgaggcaggagaatcacttgaacttggtaggtgcaatctagcgtgggcgatagagcgagactccatctcaaaaaataaataaaataagtaaatgaaaccttttttgttttcggattctaaaatgaacaaagtaaaagctgtaactccactactgaaaagatagccactgttaatgttgaaaaccttatttatttgaatagctggtacatgtacatggtatacaattttaaaaatccttaaggatatacagtagtaaaaagaagactcccttgaccctagctgcttagtttccttttcagaggcaatcactgctgcactgtttacgttttcatatatttgtttcctatgccttctcttctcccaagttttattatgaaaatttgcaagcatatatgtgcattacttagtcatttggaagtaaattacagactcaattacatttcacccctaagtgcttcagcattcacctcttaaaatcatcattctcctgtactaccactattcagttatcacaactaagaaaatttcctcatgtcatcaattatccagtttatatttaagcttccttaacttgctccccaaatgtctttttgttattttggaaccagagtccagtcaaagtttgtgcactgtttacctatgtctcagaaatctctcatgttttggaatggttcgctcactttttttttttttttttttttgagatggagttttgctcttgttgcccaggctggagtgcaatggcgtgatcttggctcaccgcaacctttgcctcccaggttcaagcgagtctcctgcctcagcctcctgagtagctgggattacaggcatgtgccaccatgcccagctaattttgtatttttagtagagacgaggtttctccatgttagtcaggctggtctggaactccccaacctcaggtgatccgcccgcctcggccacccaaagtgctgggataacaggcgtgagccaccgtgcccggctcaccctttctttttagacactgactttttgaaaagaccaggccatttgtctttgagaacatcccacattctgtgtttgtgttaagatttcctcatgaaaaccttactatgttcctctatattgtattgctgtatttcctaggaactggaagataagtctgaaggcttgtttagattcagattaggctggatatggtggctcatgcctgtaatcccagcactttgggaggccacggcgggaggatcacttgaggccaggagttcaagactagcctgggcaacacagcgagaccttgtctttattataacaaaaaattaaaaaaaggaaaaaaatagattcaggttaaatatttttggtaagatacatcataaatgatgctgtgtgtttcatattgtttcacaacaggaatatgcactttttttagatggtggtaaaatacacataaaatttcctaaattaaccatttttaagtgtgcagttcagtagtgttaaatatattcacgtttttgtgcaaacgatctctagaactttttcatcttgcaaaaatgaaaatctatgcccattaaaaaacaactcccaggccaggcgtggtggctcatgcctgtaatcccagcactttgggaggccgaggtgggcgaatcacaaggtcagaagatcgagaccatcctggccaacatggtgaaaccctgtctctactaaaaatacagaaagttagctgggtgtggtgatgtgtgcctgtaatcccagctattcgggaggctgaggtgggagaatcccttgaaccagggagtcggaggttgtggtgagctgagatcacgccactgcactccagcctggcaacagagcaagactccatctcaaaagaaaaaaaaacctcccattttcccctcctcccagcctatttttaaattttactttacattattattattattattattttattttattttattttttttttttgagatggagtcttactctgttgcccaggctggagtgcagtggcacgatcttggctcactgcagcctccacctcccaggttcaagcgattctcctgcctcagccttccaagtagctgggattacaggcgcccgccaccacgcccagctaagttttgtattttttagtagagacagggtttcaccatattggtcaggctggtcttgaactcctgacctcaggtgatccacctgcctcagcctcccaaagtgctgggattacaggcgtgagccaccatgcccggcccactttatattattttaacatcgttgagttttgtgtcttgtttgtttcacctattgtgggcttttgtccatgtcattaaaggttgtaaaactatccattctgtgaatataccatttctttagattgggttctagcttctttttttaaactattctttcctctttttttttttttttcactattttttttaaagagagtcttgttctgtcacccaggctggagtgcagtggtgtcatcatagctcatgcagctttgaactcttgagctcaagcgatcctccctcctcagccttctgagtagctgagactacaggcgcatgccactatgcccagctaattttttttttttttttttgagatggagtctcgctctgtcgcccaggctagagtgcagtggcacgatctcggctcactgcaacctccgcctcccaggttcaaggaattctcctgcctcagcctcccgagtagctcatgcccagctaatttttaaagtttttgtagagactgggttttgccttgttgtccaagctggtttcaaactcctggccttaagcgatcttcctgcctcggcatcccaaagtgctgggattacaggtgtgagtcactacgcttatcctgggttctagcttctggctgctatatagtaactgcaaaaggactgtttttcctaagcctttgacccagaggtttggttgtgctcagtctttatggggacagaggagtagtctctcttcccattagtctgagtactgagtgattaggggacatttttgttcatctcaatatctttattccttttcctctcctcttcatcctgactttccctctactgcctcgtccctcttcccttaggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggtgggtgaggctggccagaaagctctccttgggtcctgggaggtggctagactagttgattgggacaggaaggaggcctgacccttgccaactcatgcattgtcttgtaggaggttcttctgagtacaagatcaacaacaaagtggtccaactacatgagtacagtgaggaattagagaagttgggcattctcatcaaagctcgtaacttcctcgttttccaggtgggcgtttttaacagttattggctatctggtttttgccagaccatgtcccatccccactctgtctgctccatctcaggctttatcatctctcccttgaactaatgtagcaccttgttcactgagcttcccaacttcagtctggcccctgagccaggttcatcttatgaggacacacatttgttttgtttcccctcccttttttccttaaaacatttcagtgattccgtattgccttacaatggtggttcttaaactgtagtctccagaccagcagtatcagcattacctggtaacatgttagaaaatgcacattctcaggccctatcctagacttcctgacttggaagaaactgtggagtggggcacagcagtttgtgttttaccaagctctccagtttattatgatgtcggccgaaatttgagaactattgccttaggatgagatccaaactcctaagcctatcatttaggaaacaccatcatcaaaatccaaataccatctgcatgttcttctccagccttgcactccagcctacttaaaccatttatggttctgcaaattcacctgctttctttggcctacaggtctttgcatattacttttcctcttcatagaataactttttctctgttttttttgtttgtttgttttttgttcttgtttttttttttttttttgagacggagtttcgcttgtcacctaggctggagtgcagtggcacgaccttggctcactgcaacctccgtctccagggttcaagtgattctcctgcctcagcctcccaagtagctgggactacaggcgcccgccgccatgcctggctaatttttgtattttgggtagagatggagttttaccattttggctaggctggtcttgaactcctgatctcaggtgatctgcctgcctcagcctcccaaagtgctgggattacaggtgtgagccaccgcgcccggccaccttttttcttttattttcttggttagtttccctccagcttccaaactcagcacagatgtcacctttgggaagccttctgagatagatatccctatcagtctcctacccccaagcttcattttgtccttttcctatgctgcttctgttactgcacataacactttgttgtctttgtccctttggctccctgtgctcctcagagggcaaggaatttgtcctcaaagcccagtgtgaaatgtggcagcaggggcatgggagagaaagttggtaactttttctgggtgaaggagtggaaatgggtaaggtgaactgggttggctggggtctgaagtggaagagtgtttcgacctttactagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggtaggtggccaagctacctcttggctctgagggaccaggatggagccagtgccttatcgatgcacccctgccaccattcccctgtttgcacaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaagtaagaggcagacctgggcctgcaacttgtgggaaaccaagaggccgtgctgtttattagggttcctctgagcccggagttcagtacctatactcatttctctgttattctcctaacttgcttttgtaagaaccaggcacatttcttgacttgcagtttagacaaatagaatatttaagcactcaggccctgggtagacaggtgctcagatgagggagaactcaaaaggggtggtggccttgccaagaaagaggaaccaatgtgaggccgagccaatggagtggctgagaaggccttcctagaagaggaaactgaagctagaagtttaaaggataggaatttgaggggccaactaagtaaatacaggatgttcttgggagttgttaatgagcttcctggccagggttgaggcagagttggtagctttgccttatggagtggctggaatgccaggctgaagtcatacctttcagggagtagtcagactgcccctttttttcaggatctgtggggcattacgcccatgttcttttaagtaattccctgaggttggctcaggggctcaagctctcctttgggtgaaaagcctgggaaccctcccttcttccatagttctcactggtttcccccacccctctggcaaaagggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtaagctctggaaggggttggcagggaggagatccctgggctgacatctgctgacttggtcatccctgttctccttccctgtccctaacacaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggtgggctatagttataagattagggatgatggtccacagaaaaggatatatataggttgagcatcccaaatccaaaataatccaaaatctgaaacgtttccggtcctaagcattttggattagagttacccaacctgtaatgatagtctttttttttgtttttttgtttttttgagacagagtttcgctcttgcccaggctggagtgcagtgatgtgatctcagctcaccacaacctttgcctcccgggttcaagcaattctcctgcctcagcctcctgagtagctgggactacaggcgtgcgccaccatgtccaactaatttttgtatttttagtagagacagggtttcactacgttggccaggctggtctcgagctcctgaccttgtgatccacccacttcggcctcccaaagtgctgggattacaggcttgagccactgcgcctggccatgataatcttaatgataatgacaatgataatgacagtagctcacatctgttgagcacttactgtatgataggcaatgttctttacatgtatccactcatttaattcttcatttattattatctttatggaatggctactattaccctattttatgaatgaggaaattacaacacagagtaatttgcctaaggtcacaagattattgttatttttgagacagagtctttctctgtcatgcaggctgaggtgcagtggtgcgaccatggctcactgcagcttcgacttcccaggcttaagcaatcttccaaccagagcctcctgagtatccagcattacttgtgcttgccaccatgcctggctacttttttttttttttttttttttttttttttttttttttgagacaaagcctcactctgttgcccaggctggagtgcagtggcatgatctcagctcactgcaacctctgcctgtcgggttcaagtgattctttttatttttttatttttatttttattgttttttgagacgcagtttctctcttgttgcccaggctggagtgcaatggtgccatctcggctcactacaacctctgtctcccaagttcaagcaattctcctgcctcagcctccccaagtagctgagattacaggcaccagccaccattcccggctaatttttgtatttttagtggagacggggtttcaccttgttggtcaggctggtctcgaactcctgacctcaggtgatccacccgccttggcctcctaaagtgctgggattacaggtgtgagccaacgcacccagcccggttccagtgattcttgtgtctcagccacccgtgtaggtgggatgacaggtgggtgccaccacacctggctaaattttttgtagttttagtagagatgggatttcaccatgttgaccaggctggtcttgaacttccgaactcaagtgatccgcccgcctcggcctcctaattttttaatttttatagagtcagggtttctgcttgttgcccaggctggtcttaaactcctgcctgcctctgcgatcagcctgccttggcctcccaaagtgttgggattacaggcgcgagccaccgtgcccggccactcacataactattaagtatcagaaccagaccctgggcattgtagctctaaagcccacactcttaccaaatatactttacttactgcctccctgatatcaatattgtaataacagcaatgatagaaagttgtcatagtgtcccaggagtgtacagtgttcaggcattctgctaagcacttttaaatatttaaaagaatgttggccaggcgtggtggatcacttgaggccaggagtttgagatcagcctgagcaacacagtgagaccctgtctcaaattttaaaaaataataaaaattttttaaaaataatgtgatagtcattaatattaataacaaccctatattaagcacttaatgtgtattctatgcagtggagattacccacattttgcagatgaggaaacaggtacagaaaggcctgtgaagctttatcttgatttgagcctccatggttggtgaagaagatgccttggctgggtagaacacctatgagaggttctggagctctgggaggcccccatcattagttagtagatcaaaccgaacaccatctatgtctgctttttagtaggcctcctatattagtgacagattgtcctggactgttcggctcttggatgagtgggcacataaagggtgtgatctagagcccccatggtcttggcgtaaactcgtgcagcccctgatgatggaatgtttgtttcccaggccaagatcaagcaaaagctgcgggaaattgaagagaatcagaagcggattgagaaactggaggaatacatcaccactagcaagtatgtagctctgcatctgtcccccttacttccaggcctgttcttgtgaccctacctacatgcccctcttcatgcaggacccccagagctctctgagccaggagtattttctcaccagcaggagtaactcctgtgtgccctcactttgtaggcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtggtaagagcagagagggaactcatttcctgagcacttacactcactgtcacacgattttcccagcagccctgtaaggacagggttgccaatcccatttttattgttgggggaaatgaggctcggagaggtttaaaaaagcaccgcttctaagaggaagaactgcagttcaaacccaacttgttctcctgagctcatgttctttttttttttttttttttttatttttcaacctgtcatactaggcaatcatgttcttttcatcataccaattgcgtctttctgaaggttttgtcttgctatgtctatgcctctgggaggggaattggaaaaccaggaaagattttggaagcaggtggggccatggggctggaattactctcccaggaagtagctctgtgcagtcttataaaggggctcccttggcatgtattaactggtccagtagcttttagggacaccctgagctttatcagatctcttgatcttttggcctctttcaccaaatcctgagttcccaggttccctgaatattatcccatacctgggttcaacttagtttggttccactaatatttccctatcacttctctagacactgctggggagataagtatggttagagtcagtccctgcccccttaatctgatagttcttagggaaccaggcttggttttggaggctgcaggaagggaactggtagaagagattgattgattgattgattgattttgagatggagtctcgctctgtcgcccaggctggagtgcagtggcacaacctcggctcactgcaatctctgcctcctaggctcaagtgattctcctgcctcagcctcccaagtagctgagattacaggtgctcgccgccatgcccaactaatttttttgtatttttagtagagacggggtttcaccatgttggccaggctggttttaaactcctgacctcaagtgatctgcccgcctcggcctcccaaagtggtagggttacaggcgtgagtcaccacgcccagccagatttattttgctaagtgcttgtgagaatttgaaataatatatataagatacttggcatagtgcctgggtggtggtggtctgtaaaatggtagatgtgaggtttagaaagatgattctggattcagacacgactgcctgaagtcattgcttgggaaccagaataggcttttccttgatagcatgggggctgtgttcttctgtgagataggaaaaaaccaaagtgttttttctactctcacaaccagcacaacacttcacttctgacaccagaagtgtgggggtttttcctcacacaccaagcaattctccagcagacaccagctgggtgacctataattcacttcagctctgacactatttatctggagatagcatcagatcctgtgggttaggggctcagtccaagacttcaggtgccaattgcaagtctcaggttgtgacttgtggttctgactgacctgctataaattacagttcccgagaatccctccctgggttcgattaatttactagtgcagctcacagaactcaggaaaatgttttacttatgtttacccatttattatgaaggatattacaaaggatacagagaacagccagatggatgcataaggcaaggtatgggagaagagatgtgaagcttccatgcccaatctgggcaagccaccctccaggtacccccacacaggggcttcattatgtagtcatgattgatcagatcatcagccatcggtgatcagttcaaccttcagcccctctcccctcctgaaggttgtaggggtggagctaagagtcccaaatctaatcctgccttggtctttctggtaaccagcccctatccagaagctatctatgggcctccagccataatcatctcattaacatacaaaagacactgctcattcctgagattctaagggttttaggagttgtgtgtcaggaactcacgggtagaagactaaatatatatttcataaaaccacagtccactttgatcttcaaacacagatcccttacatcagaacaatcatgtaataaatagaaagatgctgggagcggtagctcacgcctgtaatcctcgcactttgggaggccgaggcgggcagatcatcggaggtcaggggtttgagatcagcctggccaacatggtgaaaccccgtctctactaaaaatacaaaaattagccgggcatggtggcgggcacctgtaatcccagctactcgggaggctaaggcaggagaatcacttgaacctgggaggtggaggttgcagtgagccaagattgcgccactgcacttcagcgtgggcaacagagtgagactccgtctccaaaaaagagtagaaagatactggcacattactagaatcccactgagtcattaattaataattagtctagtccatgatcatgtcatgtaaaaatgtctcctagggtgaggccattcaggtttgcaggcttctattcaatcttgttaggttccaaaaccaggagtgttctcggcaaacatagcttcatactttcaggcatctgggataattgtgctaagagacaatatcatctcttgctctgaacctcttttgaggtgttaatgtaatactgagtttccctcattacataactcatttattcatttctttacctcccttctcttacccaaacttttccacctttcaaagggacgttaggattggccactgtgctgatctggagtgcacacagcaagctagtctgcaattgcctcctcctcagtccatacagtctcattcagatagggtagggttgcatgggtacagaactagtgggctgtcttttttgtttgttttgagacagggtctcattatgttgcccaggctggtcttgaactcctgggcttaagctgtcctcccattgcaacctcccaagtagctaggattacaaacacacactaccatgcttggtattgggttatcttaaccactaggcaatacagttgcattcacttcctgatatagattctagtctgtccccctttccatactgggaattaggattcctgagccagcttccaaaagcttcatacttcagttttcccttcctactttactcagtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaggcttgttggggattgggtcaggccagtgttcaagggcccctcctctagtactccctgtttgtgttctgccactgactgagcttctccccacaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaaggtgtggattcccttgcccaggctggagctggacaggctcagtactggagattcatttgttcagcttctccccctcttctctcttccccctgctgtgtgtagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagtaagccacaggcagtgctgtttttagcagtgggagtcctaagcctaggtcagccaccaccttaccacctagcccttctttcttgttcccttcaggagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggtggggcctggccttcagccctgttctccaaaggccatccacacattcctggcctaggtttctctgggggtggggaacttgtttcacttccccgtctcctcccagcctgccgcagggagtcaggtatagcatagagtcagacagccaggggttcagagcttggctctgccttgagtatgacattaggcaagtattttcacctctcagtgtcaaccttcacatctttatctgtgaaatgcgagttaagatgatacctactcggccgggcacggtggatcacctgtggatcacctgaggtcaggagttggagaccagcctggccaaacctgtctctactacaaatacaaaaaattagctgggcgtggtggcaggcgcctgtaatcccagctacttgggaggctgaggcaggagaattgcttgaacccgggaggtggaggttgcagtgagccgagatcatgccattgtactccagcctgggtgacagagcgagactctgtctcaaaataaataaatgatacctactttatagggtcattattgaatgagttaacatgtaaagtgcttaagactaccatgtgttcagtttatgttatgtgctattgttagcataatttattcattcaacaaatttgaatttttgaaagtgagctatgggcatttcagtccctgcttgtggtagtgggcggggcggggggggactgttctaggtatattaatgtgttttgttttttttactgactacttccccagaccgccctagaggttttatatgtagtgtgtgtatttatatatctttttctaaactcaaaaaatctaaactgaattctgaaacaactctgcccccaggggttgtagatcaaagactgggacctatacctaatgatgtttactgtgtccccagccctgtggattgaagctggctgaactggatgccagggaagaagccatgtgatggcttcagtgcaacatcatggaggcttgactagggcagtagtgctaagccaggttctctcagttgtggagagctagcccttcctgactgtggggccaatgcagtcaaggtagctttttctccaaggagcctggtctgctttgtcctctcaacccattgcctgtaggaaaaatccaagctggagagtgagctagccaactttgggcctcgcattaatgatatcaagaggatcattcagagccgagagagggaaatgaaagacttgaaggagaagatgaaccaggttggtagggtgtgggccatgccagcgtgtgtgtcagggcaggactgggactggaagcaggacagactaaaagggccgatgccctccctggcttctcttctcaggtagaggatgaggtgtttgaagagttttgtcgggagattggtgtgcgcaacatccgggagtttgaggaagaaaaggtgaaacggcagaatgaaatcgccaagaagcggtaggtgggaggattggtagaagagattggcatgcccttgagcctctagcttgacatccttggaaaaccagatgctgtcataggcaagggtcagctcttagaactatgtgagtttatgtagctaggccttaaagaacagaaatcaggagggcagtatggcatagttatagtggttaagagtgccaactctaaacttgattttctggattcctggattacaaccccagctccacaactcgttatctttggcagtgacttgacttctgtaagctgcaatatctgcaaaatggtataatgatacctatctcatggcattgttgggaggattaggtgaaataattttttttttttaagattacctgttttaccttttttttttttttttttttttttgacacaggatctcactctgtttccgagactggagtgcagtgtcaatcttgaccttcccaggctcaggtggtcctcccacctcagcctcctgagtagctaggactacagatgtttgccaccacgcccggctaatttttctttttttgttttttgttgttgttgttattgtagagatggggttttgccacattgcccaggctcgtcttgatctcctgggctcaagtgatcctcctgcctcagcctcccaaagtgctaggattataggtgtgagccatattgccggcccttttttttttttttttttttttttttttgagacagagtcttgctctgtcgcccaggctggagtgcagtggcatgatctcggctcactgcattctccaccttccgggctcccgtgttcatgcaattctcctgccttagcctcctgagtagctgggactataagtgcacgccaccatgcccggctaatttttcgtattagtagagatggggtttcaccatgctggccagactgatctcgaactcctgacctcgtgatccacccgccttggcctcccaaagtgctgggattacaggatgagccaccacgcctggccccaacccccgcctggcttttttttttttttaacctttttaaaaggtatttagcagcttacatatcatctactaagagcaagaaatagtagcttttgttgttattatcataatgggcaacgtgaggtggagggaggcgggagatgaaattcttggttgaaacaatagtcagaagaaaataatcttctcatttttcctcactttagttgattcattcattcaacaaacctttgttgagtacctaccttgtgccaggttgtcttgtgctaggtattggaagggggacaagggagatggaggtaagacagatgaacacaacacagtctttgctgaaggaggtcatcccttgtaccctgggcttcagttagcagtttagccctttgcccatacagtaaatattcattgctgtcctacttcaagccagtctcaagggatatagaattgaatcagactgtatttctttcctcaggaaacatatagagtactgggggaaacatcaatttgaggacagtgtgatcaatggtgtaattaaggtagatacaaaatactgaagaaattttcaaggaactgcaaatcaacaacaggaaaaataaaaaacaatgacaagaaacccaatggaaatgtggctaagtacttatgatacccaatgcaatgaaaaaagtaaaaaaaaaaaaagtggcaaataatatagataggctttcatggaaagagaagttcaagtggctaatgaccataggaattgaggtctaacctcttaatcagagaaatgcaaatttaaaagtctgacagtattaggtggaaatctatagatgtcctgtgtagtatgtgaaaaaaatatatgtgtatatatataatgtatatatatacacatatataaaacctatgggtatatatccctgagagagtcttgccatagggtcccaaagagatacacattcagtgtcattcatcttggcataacttgtagtagtgggacattggtggcaatgtagatggccattactgggggagcataagtcaaatgaatatatagactggaatactgtgtgggagttcacagcaagaactagatttgtgggcagtaatggataacttataaacctggtattgaccagaaaaaagaataaaatttataacacagtagatttgtgtaaattttagaactaagacattttacaaggatatgcatttttaaggaatgcatgtgtgtatgtcactttgtggtgcatgttcacagtagggaaggtaatgggaatggaaattggggattgaaacaaagaggacaagggaagggtcttgcccaggcagtggtgataagtgtgttatgaactgtgggatatgattaacttgcttctgcacctaaagtctaaaaagggaggaacccaacaaagtgtaatagaaactaggaacctgctcagaaccgtcaggaaaggttttacaaaacagggagtgatgactggagacctgaagagtgagtaggatttagccagccaggcagcgacagaaaaagtgaattccaagcagagagaacagcatgcttggaagtgtgagagagcatgccttgttctggatactaagtagtttttaatgtctggagcataaaagcagggtcaggaagaaggtggggagtggtggagaggtcagcaggggccggatcacagaggcctttgtgagtcatacttaggagattggatataaaattgcatagctcaaaattatagagttagttatatttcatttggattatagtggctaataggtttaagctgctagcatgacatctggcaacatctgtcacaccatattgggagttggagagggcaattggaagttagtcctgcctggcctgccagtgcctgtgtatgctggttgcatactcttgagtttctgaagagatggagaggaggacaatagcaggaatccagtattttctccatgtttttgtactatccaagttctgccctttaagaggttctgggaccttggggcagaagttgggatgctgtagttgaagcccttggacaaaagtaagctgagtacagtcaatatacctggtgataatggtaactaaaattgattgagtagttatcgtggactcggtgtggttctaaggactttatacatattaactcatttaaaaatctcccaataaccctgaggtaggtactattattatgttcattttgcagatggggaaacaggtctggagagtataaccaacttgcctgaatgacattactagtaagtggcagagttgagatgccagtcttcttaatccactacattatgttgcagtggtggtatactagaaagagcccgggttttggtgttaaatctgggtttcagtctcacatgtgccatttactagctgtgtggccttgggcaaggtcttttacctcttggcctaagttttcctcatttgtaaaattaggataataatgcctacttgcagagctgttgattagaggattagagataatgtatgtaaagtacatagaagcctaataggaattaccatagctggtagaatcagatggactcttttatgcctccttgtaggaacttggagggcgctggggtcttcattgtttaaagggggataaataaggtttggccgaatcttccctgccttatgccatgtccacagggctaggctgaggaacttagttcttcagcttcaggggaccgttttatgtgcatatggatggatgaagcaagttgtgactgaaaatcagtaactctgggtccctgagccctgggtctagtttccctttcttcccatagttggattttgtacattggttatctctggctgatgagattatgagtgattctccccccacctttatacacagtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggtaaggaaggaaagaattaaaagacagactaataactgggaggaaaaatgggaagaaatacgacagacagaaggataatgtccacaacttagaaatttctcatctaaatcaataagaaaaataccaagacctaaacgggaaaaatggataaatgtcacaaacagttcaagaagactttcaaatagtccctaaacacatacaaataatttagtcttactaaagaaatgcaaattaaagcaacaattagatacaatgtattttgtaacacatcgtggaaaatgtaaaaacagaagacacaatgctcaataccagccatggtataggagaccagtattctttttttctttttttgagatggagtcttgctctgttgcccaggctggagtgcagtggcactatcttagctcactgcaacctccgcctcccgggttcatgccattctcctgcctcagcctcccaagcagctgggactacaggtgcctgccaccacgcccagctaatttttgtatttttagtagagacggggtttcaccatattggccaggctggtctcgaactcctgacctcatgatccacctgcctcggcctcccaaagtgctgggattacaagcatgagccaccgtgcctggccaggagacgagtattcttatgtaatgtggcaccatccttcaagaagcttcacaatgcatttatactctgtaactcagtagtacctgaggagatcatccaaaatgctggcaaagctttatgcaaacactttgatgtttataacaagcattatttatagttccaaattggaaactactcagtgccccttggaaagtgggaatttagcaaatcatgctacgtttgtaacattatttatgtagtgtcttcaaactttagtaatacacagaccctttttaaaggaaaaatagtccctaagattgccagtgttgccttaaatccgtgatgttacttaagtatatataaatatatatacttagaacacttaaccaaatgctaagacaaagttaaaaattaaatactaacaaaatgagcaaaatttagattgaccatgtaaattcagtgcaacaaatgatgatgttttgctgaaacctagtcacttcacagtgtgactgtgctactgactgctacagctcagttcttttgagtttagcatgcctgtgccaccatgtattgtgtgatgactcaattttctcacaccctttctctttaaactactatgaagcctttgttccttacagcattccctcctgaggtgatttggccttctcttggtttgaacttattgtttgacttatgtctgcctatgtttgtcgcttgtttctgtgttttcatcattaacccctgatgattaaagtagtcctctttagtgtctgaaatcttttttttttttttttttttgagactcagttttgatcttgtttcctaggctagagtgcaatagtacttggctcactgcagcctctgccttccaggttcaagcgataactcctgcctctgcctcctgagtagctggaattacaggcacccgccatcacgcctggctaattttttgtattttagtagagatggggtttcacaatgttcgccaggctggtctggaactcctggcctcaagtgatccgcccgcctctgcctcccaaagtgctgggattacaggtgtgagccaccacgcccggcctggtgtctgaaatcttaaatgcagttgtagcttgggcagtaaaatcctgaggcaagacaagttagatacctagatgatttgggatattacatatatgtaatttttttactttttattttgaaataattttcaactttgcaaaaaattgcaaggaatagtacaaagaactcctatctacccatcaccaagattcatcggtcatcaacatgttgccgcattatcttttgcattctctctctatatatatgcttattattttttatgagccatttgggagtaagttgcagatatgtcccctttatgtgattattatttttttttttgagacaaggtctcgccctgtcgccctgtttagagtgcagaggcacgatctcagctgactgcaacctccgcctcccaggctcaaatgatcctcccgcctcaacctctcaagtagctgggaccacaggcgtgtgccaccacacccagctaatttttgtattctttgtagagacggggttttgccttattgtccaggctggtctcgaactcctgggctcaagcaatctgcccaccttggcttcccaaagtgctggaatcacaagtgtaagccactccaccaggccccctttatgtgacttaagatcaaaatgaaaacaaaaattttcctttgtaaaaatcagaacattatacataaggctataatcccctttggctgaccactcttcatcctagtccccttcgtcttgccagaggtgattcttccagaccctttaaggatttacttaaatacttgtacatttacatatgtgtattcatagaaaatgcacagtattgtttgtgtgggtttaaaaaaaaaaaaacaacaacaaatgttaccatactgcacatgacaaagttttgatgtagaaaaaaatgctcaaatataacattaagtcagaatacagagttttaattacagtctagtctcaactatgtaaaactgtctgtaaatcaaatgctgaaagaaaatgtgctagaatgttaattgattatctagctgatgagattgtgagtgattccccacttaatactttctctatacttttctacatatattagataacttgtaaaattggggtgtgtgggagaggacaaccaaattttaaaaagataggaggctgaggggtgatgggggtgtgaaagcaaagctcattgacgagtgactccaataaactgcctagtaggaagggtgggagcaggagaatatcccagggtaagatggggaaagtcttcacctattgtcctgttcccactgctgggaccaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaagtgagtgggttcaggcctggggtgggaggacgtagatagagcaggcagcctgccagatttgggtctcacctagcccctggaccttttttagggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagaggtgagtattgtggctggtggtgggagtgggcgatgaacatcattaaccagggatggggagtgaaagtgaccaggaagggcagtgagagagagaaagatggtgggcagatggtgaagggacatgaaaagggatgcagcagaaatgaggcaaggtgcagtggtgaaggcaggtgaggcgaaaggtaataatggctttggtgtgagagagaagttgaattgggagtaaagctgcaagccagtgagtgggtggtgagagagttgagccaggaaagaatgaagtaattcattaaccttagggacctgagctatattagctccagcaggtgacagaaattggtaggagtgggaattgagggacattagccaagagcaaaggaagacagaaagctaggggacctgagggtgatagcttagctgcagtgaggaagattggccaggagagggttaggtaagggacatcagcaatgcagaggtgaggaagtttagttataggaaaaccagagatactagccaaagaggagcagtggaagcaaagatttgtagcaaggggatgggaaatgttaactgagaggaggtttgcatatattaatatcttgtcttagacctggttatatatctcagtcccatgtatctttctccctcctcactttccaaatggcatttcagtttaattcagtaaaatattttgaataccagaaatgttctgggcatcatggtagcatgtgacataattaccccaatcctaaccacagacctgccagacaggcattatccccacattacaggtgaagagactcaggatctgagaatgtgacttgcccaaaatcacaatgttagtaagtgtagacctcaaattttttttatttatttttatttttattttttgagacagagtcttgttttgtcacccaggctgaagtgcagtggcgtgatcttggctcactgcagcctccgcctcccagtttcaagtgattcttgtgcctcagtctcccatgtagctgggattacaggcatgcaccaccactcctggctaatttttgtgtttttagtagagacagagtttcattatgttggccaggctggtctcaaactcctgacctgaagtgattcacctgccttggcctcccaaagtgctgggattataggcgcaagccactgcacctggccatagagctcaattttgaacttgagtcattctgcctgcaaagcctctgttccttctgccatggtgctttctagcaaggtgctttctcaaagattgaaggctgcaaaggagctccctatagaggtgcactctcatggccagtctgctccacttgactctccgttgccattgcagggtagctcccagggggaggactcagtgagtggttcacagagaatttccagtatctatgcacgagaggccctcattgagattgactacggtgatctgtgtgaggatctgaaggtgaggatcaaccacaggggtgtggtgggggtgggggttgggtgggagtgggactatcttcctagttgtccagagaggaggtcagcccatctgggggctctgtgaagaccatggctggaaagaggggaaagctggcaagggtgggaggattcagttgtgaggcaggatctccacctcatatattcaaacagacatatgcacattccctaccccataccccaagttgcccctgcccttgcctgctatcagtcttccccttccatgtgtgtatataactaagctaagcctaggtccacacagagaagagacttcagtacagtgaacagattgacctcaggtgttcctcagggctctttcctcctcacttggcattctttcatcctggatatcactttacttccgtggcttccgctgcaatctctatgctaggtcccacaggtacctcaagccctagccttcctccccatatttacccatctcctcagtgccactcacatgctcagccagaaatttgagcctcatccttgacttctccctctttcactttacataatcaattaattaccaagcaccaagccctatggattctgcctcctaaatatcttttttttttttttttttttttgagacggagtttcactcttgttgcccaggctggagtgcagtggcatgatctcgactcactgctgcaacctctgcctcccaggttcaagcgattctcctgcctcagcctcccaagtagctgagattacaggtgcccgccatcatgcccagctaatttttagtagaggcggggttctaccatgttggtcaggctggtcttgaactcctgacctcaggtgatctgcctaccttggcctcccaaagtgctgagattacaggtgtgagccactgtgcccggccctaaatatctattgaattctggtttttgtttccactgtctaatgcaggccactttcatctcacatagccaactacaggagcctcctaaatagtttatgatgtgtttcaatcatcattatattcaggaggatttgatttttttaacttatggaaaatttcaagcatatggaagtaaagagaatgataataatgaacctcaggcactcagcttcaacagttaagcaatcttattttttataccccccattggagtattttaaagaaaactagacattactccatccgtaattacctcagcatgtatctctagaatatgagaacttttaagaaaaacaaccataatattatatctgaaaatatttaacaataactccacaatatcatctaatcagtaaatgtttagatttccatgaaagtcccataatatttttttatttttattttttttgcagtttatgtgtttagatcaatattccagtaaggtccatatgttaaaattggtctctgctagtctataacattttcttcttcgtttttattttatttttttccttcgtatttatctatggaaggaactgggtcgttggtactatagaattgtctgcattctagatttggctgattatgtccccttgatgttactgaacatgttttttctattccttgtatttcctataaactggtaggtaaatctagggtttgattggattcaagttctttttttggcaagaatatatcataggtgatgttgtgtacttgtgaacttccttctacatcacatcagtagacacctgatgtcagttctcactttctttgtaatgttaacattgaccagtgttcaacattagctatgaagtattcttgccaaaaaacaaacgtggatctgatcaagcttctatatccaatcctcctgaatatgatgattgaaacacatcataaactatttaggaggctcctgtagttggctatgtgagacgaaagtgtcctgcattagagacagtggaaacaaaaaccagaattcaatagatatttagggccgggcacagtggctcatgcctgtaatctcagcactttgggaacactatcagaaacactggtgccagaggaatgttaaaaaagcacttgagggtcaggcgcggtggctcacgcctgtaatcccagcactttgagaggctgaggcaggtggatcacctgaagtcaggagtttgagactagcctggccaacatggtgaaaccccgtctctactaaaaatacaaaaattagccgggcatggtggtgcatacctgtaatcccagctactcagaaggctgaggcagaatcgcctgaacccaggaggctgaggttgcagtgagctgagattgtgccattgcactccaacctgggtgacaagagcaaaactccgtctcaaaaaaaaatgcacagggatgtagttaaccaaatccagactgggaaatttgtttttttgttttttgttttttttttttgagacagtctcgctctgtcacccaggctggagtgcagtggcgtggtctcggctcactgcaagctctgcctcccaggttcactcgattctccttcctcagcctcccacgtagctgggactatgggcacctgccaccacgcccggctaaatttttttgtatttttagtagagacggggtttcaccgtgttattcaggattgtctcgatctcctgacctcatgatctgcccacctcagcctcccaaagtgctgggattacaggcgtgagccactgtgcccggccgtggaaattgttaatatttttaagtgtaatagtggtattactattttttttaagtccttatcttttataggagtggttctcattgagagggtagatattttgttcccccaggggacatatgacaatggctggagatactcttgtcacgcctacttgtcgtaactggggtaggggggttactactggcatctagtgggtagacaccagggatgctgctaaacatcctactgtgctcaggacaatccctacagcaacgaattacctgacccaaaatgtcaatagttcaagaccctgtctcaaaaaataaaaaaataaataaatgttggccaggtgtggtgactcatgcctgtaatcccagcactttgggagtccaaggcaggaggattgcttgagcccaagagctaatttttaaaaattagctgggtgtgatggcatgtacctgtagtcccagctactcaggaggctgaggcaggaagatcgcttgatcctgggaggttgaggctgcactgaacctagatcacaccagtgcgctgtagcctgggtgacagggagaacctgtctcaaaaaagaaacttcaatgtttagatgtcttttatgtttcaatctgttggagtcatttttcttcttcttctctttttttttttttttttaacgtggagacaaggtctcactgtgttgcctaggatggtctcgaacttctggcctcaagtgatcctcctgtttcagcctcctgaagtgttgggattacaggtgtgagcctctgcacctggcccatttttctttgtttttgtttgagacggagtctcactctgtcacccaggctggagttcaggggcatgatctcagctcactgcagcctcttgcctcctgggttcaagtgattctcctatctcagcgtcctgagtagctgggattacaggcatgcgccaccatgcccagataattttttttatttttagtagagacggggttctgccatgttggccaggctggtcttgaactcctgacctcatgtgatccccctgccttggcctcctaaagtgctaggattacaggcatgagccaccacacctggccccatttttcttctttttttttttttttctttttctttttttttttttttttttttttgagacggagtctggagttcagtggcgtgatctcagctcactgcaagctctgcctcccgggttcacgtcattctcctgcctcaagctcccaagtagctgggactacaggcacccaccatcgcgtccagctaattttttgtatttttagtagagacggggtttcatcatgttagccaggatggtatcgatctcctgacctcgtaacccacccgcctcagcctcccaaagtgctgggattacaggtgtgagccaccgcgcctggcccccatttttcttcttgatgctcacattgttcatccttggccagtgggaaccacttcaagtttatttttttgttgttatttttagatttttattatggaaaattttatatgcaaaagtaaaatactacagtgctccctcatatagccatcaccagttttaacaacagtcagctgctggccaaacttgtttaatgtgcacccccacacagttcttttttttttttgagatagagtctcacactgtggcctgggctggtgtgcagtggcacaagcttggctcactgcaacctctgcctcccaggttcaagcgattctcttgcctcagccccccaagtagctgggattacaggcgcccaccacctcgcctggctaatttttttgtatttttattagagacgggatttcactgtgttggccaagctgttctcgaactcctgacctcgtgatcctcccgccttggcctcccaaagtgctgggattacaggtgtgagccatggggcccggcccccccgccccctgacactttattatccctccctatccctaggttattttaaagcaaattctgggccgggtgcggtggctcacgcctgtaatcccagcactgtgggaggccgaggcaggcggatcatgaggtcaggagattgatcctggctaacacggtgaaaccccgtctctactaaaaatacaaaaaattagctggccgtggtggcacgtgcctgtagtcccagctacttgagaggctgaggcaggagaatcacttgaacccaggagtcagaggttgccgtgagccaagatcacgccattgcactccagcctgggtaacagagcaagactccgtctcaaaaaaaaaaaaaaaaaaaaaaaaagaaattctggacatcatatttcatttgcaaatattgcaggatacatctctgaaagagataggaattcttaaaaataattagaaccattacatatctaaaaataatttttttttttgagacagagtctcgtactatcacgggctggtgtgcaggggcacaatctcagctctctgcaacctccgcctccctggttcaagcgattctcctgcctcagcctcctgagtagctaggattacaggtgcccgccaccatgcccggctaattgtttgtatttttagtagagatggggtttcactatattggccaggctggtcttgaactcctgactttgtgatccgcccgcctcggcctcctgaagtgttgggattacaggcgtgagccaccacgcttggcagtaatttcttaataattagtgttacacatccatgatggtcacacgcaaacacacactctacagcttacctgcttgaattggaagtcaaataagatgattgatcaatagttagtggatgattgataaagccattaattgatatgtcacttgaatctcatttaacttataggatccccctccacctgtttttatttttctttgcactatttttttgttgttgtagaaattgactcatttcttctgaaggattgttcacattctatactttactgattgtgtcctgcagtgtttaaaatgttcccttcacccccccgaccaaaaaaaaaaaaaacaaaaatggttctgctatcctctgtagttcttgtaagtgggtagttagatgtagatcagtgctgttcggaagaggtaaaatgtgatccacatatgtaatttttttttttttttttttttttgagatggagtcttgctctgtcgcccaggctggagtgcagtggcgcgatcttggctcactgcaacctccgccccccaggttcatgccattctcctgcctcagcctcccaagtaactgggactacaggcgcccgccaccacgcccggctaattttttttgtatttttagtagacggggtttcaccgtgttagccaggatggtctcgatatcctgaccttgtgatccacccgcctcggcctcccagagtgctcggattacaggtgtgagccaccgtgcctggccaattttcgattttctagtagccacattttaaaaataaaaaggcaaaggtgaaattaattttaatactatattatgtttagcctagtgtcctcaggagtatgatttcaatgtgtgaactatataaaaattattgatgagatatttgatgatccttttttgtactgtcttcaaaatctagtatgtattttaacacagcacgtctcaattcagatgctaaaatttcctcagaaatacttgatctgtatttagatttcctaaaatttacaattgaaaaaggagacccacatacccaagttgttccaaatatccatcaaagttttccagtaactgaattgaatatcaggttttcaatttaaatgaactaaaatttcataaaattaagattttatctcctcagttgcactagccaaatatcacgtgctaagtagccacatgtggctactggcaaccggattggacagcacagtggcttggttagattcagattttggggttcgcttgtttgttgtggctacggctccttcacagctggtggtgttacttccatcagaaggtacttaatgtccattagtggctctttttgtgtggtttgcagccatgcttcttattgcatagatccattaattagtcaggggttgcaaaatggtgaccttactctatcatttctgtgtttactggctggaatactataaagagagacttcctctcatcatttatttggttattctgagatacagtttgtataggaaaggcaggctatatatgcttgatttttttcccccctttatcagtttataaaataaggaattgcttccttggctttctcaagatttgtccactgagttctcatatcattatgaatttaaatatatttggtgtctttcagtctgttgtggttattatccttcttggtgctcaggttgtcccatctttggccaatggtgactcattcagtttggcttctgaatcatttcaacacaaccctggtagtctttgatatctcccttgctttccaatatgtccagattcatcctccccattttccacccagacctggaatccactatttctccaggaagctctgacttcctttagtgggaaatgctattatttagcaactaccatctggatattggagtgttcatgattgctgagtttattagtgcttctagaacttttcaatagattgggctattaaatgcggtttttttgttgaaggaaaaatgcatcatgagttcatattgatactttgaattgaaattgtaatttttagtttaacgtcattgattttctttttgagtcttccagttattgttgctgaaaatctcagttcctagcaacactaacataataacacatttactttatcctactctgtatatactagtttgaaaaatcacaataagatattattagtaaaagggccaggcgcagtggctcacgcctgtaatcccagcactttgggaggccgaggtgggtggatcacaaggtcaggagatggagaccatcctggctaacatggtgaaacgccatctctactaagaatacaaaaaattagccgggcgtggtggcaggcgcctgtagtcctagctactcgggaggctgaggcagaagaatggtgtgaacctgggaggcagaggttgcagtgagctgaggtcgcaccgctgcactccagcctgggcgacagaacaagactccgtctcaaaaaatatatatattattagtaacaatttgattattgaatgtaattttaaatagtttaagattttctgagattctttttattattaagctaaggaaagcctcattgggaatgtatagtcatgttcctatgttttaaagtaatttgaaagaattatctgagtgtctaaccagcttaatatatagttaggtttctttgttttagtttgtttttcatttttagggattactctttttagcattttgattttttttccagctttaattttgagatgtttcaagcctatggaaaacttgaaagactagaatagtgaacactcatatgcctttcaccttagattcaccagtgaatattttaccacatttgctttttctctcatctttcccctgtctttcccctccttccctcttgcctcccattacttgcagtttttttgtttttgctgaaccttttgaaggaagtgtggtcgtgatacttcagccctaaatacttcagcatactaagagcaagggattgtcttacctaatcgtaatttcatattatacctaagaaaatgaataattaggtttcataatatttaatcttcaacccatatttgaatttctctagatgttctaaaagtgtcttttgtagttttttttctttttgaaactagtatccaatcaaaatttatgaatgtcttttatttattatgtctctttagtttcttttaatatggagctatccctttaccttttattcatggcattgatcttttaaagagtctatgagagttttcttggaaaatgtcccacattatggatatgttcttttttttttacaatattatttaacctgttcttccaacccttgtatctcctgtaaattggaaatttcatccagtctggaggctcaatggattcatgttaagtattttttggcaagaacatttcattggtgaacttgatgtggcatccctccaggaggtacatcatgtcaggatgtacccactattagtgatactgagtttgatccctcagttaaagtgtcagttgctaggtttttcaacgctaaatgtacacttttacctttgtcattaattagtaatctttagagtgatgctttggcatcttatgaatatcttgttccccaacaattttttacccagtggttttcacattttgatttaattttgctttaatagttatatataacatctttatgtgtttctaaaatcaaaagtataaaacaaggtacatgaagagaattcttgcttccattcctgtccccttcacctctctttctcgatagataaccctttaattagtttttggattattctttttcttgccgttatatgtttaaaatagaaatatatttgtattccctctaccttcacttcaataaaatatagatacactattgtgtagctttcatattttacttaaaaatctatcctggggccgggcgcggtggctcacacctgtaatcccaagcactttgggaggcctaggcgggcggatcacgaggtcaggaggtcaagaccatcctggctaacacggtgaaaccccgtctctactaaaaatacaaaaaaaaaattagccgggcatggtggcgggttcctgtagtcccagctattcgggaggctgaggcaggagaatggcgtgaaactgggaggcggaggttgcagtgagcctagagcgcgccactgcactccagcttgggcgacagaggaagactccgtctcaaaaaaaaaaacttaaaaaaaaaaaaaaaaaacctattctggagaccactccaaagtagtgtatagagatcttcataagggctttctaaaatgtacataagtttatgtccttcttattcttgaaatcattcactggtacctcacctttctcaggataaagtctaaaccttataaggccctttataatctggcttctacttgtctatctagcatcttctctttctgtgccctccaacacacttgtacgcatgcacatacacacacaattgctactactgccatatatatatatatattttttttagctttcgaagtttattgaagttgattactcttttttttttgagacaaggtcttgcactgtcatccaggttggagtgcagtggcaccatcatggttcactgcagcctcgatctcctgtgcctaaacagtcttctcacgttagcctcccaaggagctgggaccacaggcatgtgccaccacgtctggctaatttttttatttttgtagagacggagtctccctattttgcccaggctggtctcaaattcctattctcaagtgattttcctgacaggctcccaaaatgctgggattaaaggcatgagccaccattcctggcttgctttctcttttgaattattttcagtttgatgaacggaccatgagcaacctcccctggctatttttttgtgatgctcccaactgcatagaagtctgttcctggccgggcatggtggctcacacttgtaatcccagcacttagggaggctgagatgggtggatcagttgagctcaggaatttgaggccaacctgggcaacatggtgaaactctgtctctacaaaaaatacaaaaattagccaggcatggttgtgcgtgtccgtagtcccagctacttgggaggctgaggtgggaggatcacttgagcctgggaagtggagcttgcaatgaccagagatcatgccattgcactccagcttgggtaatagagcgagactctgtctccaaaaaaaaaaaaaaaagtctaaaaaggtctattcgttttctctgtcttcacttgttcatcctgtagtccttagcttaaacatattcctggaagcctaccttaatttttatcacccgatgaggtaaccatccagaacacctcaatgcaggcacatattctatacactagtgggatccctccctctacttattatacttatttatacccaaaataccctaggctcactaaacataatagtactaacattcaccactcaagaactatcaatctcctgatctctgagttaggagtctgagtcctcctgagtctgagttaggtgtctttcttgtgtgctaagtcaacactgcctgcttatcattgttttcacattcatcctacagtattctggttgtttacttatgtgcattcctctgttagacccctgagctctgtgagcacagaaaccagggctcacaggacaggatggccccagtgtctggcacttggtaggcattcaataaatatttattgactgaaagtggcagaaaggcacaagcccagacatgcattgcaatatccataagaactaaaactaaactctaatggaatttgctcaaatgtagtgatctaagcagaaaacgtgaattgccttacttattgtggagctgtaagtggagtccaaagcggccagtgtgggagcctccaggtcaccctgggttggtactggctcatggcctgggctgagagccagagaggggcaccaccagctgctcctcctgagagacaaagcggttggcagggcctgggggaagggctagagattagaaagcagctagagattagaaagcagcctcagcctataatttccagagatggtgggaatggttactatgggtaggatctggtggaaggaaccgagctggagaagaagaacctgccctccgtataggagcaggcgcccaggccacactcagtcagtcatctttcggtgggggccttggcacaggggccaggcccttcttgacattgctgggcctggggcttacaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatggtaagatttacccttctacttgggcctacgatgaggacaagaggctaagggtatgccacgggcctgctatacatcacagcagttcctgttctgacatgttttcttacttaaaactctcaggagccctaaacagtaggggttattacacctgctttatagaacggaaaattgctgaggttcccggagagtaaatgacctgttcaaggtcacacagctggttgctggtagaacacagggaggaatccatatttgtgtggctccaggcccctgtttcttgctctgcattgtatccagtggccagtccactggatacagatccttctgggaccctcctcaggcattcctctctctcagtgggatgttcctgctctggattgtcatttgcaggtccttcttgccagggcactgaggggtctcctgtctttctttctggcagagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggtaggctggagccccttacccaaccagctgctaccatcctcagttgtccttccctctaggcttcctgtccctatctccatccagtctcagatacagatcctgacccatctgccttcccctaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacaggtaaggctgatcccctagggcagttgacgaagagactgaactgaggccaccagaggctctggggcccaaggatacacagagatctgcgaaggtgatggtttggtggaatctggattgcatccctgtttcactatctactgcagcatatctggctttggtttttctggacctgtcttccccatccaccctcatctgctcagcatgtcctcaccggcctctgcatgtatttagttccgcctccaggcttttgctcacgaggttgctggctaataatccctttccatgtaaatctagcttgatcatcacctttcaccccttcacccttcctcattctcctcccctttaggaagccctccttgatcactgtggcataccctgaccttcccctcctgaatgccagtagtacttgagtctgactcccgcagcttatattgcttgattgtacagcatcaatttcttgagtgctgctctgtaccagaccctgcggagggattagggacacagatgtatcagacagggtctctggcctcgaggagctcacagtctagtagaagccagatgcataaacagacatgtgctaagtgttgtaaccgggtgagcatgggtgcgatggatacacagaggaggtacacttaacccagtctgtggggagggtatgggtaggccagggaagacttttaatgacaggtgccacttgagcaggagatgtaaaggatgagtagaagtgtgccaggtagaccagcaggcattctaggctgagggtgcagcatgtgcagaggcaaggaggcatgacaaagcatgctgtgatggcatgtgttggaatggggtggacctctaggtagctcggtcattacaactagaaccttggacagctttagctccccagccagcctggaagctcctgaggggaccatgtcttcttgtggttctgtaggaacctggaacacagggctgattgcagaggggagggctttgttgatgtcttggctttcaggggctcaggcaactttgagacctgggttttttagtttctgaagaagtggagtgggaagctggcctgtttgatgggccctggggctgtcccaccccgccttgccaccccctccccgcctcagtgtcagctcacctactggttccctcccagctacaagccagcccccttcttcgtcctggatgagattgatgctgccttggataacaccaacattggcaaggtgggtgcaaagaaagtggggcctgggagggatgcccccaggtcggggttgggtttcagggagcaactcctgagcgtgccctagccgttcctgctgcctgctctctgtgcctgggaggctgggcccagagtcatccatgctgtggtagtcagtagtctcctctcaacctctcttttccccaccttcctctccctaccctacctcttctgccttctggttgtggctggaaaatactggggactgttaaggtttgagccttgctaagtgcctggcggcctttcccacaggtggcaaattacatcaaggagcagtcgacttgcaacttccaggccatcgtcatctctctcaaggaggagttctacaccaaggccgagagcctcattggagtctatcctgaggtagggcgggcctggctcaggagccagtcctactccctgcctgatttcccagggcaggaaaggaaggctgcagtggaggggaaaggaggtgggggagcatagggaatcaggtcctgaatggccatttgggcttgttggagccctgcctctggaggcttagccagcccagccaggcagggccattgcatttggggacaggtggaaaggcaggcagaggcagccagacagtggagaaaggaggagagtacagaagtaggcaaggagcgaaggcacatgggactgagcatatcctctcacacccagagagaaccattgactgggctttgggcaggtatgtagggaggagggtttgaggcccctggtcctggggcactagacccctcttaattctctccttacaattttatttttctttttctccctcctccttcagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcctgaggatccaggaggtgaggtgacttgtccaagattccactggtttagtggcagagcctagacttccactcggatctatttagtgcttgccccctgctctctcctgtcgtgccccaccacctcctggcatcacagggcaaccgttgtcaaggctatgctcacgggaggctgggcaccacagtgtttccaagagcaagctggatccgagtagattccctagggcttgttggaggaactagtttgactcccttatactgtggacgcagtagccttgctgtagggagttgaagagtactccacaacagtatcttaagtttaactgggcacttccctctggaaatcacagtgttgtgcaccaggaacacaaagatgagtcaaatctttatcctgcctttgaggagctcactgtttagttggggaaaccatttgtaaaacagccattaaccatacagtgtgatcaacactgacaggagcacaggaaaaacatctagcttatgtgaagattcagagaaggcatcctgtagtctaggtggtgatacctgaactgagtcttgagggacgggtaggaattagccagttgaggaagtagaag

SEQ ID NO: 17574 - DNA, 9027 bp, Human; identical to SEQ ID NO: 11883
  misc_feature (1)...(9027): n = A,T,C or G

SEQ ID NO: 17575 - DNA, 11359 bp, Human
cttggctcactgcaacctccatccccctgatcctcccgcctcagcctcccaagtagctgggaccacaggcatgtgccaccacacccagctaattttttgtatttttggtagagatgggttttgccatattgcccaggctggtctccaactcctgagcacaagcaatctgcctgctttggccccacaaagtgctgggaggtgtgagtcacctcgcctggcctgagatatatttttttaaataataatatatagatttttgaagcactggggggcacagggaaggcctctttgaagaagtaccatttgaactgagacctaagtgatgaaaagaaccagtccagcaaagaaccagagcccccagcagagatccaggaaaaagggctgcaagtgcaagggccctgaggcagggaagcacttggcaaggagagtggtggaggcacgaggtggaaaatgtaggtaggtcagcaacactcggcctactaggccttgggttggagtttttattttagctagatgaaaagcaactgacattttttgttttttaaaaaatttctatagagatgggttctcgctgtgttgcacaggctggtctcaaattcctgtcctcaaaggatcctctcgcctcggcctcctaaagtattgggattacaggcatgagcctctgtgcctggctgtaactgacatgttttaagcaggggaatgacatgctctagtgaaagccagtctgggcagctgggtagctaatgaggggattagagagattttgttgaatgaaaggcagattgagtcctgctactcgcccccttcattccccttcattcatgcctcattcttccgcctcccagccgcctcaactggccaaagggaagtggaggccctgccacctgtagggagggtcccctggggcttgcccacagcaaacaggaagtcacagcctggtgagatgggcctgggaatcagccactgagaaagtgggtctcttgggtccctgaattctttttctgagtccctgcagcagtgaaaaagacacagaggcacatagagagtgacagagaaagagagagacagagaggagaggcatggggcagaataagaacagatttaggagttagaactcctgggttcttttaaaacaatttttcttttagagacagggtcttgttgtgttgcccggactggagcacagtggctattcccaggcataatcatggtgcactgcagccttgaactcctgggctcaagcgatccttctacctcagcctcccaaggacctgggaccataggcgtgtaccactgtgcctggcttttgcctggttttaaactgaggcagtatgacttgagctcttaggcattaattgaagctgtatctcattaactgagggcttatgatgtgctggacactgggctaatagtgctgaacatattgtcatttttaatcttcacaaacaatatttgtataggactgttttcttttcttttttttttttgaaacagagtctcactctggtgcccaggctggagtgcagtggtgtgatctcggctcactgcaacctccgcctcctggtttccagtgattctcctgcctcagcctcctaagtagctgggattacaggtgtgcgccaccatgcccggctaatttttttttttttttttgagaaggagtctatgtgcccagcattgttctagagcacttgcaattagtggtgaacaacacggtctctactccaaggggctcacattcttgtgcagaaaacagaaatgaacaaataaacacacaagatcatttcccgtggtagtgagagctgggatgaaaataaaacagcgtggcagggaggaggcaagtgttgtgagtctggagggttcctggagaatggggcctgaggcgtgaccaccgccttcctctctggggggactgcctgccgcccccgcagacacccatggttgagtgccctccaggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaaggtatgtccaaagggcagaaagggaagggattgaggctggaaacttgagttgtggctgggtgtccttggctgagtaacttaccctctctgagcctccattttcttatttgtaaaattcaggaaagggttggaaggactctgccggctcctccactcccagcttttggagtcctctgctctataacctggtgtgaggagtcggggggcttggaggtcccccccacccatgcccacacctctctccctctctctccacagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggtgagggccgggctggggcaggggcaggaggagagaagggaggccaccatggacagaagaggtccgcggccacaatggagctggagagaggggctggagggattgagggcgaaactcggagctaggtgggcagactcctggggcttcgtggcttcagtatgagctgcttcctgtccctctacctctcactgtcttctctctctctgcgggtctttgtctctatttatctctgtctttgagtctctatctctctccctctcctgggtgtctctgcatttggttctgggtctcttcccaggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccagggtatggtgatgactggggagatgccgggaagcgggggtccagagacagaggggaggggaaactgaagaggtgaaaccctgaggatcaggctttccttgtcttatctctccctgtcccagacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggtagagtttctctcaactgggaggcatctgtgtgggggtactgggaagaagtggaagccagtcaatcttagattcccccaacccgagggctactcccagcctcaccccaaaccccaacttccacacagaacactgactccaagtctttcttttttttgacagagtctcgctctgttgcctaggctggagtgcagtggtgccatcttgtcttggctcactgcaacctccgcctcccaggttcaagtgattcccctgcctcagcctcctgagtagctgggattacaggtgcccaccaccacgcctggctaattttttttttttttttgagacggagtcttgcactgtcacccaggctggagtgcagtggcacgatctcagctcactgcaacctccaccttccaggttcaagtgattctcctgcctcagcctcccgagtagctgggattaaagcctggctaattttttttgtatttttagtagagatggggtttcattatgttggccaggctggtctcaaactcctgacctcgtgatccacccgcctcggcctcccaaagtgctgggattacagacatgagccacagggccgggccaagcctaattttgtatttttagtagagatggggtttctccctgttggaccaggctggtcttgaactcctgacttcaggtgatctgcctgccttggcctcccaaagtactgggattacaggcataagccaccgcacctggcctagacttcaagtctttcttccctcgcttccaagacactacttttctgggtcttcacctaccattgcttgcgcctgcccaccagcttgggtggagtcttccttcctccccaactcctcactcttggagccctgggccctcttcttatccctgtctgcacactttcctatttgaacttgactctcaatggcttcttgggtcaccatgccttggtgactctattccaggctccatactcagccatctcctgtgccatttgatatcccatggacacctcaggctcaacagatacaaaatcaaactcaatgtcttccccaagtatagtcttcttggtggcccagtgtaagcagagggcaccaccacctgctccctcgcccaggctaagaacctgggcatccttctttttcctcaccccgtccaacaaactggtcacagtgttctgccaattctctctccatgcaatcctatcatgctatcctaactgcaattcacaaacccaaccccaactttcactccaaacttgatccaagcaatgtgctggatcccaactgtaaccttgcaaactcaactctgcccttcactttgaccgtgactatccttaattgcagcaggaaactgatcattatgctcccctcaatccacacattgcctctgagtacagccatggtttgtccacgatttgctcaaagacactgccccatgtcctgtgccagggtctgtgacaatccctgacctcctgggacatggctccttagagagaggagagcctttctcacagcttgggactttgagtctgtgtctttttttttttcttgagacggagttttgctgtggttgcccaggctggagtgcagtgatctcggctcactgaaacctccgcctcccgggttcaaacgattctcctgcctcagcctcccaagtagctgggattacaggcacccaccaccatgcccagctaatttttttgtatttttagtagagatggggtttcaccatgttggccaggctggtctcgaactcctgacctcaggtgatccacccgcctttgcctcccaaagtgctgggattacaggcgtcaaccaccgcgcccggccgagtctgtgtcttgcctctgtgcctcagacttgcggttccttgagatctcaggattgggacgtaagatgccagcctggggtcctcgtctcatagccccttccccctagtactatggcactggctgctgaggactggtggctggaaggtctcagctgtgactttggcttatctgatcttctgcctgtgttcccttgtgggcattcttcatcttcaaagaggtgagtcatgtccccagtgggtctgtccaaaccctactccatcttccccaggataagccggctctggccagtctgacaaccatctttctttcctcccatccctcccttcaagaccccagaatcctgttctccccagtcttcctctagcctccctcaaacttcccaagcctcttgcaattttttttttttttttgagacagggtctcattctgtcaccccagctggagtgcagtggcacaatctgagctcactgtaacctctgcctcccaggcttaagtgattcttgtgcttcagcctcccgagtacctgggactacaagtgtatgccaccacacccggccaattttttatatttttagtagagacgaggtttcaccatgttggccagactggtctcgaactcttgacctcaaatgatccgcccacctcggcctcccaaagtgctgggattacaggcacgagccaccgcgcccgtccgcctcgcaatttgaactcctgtctcctttgttgaaccaagtgacctccccagcacctggccccacaaatcctcaccctgccaagcagcccctcctctgatcacgccctttaactcccaccagccctggtcctgaggaggaaaagaaagcgaatgactgaccccaccaggaggtaatgcaaccagtgcaccccgcggtaacaccctccaccttcactttatgccttgcacttactgtttcctctgcccaggggttctttgctccgtctctactgtttcaaatactgcccaacctcaaagcccagctccaaagctacctcctctgtgaagaactccttggaaatgatcatctcagactcctctattggctgtcccagcacaagtgatcacgtttaacttctgaaggcctggacagaatcttgagtgggtccgccattccattccaagtcggccctcaccgtgcacttcctcttctcccgccagattcttcaaagtgacgcctcccccaggaagcgggccccagaaccagtacgggaacgtgctgtctctccccacacccacctcaggcctcggtaagaggcaccgcccctccagcctatagctccgccccagatccggggctccacccccactctcctcatccctccaatccgctgtgcgccaagccttctggagctcggaactccgcccccggggcggggagtcccgcccagctatgagccccgcctctagaaccagaccccgcctccagggctcagagccacgcccccaggacccagagcctgaagtcgtaatcaagagcagaacttcgccccagaactgaaggcctcggccctagatttagattccgccccagggttcaaggccgggttcctagacccagagtccattcgcagagcccaaaacatcctcttcccgtgccccgccgcgcggacccttagccttgaccgcccccatctcttctgaccccgtcttacaatgcccctctcaccaggacgcgcccagcgttgggccgcaggcctggggggcactgccccgtcttatggaaacccgagcagcgacgtccaggcggatggagccttggggtcccggagcccgccgggagtgggtgaatgactgggagagggaagggtcgttccccacatggagggggttggagcggtctgtggcccgaatagtggactgggccctggaggagagggggcatgactcggttccccatccccatccccaaacccccaggcccagaagaagaggaaggggagggctatgaggaacctgacagtgaggaggactccgagttctatgagaacgactccaaccttgggcaggaccagctctcccagggtaaggctgccctcccccgtggccccccacctctgcggtggcctgtggactcccatggacacccctccttctccaccagatggcagcggctacgagaaccctgaggatgagcccctgggtcctgaggatgaagactccttctccaacggtaacttggggcctttgtgggacctcagagacttaggtgtaattgcagcgctgtgacactcctagaaggggtccctggagttctctctcttctgccacagctgagtcttatgagaacgaggatgaagagctgacccagccggtcgccaggacaatgggtgtgtgtgaggatggcaacagtccaggggggaggcggaggacacctggaggccaggaggaatagtaacctccctcttccctttccagacttcctgagccctcatgggtcagcctgggaccccagccgggaagcaacctccctgggtgagagatgctttcaatcagactgccttgcccagcttgggtgacctggcctcagctctgacaccagatccaactttgacctgaccctgaccccaaacccgaacccaatcctgtgactcctctcacctcaacactgagccccatcccccatcctgagccccatcccccatcctgacccccaatatttaccccctccctaactgtgaatatcaacaccgatcccaatgcagtatcagcctggacttgatctccacctcacctcagccccagtgcagacctcaacttggaccccagcttactctgcagcttcttcatgactctgactccgactccctccagtttcttctttttctttttcttttttttgagacggagtctccctctgttgcccaggctggagtgcagttgccacctctgcctcctaggttcaagcgattctcatgcctcagcctcctgagtagctgggattatagacgtttgccaccacacctggctaatttttgtattttcagtagagacagggtttcgccatgttggccagactggtctccaactcctggcctctagtgatctgcccgccttggcttcccaaagtgctgggattacaggcatgagccaccacgcccagcccagttctgttcttgaccccttccttagccataatctaacccatatctaaccctgaccctacagctaactggggccccaaactcaatgctaaccaaatcaccccttcccagcacagcatgggtaatgctcctcaccttcctctgcccctcagtcttcctccttaccgtaggctgtacttcccatgccctagcctccaattctccatcccccgcccaagcagggtcccagtcctatgaggatatgagaggaatcctgtatgcagccccccagctccgctccattcggggccagcctggacccaatcatgaggaaggtgggtgcttctgccgctgtcccctgctgtcccctgggctgactttgccttccagcctacttccagtgccacccatgttctcctcctccctggtcctatccagatgcagactcttatgagaacatggataatcccgatgggccagacccagcctggggaggagggggccgcatgggcacctggagcaccaggtgatcctcaggtggccaggtgagctgggactgcccctagggaaagcggggagggagggagataggcacggatggcagtggctgctggctttcagggagggagagggaacagggttcctagggcctggtgggcagggggaggactgctggacccctccccatcaccgtttcttctgcatagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcctatgaagtagtgccattgtgtgggaaggaagggaaggaaaggaaaggaaggaaagggaagggaaggaaaggaagggaaggaaaggcgtcttgaatcccatggaagagggagggctgccttctgcatacaaagggccttttcccggtgcggtggcccacacttgtaatctcagcactttaggaggccaagcaggtggatcatttgaggtcaggagttcgagaccagcctggtcaacctggtgaaaccccgtctctactaaaaatacaaaaattagctgggtgtggtggcgagcctgtagtcccagctacttgggaggctgaggttggagaatcacttgaacctgggaggcagaggttgcagtgagtggagatggtgccattacacttcagcctgggcgacagagcgagacttcgtctcaacaaaaaataaaaataaaaataaaacaaagggcctttccccttccatggcctagccttcacctactgccctcttttgcccgctgcccacagatccgtcacgatcagccccctcccaccatccagctacccaattatcattaattcagcagttacatgctgggtgcccagtggagaaacagcccaggaattagcagtctagttagaagatgctattcattgtcactgagtacttatttattgagcatctactatactcttctttttttttttgtttttgagacaggctctcgctttgttgcccaggctggagtgcagtggtgcaatcatggctcactgcagcctcgacctcccaggctcaagaatttctcccacctcaacctcccaagtagctgggattacaggtgcccgccaccatgcccagctaattttttgcatttttagtagagacggggtttcactatgttggccaggctggtctcgaacgcctgacctcatgatccacccgcctcggcctcccaaagtgctgggattacaggtgtgagccaccgcacccggccacagctcattttttattttttgtagagatgaggtcttgaatgcctcatgctgcccaggctggtcttgaatgcctgggctccagtgatcctaccaaccttggcctcccaaagtgctgagattacaggcgcccactatcacacccggataattttgtatttttagtagagacagggtttccccatgctggccaggctggtctcaaactcctgacctcaggtgatccacctgcctcagcctcccaaagttctgggattacaggcgtgagccacagtgcccgaccttactatgttctaagcactaatatcaatgagcaaattttatcgttacaataacttcacaaagatagtaagcacttattatgtggcaggattgtattcaaatattttatgtatattttatggacatgttatgtatgtttgtgtatattcattcattttatctttacgaccctatgaggtaggtatactattaatattattttcaccatttcttttctttctttcttttttttttttttttttttttttttgagacagggtctcactctgtcacccaagctggagtgggtggtgccatcttggctcactgcaacctctgcctcctgggttcaagctattctcctgcctcagcctcccaagtagctgggattacaggcctgtgccaccacacctggctaatttttgtatttttagtagagatggagtttctccatgttggccaggctggtctctatctcctggcccccagttaacagctccctgcctcgacctcccaccctgtttttgttgtagaaatttcttctttatctctgagcatgtaaaacttacttcatcttttttttttttttttttttttttttttttgagacggagtctcgctctgtcacccaggatggagtgcagtggcactgtctcggctcactgcaacctctctcttccctgttcaagcgattctcctgcctctgcctcctgagtagctgggattataggcatgtgccaccacactcgactaatttctgtat

SEQ ID NO: 17576 - DNA, 62776 bp, Human
tcatcaactcttggaatgtgagatctgaaaggcctctgacagagtattggtccatctctggaattgttaggactcttccttacaaataatagaaacccaattccaagtggctaacacaaataggaaactaataatcagaatgcaaggacaggaatgcagctgggactcaggaacatgctggatccaggtactctgacatggtcaggacttacatctctctctttacctgcttttttcccttagtccaaaacatggtggtagacaactcctgggtgtcacgtgttggatgttcagcagtcagtagagactgacctcctctatgctccagtgttaaaatctcgaagacctagtatttgatagcacaacagggtgactatagtaaaaaataatttaattgtacatttaaattaactaaaagattataattggattgtttgtaaaacaaaagataaacacttgagatgatggataccccatttaccctgatgtgattattatgtgttgtatgccagtatcaaaatatctcatgtaccccataaatatgtgtgtactatgtacccacaaaaattaaatataacaaattaaaaaaaaaccgccccattacaggagaggtccaaatgaaaacattttgtttgagtttaactggccacaggtccaatggtttcttatacaccacacagtgggtaaacagctcaagggcgggctgcccgccagcataaacctttgagtggcaaacactaccagggtggccatggaaaatgccctcttgctgaccataattgcacagaatgtgtgtaaataaaagctaaaaggaaaaagaaaattctgtagctcttccagaagaggcaaacggagaaatgaagaaatataaagagataggcactatataaatactaagtactataaatagggcatttcccaacccactaaatattttgatattttccagggatggagccagagatgttctggaaggatgaaggagactgcatgagtaattggggtggggtagcagagagtttgccaatccctacctcactgggttttagttatgtttcagttaatctgcctcctcatttacgaggcgggtattgttagctccacttttcagatgaggatactgagattcagtaaggttattacccaaacttatgagaaagccaagatttcacaatatttcaacccaactcgactttgtctaataccagtgcgtaccaatggcattattaatccagactgggcgatgaattaaaaactctgacgtgacgtttctgcaggtttctggaagaagcctggatcacctggggacggggtgaagttggcgttgccctccttgcagtaatagctgctattgttttgcagcagttattatggatcagatactgtgctgggtctatgatctcatttagcccttacgacaatcctgtgaggttggcattactatgatctctattttacaggttaggaaactgagccttaaataaactactggattttcctgagtattctgtgaataaattcctattactgaaatacttgaaagggctagattaataaattaacaaagccttcttcggagcaactgtgctgaaattccgtacgcgtgacgttcccaccctctgccactcggtgacgtcacgatcaatcccaccactaagttcccagccaagcgctaccgccgctatctcgcgagagccgtagtttcttccattctgttttggacatgcgcggggcgtaaggcgctttggccagagtggtttgatggttttgtgttagtcttcctgcagctgagcttccacaagacactttttccctttcagccacccaatatctcgcgagacttgctattctgcgccccctcccaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggtaagtctccttttcccgccgtccgctgcccgccgctccctctagcagcttgtgcgcacgcgcgcggaggtcggggaggcgacgaggagaccccgtggggtctgcgtggagggcagcccgggggctgacccttggggccctttccgtgtgtctggccccgtgttgtgcgagcgccagtaggacagggaccgtgatgtcaccacctggctactcggctccaagctcacttgttaggccctgagtgaacatttgttgacttgaatacgccccctcccaccccgcccccccgcccccccccggccccgggaagaactcagagttccaactcagccagagttggtcccccggggcaccatccactcttagtccaggcaccacgactctgtctcatactcagaaataaagaagttgccgtggccacaactttgtgtctccattgacttccttgcagaggggaagcagtttgagtgccaggttcagagagcccgtttatgcccgcatctctctggttatctgttatcagggcataacctgtctgccatctcgacagatcccaaggtctgtctctttctgtcactgcctttgcctagatagaagccagaaaggaaaaactggcctaggatagtctctgtttccagaaacgtagtggatagtgccattggtgagccaaagggcagtagagtgggaatgaaatagaaattagattttagtgcgttttgtgttcagagtgtaccgaatttatcagtttctggagcacatcatgtcttttcatgctctgtgtctttttttcgttacattttatggcttctttttttttttttttttacatcttttgccttcctagcgcttgacatctttctgatcatccttcaaacctagttcggaaacacttcttggaatctctgtaagaattaattgcacccccgatattctcatgatacctttttcttccgtttgttaaaacttgctttgtctttttgtaagcatcacatcctctgtgtggtactcggtaagtttcttaacttctgaaagcctcagttttctactttttctaaattgggataataatacttacctctcttgaggattacacgagttaatacgtttggaatatttagatcagagtagggcacatagtagcctctgagtaagagctagttgctctttcacctcaccagacagcatggcgagaggaccaggtcttggtatccctaggacctaggacagtaaccaacatgaagtaggttgctcgacaggtatttgcagaatgaatcaagtagagtaggtatctgctgtatctatttaattgaaaatgtgtttaagtgtagttgtactgcaaccaagttacaaaaaagacaatgaaaactgcctcagcttccaccgagggaaccagactgtttaaattggagaagagatgacttctgagggagagacagatataaaatcaagtaacagtaggattcctatgcagtggtcaaagctctgcagtctttttaaaaagtatctttgatcatgggagatgtagaggatggagtggggtatctcaagaggcacgtacctcaaatccaatgtgggaaaaaaagcctagaagtaaaatcgcctaagtgcatgcatctatggctccattaactttcttgtctttggcttggcttgccaggcttccttgaggttggtgcattccacatggcaatgggtgccctggtgaaatggtatctagagatggggggaaattggaaggagagctgactagtggggttggggtagaaatatgtaattcttaggttagacctgagatgtggattcttgggtcatagttggggttaaggggctggaggggaaatgccatgtataaacttgagacaggaggcttggattggagaatatattcaccagagtcccaacttgcttcttgaggcctggatatgtcctgtttgataagacctttccccaagggaaaggtagatgtttcaaggtagatgttcaggaagtgttttttgagtgagtgtataaatgaatgagttatacatttttgttgttgttgtgttttttagttatcctttttgaagagaaggacagccacacgttgaagaatactttttcttaatttttgtcataaagtagggtttctcagattgggctgttcccactcccaatttattggagagtgtggtgtaagggtgggtagctgtctttctaagggatttcttcttaatttctcaattcttggttgctgttattatagttaatgaggttttcatccttagtcttttaacctagggggtgtgtatgtgcatgttatatgtctctttctccaatagccctatcagagttaatttaaattttgtcttttcccacttggagttttgtgactgaatgtactctttggcaattttttttaggatgaaattctgaaagcagcggtaatgaaatatgggaaaaatcagtggtctaggattgcctcattgctgcatagaaaatcagcaaagcagtgcaaagccagatggtatgtatcagtttaataagtggaaaacagaaaaggagcttaattatgatgatggaaaatgtcaactctgtgaaccttatcaaagaaagcagacattgtaatataacaaggcatggagtgggagatggaagttgggtgtttgacttagctgtcacttgcttcctgtgtggtcttaggcaagccatttttctatccctctcccctgcccttgttttctcccaattagggataataatacttggtcctgactgatagagatgtgagttgtcatctaaatgggttaatgtatttgagagtgctttgtgaagcatacaaagtctactttcagggacagatgagccccagcttgtaaattaattgtgttctaaaagtgcataagttagctgttttagaaattacttgctcaaagaaataaatgataaataatggctaattttctaagtaagcctacagtagttgagtttcctcataatacagttgaaatattatatattttatagttaatatgttatatattatatattaaacatacttaatgttatatattatatattaaacatatttaatatgttatatattatatattaaacatatttaatatgttatatattatatattaaacatatttaatatgttatatattatatattaaacatttaatatgttatatattatatattaaacatatttaatatgttatatattatatattaaacatatttaatatgttatatattgtatatattaaacatatttaatatgttatatatattaaaacatataagccaactctgaacctgtggtgtcacctcttttttatttttattttttgggacggagtcttgctctgtcgcccaggctggagtgcagtggcgtgatctcagctcactgcaagctttgcctcccgggttcacgccattcttctgccatagcctcctgagtagctgggactacaggctcctgccaccattcccggctaattttttgtatttttagtagagacggagtttcgccgtgttagccaggatggtcttgatctcctgacctcgtgatccatccacctcggcctcccagagtgctgggattacaggcgtgagccaccgcgcccggctggtgtcacctcttaaatcatagggtagtggacacgtgaagctatttagggtgttcttggcatgagttatttagcaccatccccaagtcatgtggcattaggaaaatactttggattgtataagaatgacctaatttcctaggcacctggttaggggaaagtatcagaatgtagaaattggccaggcgtggtggctcacatctgtaagcctagcacttcgggaggccaaggctgggatcacctgaggtcaggagtttgagaccagcctggccaacatggtgaaaaccccgtctcttctaaaagtacaaaaattagccaggcgtggtggctacttgggaggctgaggtgggaggatcggttgaacccaggaggtggaggttgtagtgagctgagatgctgccactgcactccagcctgggcgacagagtgaggctttttgaatgtagaaattggctaagaggaagatgatttttaggctgaagaagtcgttctgatttctgtttgtcttagtggtaccagttcctgctgtcatatttggtaggacttaagtcctggttgcctgcctgtcatccagctaagtagactggatggaaaaggtgggctgggtggggaattaggaaagacagagggaatgtcatagtagttttacttaaattttaaaacatatcaaatgaaaggttacggtgaatttagtgagtgtaagtcaaatgcttaaagaaataagccatggtgtgagaatcaaagcatgagaaaatagtatgaaaactggaaacactgtaagaaacgtgattttgtattgtcttccaaatatttcaaaatttctagaaaagcgtaaataaataaaaacatgatagatgagaaagaaggcatatgatcatgattcagtgaagtaaccttttttaaccattactaatcttgcataattaaaataaaatagaatgtgatgagatggggaatattgactggggtaagtgtaaccacacagcaaatattctgttgtcaaaaagaacagtttttgtaattgaaggatgagagcacaagtcagtgtatccattgtgcaaattggatatttatgccaggtaactgattaatatataaaatgatctatgtttaataggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctgtaagtgagtcttcagaaagagcatagaatatatgtatatgttctgaaagaggctgaataaactttgagtattttctgtctttaaacttttaattatggatgtgagtaaacccaaagctaaagccattggataatattttccatatctcagatggttgatcaaaattatgccttctgtcatatacttcctaaaataataatttaaaagaattatacaagtcatgcatgttcatcatagaaaatctggggaaaaaatagtaaaagagcaaataaaagtcacccataatcacactgctaagaattaactactggaacattttggttctttactaatagtttttttttttttttttttttttttaaatttgtatggctgtaccgcatttgtgattaggatctgtttgggttctattttagagtgattgaaaccagtcactgaaatcagcaaattttaatatcatttctttcagatgaagtgatagtaaaaaggctttatgttgttaaagcccatccattggtttttttggggggaaaaatatcgtcagaacttggaaatctggtaattttaactctaaatggtactgtagtgtgactaactcctatgggcttttttctagggataaagctgcccaaagagacaatgaagaggaaacaacagatgatccacgaaaacttaaacctggagaaatagatccaaatccagaaacaaaaccagcgcggcctgatccaattgatatggatgagggtaagtgtatgctttgaggaatttatttctttggtaactgtaaactccttgggcctcactcttttagttcctttctgaactcctctactttagaatcccttttttttttgagacaaggtcttgctctgttacccaggctggaatgaagtggcacaatcatggttcactgcggttttgacctcctgggcttaagcaatcctcccatctcagcctcctgagtagttgggactacaggtttatgccgccatacctggctaatttttaaatttttttgtagagatggggtctccctgtgttacccaggctggtctcaaactcctgggcttaagctatcctcccttttctgcctccaaaagtgttgagattataggtgtgagccaccatacctgatccccaattctgtcagcagtgttcttattctaagtatctttccaaatatgtccagtgttttctgttatagagtagttgctttttctgaacagcgccccttcatcttctgtttcttcaattcagttaattaagttaattaagtgttacggggtgtggtggtatgtgcctgtagtgctagctgctaaggaagttgaggtgggtcgatctctttagcccaggagttggaggccagtctgggcaacataaccccttgagcccagaagttggaggccagcctgggcagcataacgagaccctgtctttaaaactgagtagtgtaattctactgagtagatttttcagaggctagaggtgagcccttgaagatcctgtttctcattcctattccatggagagagacatcaagtcagaatattggacctcagtcctcctattaattacttatttgactataggcaagttatttattctgtgtgagaaggcaacctgtgagacggtgatggagacttaacagtgattctgggaggcattgaatcaggaattccacaatagaaagtatatggaatcaacctaagtgtccattaatgggtgaatggataaagaaaatgtggactgggcatggtggctcacgcctgtaatcccagcacgttgggaggctgaggtgggcagatcacttgagcccaggagttcaagatcagcctggccaacatggtgaaaccctgcctctataaaaaaaatacaaaaattagccaggctgaggtgggagaatcacttgagcccgggaggctgggtttgccatgagctgagatcaagcactgcactccagcctgggcaacagagcaggaccctgtctcaaaaaaaaaaaaaaaaaaaaaaatggtatacacacacacacacacacacacacgaatactatttggtcataaaaagcaatgaaatcatgtcatttgcagcaacatggatggcagtagaagtcattatgttcagtgaaataagccaggcacagagagacaaatactgcatattcttcctcatatgtgggagctaaaagcgttgatctcatggagttagaatagagtgatagatgccagaggctgggtatggtgtgtgggtgggagagcgggattaagagaggttggttaatgggtacaaacgtagatggaaagaaataagttataatgtttgatagcagaatagggtgactatagttagcaacagtgtattacatatttcaaagtagctggaagagaggtctgaaataaatactcaaggtgatgggtaccccagatatactgacttgatcattacacattctatgcatgtaacaaactctcacatgtaccctataaatatgtaaagtatgatgtatcagttaacagaatcaggaattggattttcaacccgtgtgtgccacctattagctgtttgaccttagacaagtcataaaatctctctgagctttgattccctttcttgcgagatggggaatactaatacctgctttaccttagcagggttgttgtgaagcactcagtgaatatttgttaagtttctaaaatgtaaagtttgaacatagtggttcccaaaggcaggctgtggctaggctggctgcatcattatcacagggggagcatttaaaaatagaaatatcagggcttctcctgtatatactgagtcagtacatctggggtggtgtgggaggcacgggaagagcagtgatcttggaatctgagtattttacaagttcccatgtgatttagttggacagccttgcataggaattgttctaaggcatcaatagtggcatgtattattccattctatagagccacgaaaaatgtattggatgagagaaattgttctgaggggaaaaaaaagtatctaatgatagttgttctctcataattaaatagtttttaccctatttcacaatttgtgctgtgccagttagttgataataatgaaggatacaataattgtagccactgtttaatgaatgcttgcgagatgctttacatatttcgttttacttagcccttctcaaaatccttgtgaaataggaattgttattcgaattttatagggaaaccatgcttagggagggtaagtaagtgactaaggtcacatagctagcaagtggtgggcctggtttttaacctaggttctttgacttcaaaactcaagctgtttccattatgctacaccataaaatcagtatttttatgtttttttctcattttgagcaatagagtgtctcttacataccttgcttctagagtatgtaagaactaagaaaatacttagtttttcttcttttaatttttgcagatgaacttgagatgctttctgaagccagagcccgcttggctaatactcagggaaagaaggccaagaggaaagcaagagagaaacaattggaagaagcaaggtatgtgtggatataggaataaaaagcaaagtgtttttctcacataacaatcaacacagaatacttctgtgaccagatatgtggtttttttttttttttcccctctccaccagcaatcaggcaatcaattctgcagtggatagctgggtgtcctctaattcagttaactctaatactgtctacctggagatagctccagatcttacaggttgaggacttagtcccacaagactgaaccccagttttgatgctgaccctaaaccccaggttattttgcttgtgtttctgaccagcgagctgggttccactgccccttccttgggttccattcatctgctagaggactcacagaactcagggaaacacccacatttacaaaggatattttaaaggatacaaatcaacggccccatgaagagatacacagggtgaagcctggaagggtcctgagtgcaggtgcttatgtcccattgaagttgggatatgccaccctcccagccagtgggtgtgttcttgttcaccttttcggaagcccccatgtatttggctgcccacaagttctccagactctgtccttttgggtttttatggaggcttcattaaataggcaagattgattacatcattggccattgcttatcaactcgaccttcagcccttctcccctcccctgaggttgggggttgtggctgaaagtcccaagccctctaatcctgccgtggtctttctggtgactgccagctatcagtcaactcattaacatgcagaaagacacttttcacttggaagagtcccaggattttaggagttgcattgttggaaacggatgaagaccaaatacattatttcacaatgtgtgcttgtctccattcatagttcaataattagtctaggcatccttaggaccaataaaactgcatgatttattaacccgttgggtgaataataattggaattgtccagttcctatttcgctagtattctttaccttctttatttctctgaaactatcttgtatttttttcccccaaccatttcagaatatttatagaaaaccatatttaaaaaaaattgaagctatggcagaggtaatgcccagtttatccagtatgttgagtgtgttctgttggcatatgagagcttcatttgttgtagctattttggagtcagatgactgtaggacacacaagattatgtgtcttttgtatgactgccaattagttactttccttgattggtattgggaaggcactggctgtgaaacaggaaacttggctgaacaaagagggaattaatgagcttagaaccaaattttaggccctcatagaaatctttatttaaaaagtaaacgaatatatattacacattgtctttcactcaggattttcttcactttccccttttttccttttggttaagtccatgattgatatcagttctaatagcccagaaaccaagatgatgtcactaaagggcaaatctggactgtgtcacagcttattagcttctgggattcaggccctagaataacctccctatcctgtacagtgccccttgtggcccccaggttggcctgctgattcttcttgacctgatgaccagcattatgttgtaattaatggctttgaagtgccagatcctgggatggagggttttttaatgtctgaggatgcgtgttggcagagctggccaattgctagcctagaatagttagcttatttgggggtattagctgccggggacagtaaacagaaaccaagaggaggtactaacttttccaccattcttggccacctctctattctgtatactcttcagagttaagtactgtgagtaaggttgaaaaaaaatcacttttccatttttatccatggttgtaggggaccaaatttttagagccctttaaccgtgtggattgggccagggacacagcaaatgcatatgtgaaaaatctccaagtgtggctagcattgattgctttaaataaaatttgcagattttaatttaccctgtaatttcttgtaggcattcttgtagaatctacacatctttgtaagttatattctaacaggctggaatggcctctatgcaaagtgcagggcagggctatttgcttttaaatgttaaattacaaatctaccttgtaacttaaagcagttttttattgattataaaagtaacacatttttccttctagtattgttaatgttctcattttgggacataggtaatataatgctatatggcttggttatattcatttagcattattgtgtaaaggttttctaatgtggattgaagtccttatttccattatttaaagaatgaaattactttaaaatttgaaatacatttttctaaacttttctctctctcaacatagatgtgcatttatgtgtatatatgtacactaacgtttatacaaagttggatcatactgtacggttttaatgagaagtcagctgtaaatcttactgagatttccttgtaagtgttgaatcatttttgtcatactgcttttaatgttaattttaattttttttaagagagggtctttctctgttgcctaggctttagtgcagagttcactgcagccctgcacacctgggctcaagcagtcctctgccttagccccctgagtagctggatctacagatgcacaccaccattcccacctaattaaaattttttttgttgagacggagtctcgctatgttgcccaggctggtcttgaactcctgacctcaagctatcctcctttcttggcctcccaaagtgctgggattgcaggtgtgagccactgtgactggcctgtcttactggttttaaatcttctcgtctttggctttcaacatttttaatatgatgtgtctgtagatttctttttgtttatcttacttggagttcattgagcttactggatgtgtagattaatgtttttcaataaatttttcaaaatttcagccattatatatcttcaaatatttaattctgctcctttcacttctctccttttggtacccctgttctgcttatgttggtgtatttaatagtgccacatatttctctgaggctctattcatgttcttcattctttttctctgtttagattgcataattgttactgctctgttttaaagtttgttaattcttctgccagttaacatctactgttgagcctctctagtgaagtttacatttcagctttgtactttgttttgttttgttttttgagacggggtcttgctctgttgccaggctggagtgcagtggtgcgatctaggctcactgcaagctccacctcccgggttcacgccattttcctgcctcagcctcctgagtagctgggactacaggtgcccgccaccacacccggctaattttttgtatttttagtagagacggtttcaccatgttggccaggatggtcttgatctcttgacctcgtgatctgcctgcctcggccttccaaagtgctgggattacagtgtgagccaccacacctggctactttatttttttttaattaaataaatattttttttcatttttgttattccattccttttctaagttagctgataagctttgtgcttttgaatttgagaatttccatttggttctttttaagcatttctgtctctttactgatattctctgtttgatgcaacgttgttatcataccttcctttacttcttggtttccttttgttcttggaacataatggctactttcaagtttgttaatctgacatctggttgcactctcaggcagtttccgttgcttgcattttttctagcatatgggtcattctttcctgtttctttgcatgtcttataattttttgttggaaactagacattttagatgatatactgtagcaattttgggtactcccccagccttcatttattatttgcttgtttacttgtttgatgactggtttattttattttatgtttttgagacggagtctcgctctgtcacccaggctggagtgcagtggcatgatctcggctcactgcaacttctacctcctgggttcaagtagttctcttgcttcagcctccagagtagctgggattacaggcactgtctaccgtgcctggctaatttttgtatttttaataaagacagggtttccccatgttggccaggctggtcttgtgacctcagatgatccacctgccttggcctcccaaagtcctgggattacagacatgagccagcgtgtctggccaattttagtcagtctattcttcccttacctcctgtgagaaatgtgaagcatctgatgttgctcctcacagggtatgctcacagtcaccctgggatagcatggtttgggcagcgctctctttgacattcctttccctgttaagtttcactgattgccagctgtttactgtgttgttttcaacaatgtcctggggcataagttgcactacaaagtgatccagtcaaatttgggctcctttgaagggatgcttcctgatatcagtgtttgagatttattctcaccccagaagggctcctcccagctcttattccctgtttctctctggcaaactagtaggcctacagatttggtatctccattaagtctgtcaagctttttcccaacttgccttttaccagaacttccactgtttttgatagtacccttaggctagaacttctctatactctgttgcaatgaagtccttttgtttgaggagagatgtggatctctcagttctgtgtcctgcttcttccccagggctctgacaggacatgtctccaagtgacagccctactttattagctgagtgtttggtgggaagtaggggatggacagcagcccaaggtttccttggcttgccctccccgtccgtccgcccgcagcgtggagccctcatctcataagccagggcaaaggctatcagggctccagtattctcagcagcactgtgtccaaagctaggacttctgtttggatggaggaaggaagcccacttttcagccactcttgatggaactttgccaccagaaatactgatgtcctaatcctcctggaatgaaagccctactactgggagctggaggggagaaggagtcctgggttcttggctgcacttgtgtggagtggaatctccattcctctgagctggggggaaggagggagtgggtcttggtttaaatatatatatttttctcttttttaaatttaatttaattttattattattatactttaagttttagggtacatgtgcacaatgtgcaggttagttacatatgtatacatgtgccatgctggtgtgctgcacccattaactcatcatttagcattaggtatatctcctaaagctatccctcccctctccccccaccccacaacagtccccagagcgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatttaaatattatattcttgtgtttcttaccgagttaaagtagattttcttgatttaatgtttatatatttgctgtatctgcttcagatcctcttcagagactttaattggttgtttttaaaatatatgtaattttcaccattctccctgggtagtgagtttatggagttcctcatgctgtcatgctggaagttactcatagatactgttttgtaacttgttttccatctttcatattgtgaatagcttttcttatcacgaaatcattacagttatagcaacataggaagatgcaaagaaaaaaagtaaaaattaaatggaattccaccctccaatgactatcgttattaatattttgatggacatccttcatatctcctcaggcacatattcattgatagatatgcatacagttcttatgtgttgccctgtaacatgtaaactttctaacattttttacacagtggtatgtcttgggcctctttccatatcagagtagatttatagccttttaaaagtttatgtaaatgtctgtataatatcttataaattcatttaatttcttactgatagttgtttagattgtatccagctatctactatcataaacagtgcttagtgaacagctttgtaattaagtccttgttcatggtgtaacttatttcctcaggctaaaggctaaggagtgaaattgctgctcaaaaaatatgaaaatctttagactatgaatgtgtatttctaacttctctttgggaagagatgcaccaatatactttttcattaccagtgcagcagactgtccattttttgcagccttgccgttaaaacaaaacaaaaaactgaatggtgttaattagatatgcacaaatggtacttgttaatttaatttgtgattctttaattgttaaataaaacttttgtcattttagttacctgcattttttgctttgtgaattgtttccttttgctctttttacaccctttgagtgcattaaaaaaaaaaaaaaactttgcttagactgtttatatttaaccatcatactagttgcaaatattttttcctactatttgccttttaatttcatttataaattttcatagtgttacagttagaagttttatatctcaaagctattcaatgtatagatgagtggattaaaaggaaaaaaaagctgttgatttttttcatttgccatttatttaatttatatttagtaagtacatttccatccagagataagatatgtatttacttgtagttccttttggtttttctttttgccttattatgtgtatgtgtgtgtgcacctttaaattaaaactaggatttgttttggtgaatggtgtgaggtaaggatttaaataactatttcttccccaaataaatagatactttttttttaactgtatgggataatttatccctgtcacatggcatatgattttcaaagtgattttgcattcttttcagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatcgtaagttgcctttctgattttggaaatggaaaggaatagtaggaggagtcttacgaagggccaagtattatccttgtcagagccagatttttattatttatttattttacattttttaaaatcaattttttttttgagacagggtcttgctgtgttgcccaggctggagtacagtggcacaaacacggcttactgaagccttgacctcctgggctcaagcaatcctcccacctcagcctcctgagtagctaggccttcaggtgcacaccaccacacctagctaatttttttttattgttttgtagggtgggatctccttttgttgtgcagactggtctcaaactcctgggctcaagcgatccttcttaaagtgttgggattataggcatcagttactgtgcctggcctagatttttattagtacaatgtggcctacatatggttttatttatttaatggattcatctttctgagaaaatcagggactgtggctatcacgtttttagcacagaatgctgtttatggctcttgagttgaaatgcatggctctcaattgactgtttactctttgaatcacatcttaacttttatgtacatttatgagtagattagttttactagtggctgaggaatctgtcaaaattgagtctggtatttttagccttaaaaaacaatttttttttttaagacaaggtctcactcttatcacccaggctggagtgcagtggcatgatcacagctcactgtatccacctcccaggctcaagcagtccttccacctcaacctctcaagtagctgggagtacagatgtgtgccaccatgactggctaattttttattttttgtagagaggtgggtcttgccatgttatccatgctggccttgaactcctaggctcaagctaccctccctttgcgtccctcacaaagtgttgggattacaggcatgagtcaccactcctggcccttttagtcttttctagtgaaaaattttaccttgtttttattaagatgaaattaaaagaaaaaacttactgatcctttcacttgatgggataaatatacatttataaaatctttatgttttagggcatagcagattttccctatttcttgagatttttagtttctttaaatctcatatctgaatattgtagggagagtattttatggttgtcaagggttttttaaagttttctactccgttgacctttcatttctgttgacatgaattgttacaaaacaacagctatcagccattgtaaaataggattttcttagatgtactccattgtatttattcctcagattaggactttgctttaggtaggctctacaaataaagagattgaacaggaaaactattcatttggaaggagtactaagtgggggaggcaagaaagacacacagaaggggaggaggtattcctggagctttgaaagactgctttgagcctgtctttaggcttcctaaccatgtttagatgtcacttgtcagtattaagacagcctttttaaaaaagttgtgaattttaagaatcatgagaatttaataacaagttttaaagggaaatttaattatgttttaattttatttctttcatacacattttcctttttacatacttgtcatactttttcctatgtgcacacgtttttattgaatgtattcataatataggaatagtttttgacattatgtggaatgttttgtttatcacaatcttcatacttacatgttttaatatttagtacttcaattagggtaccttattgataattttgttgctattctgagtttgcttttatcttgaatatggtaagtaatggtgtaggggactacttaatgtatattgtttttacctttttttagctattttctttttttttttgagatggagtctttctctattgcccaggctggagtatagtggtgcgatctcagctcactgcaacctctgtctcccgggctctaatgattctcctgcctcagcctcccgagtagctgggattacaggcacgcaccactatgcctggctaatttttgtatttttagtagagatggggtttcgccacgttggccaggctggtcttgaactcctgacctcaggtaatccacccaccttggcctcccaaagtgctgggattacaggcgtgagccattgcacctggccttttcagttattttcttagaaatgaggttgtttgttcaaagggtttgagtatttgtatggattttaatgtttttggctatatgtaacttaaaaatctcttttctactttgatccatgacagtgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcaggtaatctgataaaagcaaatttttcactatgtgaatttatatgcttatatcatttattcagcaaatgtttgaaggcctgtgtaccaggtttgtgctggatgctcttaagaaattcacagtttaatgggtgagacacacataaaaacaagtaattgtgggctggctgtggtggcccacacctgttatttcagcactttgggagaccaggacgggcggatcacctgaggtcaggagttcaagacagaaggagttcctgcccagcatggtgaaaccctgtctctactgaaaatacaaaaattaggcgggatggtggcacacacctgtaatcgcagctacttgggaggctgaggcaggagaatcactggaacccgggaggtggaggttgcagtgagccaagatggtgccattgcactccagcttgggtgacagagtgagactctgtctcaaaaaacaacaacaataacaaaaaaaaacaaaaaaaaccccacaagtaattgtgatatagtatgataagatagcttcagcttctctgtataaattattgtatcagatcttaaactgctcatatgatggtttggtaagtaattatcagctcttaacattttgtcaacagggtagggctttaggcttctttttgtagctgatgagggtaaaggtgtggtttggctttgtggactttaagctgccttctcccagggaatgttttgttgtgttatgcttttcttttttgagacaacagttgtgaaagtcaatgtgggagttgtggagaaaagcgatacaaacattctttcattcagcttattacaggctgtattcttttgacttactatagttggtcagaaacatgggaccttagggtaacctttttttttttttttgagacggagtcttgctctgtcgccaggctggagtaccgtggtgccatctaggctcactgcaacctccgccttccgcgttcaagcgattctcctgcctcagccttccaaatagctggaactgtaggcgtgcgccaccatgccccgctaatttttgtatatttactagagacagggtttcaccatgttggccaggatggtcttgatttcttgacttcgtgagctaccatctacccacctcggcctcccaaagtgctgggattataggcatgagccaccgtgcccagctaacccttttttttgtctgttttgagtagtacagctttgtagaattggacagatttaatggtgcagaagaaaggacttaggagaccagaagaactcttttcccacatgagcacattggctgcatcaacacaagattcttgggcataaacgagttttgtcatatcctgacattcctagtggggatatttattaaactgaaattttgtctttaatttttttcttagtacaccttaggatatttattttggtaaaattactaacacaacacctttagattttcttagggatcttgtggctcgctggactctttctgtgtgatattttaattggttttcagtcttcctcctccaattttgtataaatactgctattttacattcttggtacgttaatatgttgatttgaaagaatttcagtatagagatacagcctttgtagcttgattctatatcatatgtgaattttcccctcacattctgtagggaaggctttctaaagctatattatggaaactttcaaagccacaaaaaagatgagtactactgtgaactcgtgatattaatcacacagcttcagcaattcatttttctggaatatggaaatttaaagctgtgtcagctctcagttaaaatgttggtttttttttttttttcaatagagacagttttgctgtgttgcccaggtaggtcccgaactcctgggctcaaacagtttgccctcctcggcctcccagagtgttgggattacaagtgtgagccactgtgcccggcctcagttaaaatgttgcttactatgataattgtgtccttttagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggtaacgtgtcacgtagtagaatgaggcttttactttgtttattgtccttagaagtatcatgcaggagaactaagcggtttggttgtgtttcttttagtgtaaatggtttgaaactgagtcctgaatgcatagatcttgcaatatttctgtagtagagaagctaaatagattcagcaatcaggtagttttattttcacatttattaaaattcgtaattttttgaagccagcccttctaccttcattagtcttttgtacctgtcagtaaagcatagttttgtaaaatttcacattgcctgccaatcctagaaagaaagaaatacttccttgcatttctgtacttagcttcacatagtgtgcccgcagttctactttcttccctctctctaacacgtggggtagacacagctttgtgtgttcccagggtgtctgtataccagagaatatccaaacctacaaaacatagttgggtcttttggtacacttacatctcatttcctcatctctaatagtcaggaatataattttaaggctttgattcgcggcaaacagttgtgtaaggcttagcaagaaaaacacttgtgcccctcatccgtagaggtgcctgttacaactctttgttttacttaccgctaaaagatctttgttactcattgaccattttcagttttaggcattatctgttgtttttctacatagaatttgacatttggctttcacaccctctgtgtccgtcatgcatacattttctattcccctattgtctgttataatttggttagctttatattcttggtttatcttatgactctgtaaatcctattcattgctaaaccatgaattaccttataatttgtgtaagttatacaaatatgtaatattcgtacatatagtttgtaatccatagcataccattgtactttgtggtatagtattttgtttttcttggagctaatacttgttttattcagttgctaagttttttgactaagcagtaattcaactctagactacgctggctgtgtctgttttctctaacctgtgctgactttagatagtctcatctttttgaagaaatctttcttagaacttccgaatgttcttgcctggactcattattcttcagggcttgtttatagcttgttcttttgatttcccttcactgtcaccctagagagtcccttggatcccctctttccaggctcccatgtctttggctttcttggtttactcccttgttcaatgaagaatatcattcagtagctttcagagaaagggttcataggaggtagaatttttttttttttagttttttttcattgataaggaaaaattgtatctatttatggtgtacagtatgatgttttgatatatgtataccttatggaatggctaagtcaagctggttaacatgggcattacttcacatatttatcatttttttgtggtaagaacacttaaaatctacccttagcaatgttcaaatgtacagtgtactgttattcactataatcactgtaatgtataatatcttgaacttatttctcctgtcttactgaaattttgtgtcctttgacagatatctccctggttccctcacccctcagcctctagtaaccaccattttactctttttctgtgagtttgacttttttagatcccacaaataagtaaaatcatggggaatttgtctttctgtatctggcttacttgatgtaatgtccttcagtttcatccatgttgtcacaaatgacaggatttcttttttaaggctgaatagtattttattgtgtttatgtatcacatatttttaaattcatttctccactggtggacccttaggttgtttccagaggtagaatttttcaagatcttgcatatctgttaattactaatctaccctcttggttgatagtataactgggtatagaatcccagattgcagtggtttttgttcacagtgttgaaggtagcactgcaaggtcttctggcttccactgttgctcttgagacctcctatactgttgagtttgttaaaagtaaacctcgttttttcttttcttgaagcttacattatcttacatgatttatgatgcatgtttcttggtgaaggtctttttcaaccactgtggatcttttcattccagagactcatggccttcaattttgtaaaattattttgaattaaaattgtttttctccctttcattgatctctttatgaacctccaggttttctattaattcctctgcagttttctatcttactgattttgatttatttgtaggaggttttctcaattttatctttattcagtttttaatttactatcatatatgtaatgtttaagagctttttaaaattttgttcagtattttttttttttaccatctcttatttcatgagtatcttatttctctgaggctgttaatgatggttttgtttttataagttttcttttccttgcatagtttctaagttttttgttttgtttcctttctgtctttccttatgggtatttcctcaaatgtccggtgctctttgcctgtgtctagaagtgggtggggggcaatcacaagctgattggaagctccttaggtgtgggtagggctccttgactcctggcttccctggaggctgatctggctgggatgtttcactgggagagttcttgatgtcagtgttagttcttttgggtcagtgttagttgtttttgcttaggttagtcatattcctcagagaagtaatttccagtctcctatctacagggtataaagttggccagtctctgggaacctagttggggaaaaaggctggatgtctccaatctaaaataaaaacttctgcttcatttctctattttcatagtgataattttgctcttaactcttcctggtattctctggtttagaaatcttttttgtactctcttcagagagtaaagcccctctgttttttgtaaatcctgtgagagacagacagagagagagagagagagagagagtgtgtgtgtgtgtgtgtgtgtgtgtgtgtgtgactaaaaatcctatagactttgttttttattatcactctttttcttctcattttatattgtttcgtgaaagtttacaaaattatggcacactagttattagccagctcaaggctttgaggaggtctgaacatagggtttctcaagtaaataagtaaaatatctagcatatcagaagctttaaaaacaataatgtgatcttgcatttatttccttggattctgaacacaagtaaggaatgtgtttcagggtgttcaaggccagataaagtgtcagataagcctgttcggacagactgggaaagagaaaacctaaccactcacagaggaaatatggagggacctaaacagtccagaatacagacaggaatccacttaaactgtatagacctgttaataacagggggcaataatggctataggtattgtaagaatcccactagccatcttctcctggtggccctgaagtgatggagatgcttctgatagaggctctgtcagtgttacatggcttagtattgctcgtgcatgtgcagcacttatccagccctttcattaaaatacagagcatgctttcctggttctgtcactttatccatgcctcagcctttcagatgtctccacttctgtgacagataggaataacctgtcccccacttttttttttttcagacagggtctcactcccattacccaggctggagtgcagtggcatgatcacggccactgtgcccagacagtttttttacttttagtagagacagggtttcgccatattgccccaggctggtctcgaattcctgggttcaagtgatctgcccgccttggcctctcagagtgctggggattacaggcatgaaccactgcacctgaccccccacttttttcagtggtgctgtttgaagaagtttgcaagtgtgaatattcacacttgaaattaaaaaaaatagtttttttttttaattttgggaaaaaattacattataggacaatataagggacatttaatggaactcctttcatggtttttaaacagttttattgagataccattcttacagaattcacccatttttactgtatttaccgagttgtataaccatcaccacagtcaattttagaataatttcttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggcccaattttagaataatttcatcatccagaaagaaaacccatacccattagcagttattccccattcccctcaaacctgccaagtttttaggcacccattaatctactttgtgtctctatagagttccctattctgcacatatatgtaaatgaaatcatataatatatgatgttttgtgactggcttttttcactttgcattatatcgtcaaggttcatccatgttgtagcttttatcagtactttattcctttttgtcattgcataatattccattgtatgaatataccatgttttgtttatccacttatcagctgatagacacttgagttgtttctaccttttgactgttaggaataatgctgctttgaacagatgtttgtgtggacatgtttttttccttactcttgcatagatacctaggagtggaattactgggtcctatggtgactatgtttaactttatgaggaactgccagactgttttccaaagtcgctgcaccattttatttgtttatttttgagacatggtcttgctctgttgcccaggctggagtgcagtggtgcagtcatggctcaccgaagccttgacctcttgggctcaagtgatcctcccaacttggcctcccgagtagctggtactacaggcatgcactaccaggcccaattaattttctaattttttgtagagatgggggtctcactgtgtcgcccaggctggtcttgaactcctgacctcaagtgatccttctgcctcagcctcccaaaacgctgggattacaggcatcagccaccgtgcctagcacattgtacgtttttattaggaatgtggaagggttctaattctttacatcctcaccaacacttgttttctgtctttttgattatagccatcttgtaatcaaacagatcctagttgtgaagtgatatcttgtgtttttgatttgcatttccctaatagctaatgacatttcatgtgcttattggttatttttatatctttgttgttgttgttattgagacagggtcttgctctgtcacacaggctggagtgcagtggcaccattatggctcactgcagactcaacttctctggttcaagcagccctcccaccacagcctctcaagttgctgggactacaggtgtgcaccactgtgcctggctaattttttatttttgtagagatgggatctcactatgttgtccaggctagtcttgaagacctgggttcaagcgatcctcccaccttggcctcccaaagtgttgggattacaggcgtgagccactgtgcctggcctggcctgtgtgtgtgtgtgtgtgtgtgtgtgtgtgtgtgtgtgtatttttttttagaaatagctattcatcttctttactcatttttaaattgggttatcttttttttttttaatttaaaaattttttttgtagagacagggtcttgctggtgttacgtaggctggttttgaactcctggcttcaagattctcccacccgagtctcccaaagtgctagaattatatacgtgaaccattgcacctgactgggttttttataattgtaagagttctttgtatattctggatataagttccttatctgatatataacttgcagatgtttcctctcattttgtaggttgtgttttcactttcttgatgttctcatttgcagtacagaaggcttatattttcatgaagtatagtttagctatctttttcttttttgcttatgcatttaatcttatccaagaaattctttccaaccctgggtcatgaagagttattcccatgttttttcctcagattttatagttttagtgcttacatttaggtctgtgatccactttgagttagttttttatgtactgttaggtatggatctaccttcattcttgggcatgtggatatccagttttcctaacacaatttgttgtaaagactgttcttttcccgttgtatgttcttagcagcccttaaaaaaatcaattgaccattaatgtaagggtttatttctggactttcaattctgtctcattgatctattatctatcctgtgccagtaccacactgtcttaattcctatagccttgtagtatccttttgtgtttttaataggctttttaactgattgttaaagaatattgaagtaatgagtgaatgttaactgggagcgtagtagttattttgaaaaagcacaaaacaggtttagaacctgagccatatgcagtaagtttggggcttgtaactttggatttctcttctaaaagatgtgggggaagttatatatttgttggaattgggtttagctgtaacagaaaacctctaacagtggcctaaatagaatagaggtttatttctgtttcatgttctaagtgttgagagataaatcaaactggggcttgtgtggcactccctggtgtcagggacctgggcacctgcttttttgtcctcccccatgtcaggtttctcttcttagtttctccttgtggcaggtacagtcgctgcagggccagccgtcatgtttgcatatagcctgcaagaaggaggaaaaagggcacaccctttcccttcttaagaacacatctcttgcacacatcattctgtctgtcctgctggccagaacttaggcacacatgtcctagctactggggcatgtgatatttgttctgggtagccaggtggtggttaagaattgaggcttctgttactatggaggaagagaatgggtgcttggtgacaagaagtctctgccacagtaaaataaatatctactaatgaaaatgattatgattggttgaagccctttggaacctctaagatgaactgacagaagttgagatttagtctagtctgtgacatatttttttgtaaaattttgataaattttgttttcactttgtgagcttttattggttcagtgtctgttctatgtgtgataaaggcggtacctctggctgctgttgtgtgtagctaggggtaagaggagttttgcttctgtctcttggcctcctctgatgtagtctagggtatatcagtcaagatttaattaaggaaacagaaccactaggaaaatcatggaataaggaatttgttagaggaattagtcccatatacagttatgggaaaagcagggcattaaaggtctgaaaaggagtgttaaagattggagaaaggtcaccagccctggtgtggagtgagtcatagcttacagggaaatctggaggccaggcatggaagtctggagggttgttgactctttgtcactactgttactgtgagtttgaagcagaagtctggtcaccagggctgcctgtaaaggaggagaattggatatatggagcagtggggtgcaaggacacactgaaacttgccagctcctctgcaagtctgtcactacctctgaccaatgatggccttcagagtgtagtggttgctacttcacctctgtcacctctgcttctccttctgcctctacctctgttttacttttgatgaactctactcagtaccaagatggaagaggattctgggaaacatcccagtgtaaccacgtcaacaaaggataattcaccacataggagacagctctcagatgcaccggcattttactgggccaatctcatactgggccaaactcccccactcctttagccacaccatttttgggagtgttgcctatttgtaattttggcacatatgatatttcacgtcacccactcttccaggaatatatacttttgccatttgattcttatttctcctctttcctatgcagaagatctaagcctacatacgtttctttctagtaaatgctttatatttggaatagcaaaaaggacacacacagggcctttgataatgtgaaattcaagattttttttcatgaataaagatatacagaataatggaataagtcttgctctggttattttcattttgcctcaaaatttagtgatttagtgcattttactatgcttatgacttctgtgagtcaggaattcagacagggcacagaaggagtggttagtctgtgctccatgatgtctagggccttagtaaggaggactcagcggttctgtgtgatttgatggataggggatagagtcatttggaggtgttgtctttccatgtctggtggttgatgctggctgttggtggggtgggtcctcagctgggaatgtggagtgaatctgcatgtggtctttccatgaggcttgggctttctcatagtgtagtggtctcagaacagttgaacttctcacgtggtatctcagggctccactgtgagtgcggtgggaagctgcgttattttttctaaactaacctgggaggtcaagcattgtcacttttgttgtgttctgttggtttcaggtgaatcacaagcccacctagatttatggggagggaacatagaccctacctcttgatggaaggagtatcacagttggattttaagaacatgaaacatgagagagaaggttgtgaccatctttggaaaataaactttgccacaggccctaagttggacataaagagatttatgggtacaaagatagcactgaggacagggttacagtgaagggactaaagagaacatggtcagttctgcctaaagagatcagcaagacttctgaaagggacctgacccccacaagttgttttcttgtgcagtggaaaggttgcttgggagtatcttaagttcccagtagaagaaacagacctcagagatactaatgaagactggatagagaattcagtggtgaagccagactaaaacccaggcattcagacatttggcctaagctgggaaatttgaattcttgtaatagtaatttcatatgtgaggccacaaaagcacacctctacacataaaactttatttgatgtataaaacttctttttaaattttattattattatactttaagttttagggtacatgtgcacaatgtgcaggtctgttacatatgtatacatgtgccatgttgctgtgctgcacccattaactcctcatttaacattaggtatatctcctaatgctatccctcccctctccccccaccctccaacagtccccggagtgtgatgttccccttcctgtgtccatgtgttctcattgttcagttcccacctatgagtgagaacatgcggtgtttggtttttttgtccttgtgatagtttgctgagaatgatggtttccaatttcatccatgtccctacaaaggacatgaactcatcattttttatggctgcatagtattccatggtgtatatgtgctacattttcttaatccagtctatcattgttggacatttgggttggttccaagtctttgctattgtgaatagtgccacagtaaacatacgtgtgcatgtgtctttatagcagcatgatttataatcctttgggtatatagccagtaatgggatggctgggtcaaatggtatttctagttctagatccctgaggaatcgccacactgacttccacaatggttgaactagtttacagtcccaccagcagtgtaaaagtgttcctatttctccacatcctctccagcacctgtttcctgactttttaatgattgccattctaactggtgtgagatggtatctccttgtggttttgatttgcatttctctgatggccagtgatgatgagcattttttcatgtgttttttggctgcataaatgtcttcttttgagaagtgtctgttcatatccttcgcccactttttgatgtggttgtttgtttttttttttttttgtaaatttgtttgagttcattgtagattctgggtattagctctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccatgatgtataacacttctaatgtgatgtgttagattgatagaaggaatggaaacattgaaatctgccatgactggtattcattttctctgttagctttcattgagaaaatgagtaaggattctgcctgcttcaagattggtatagtaggaccagaagagattctgcaagtctgtctaaacttttaaacttgcttctttgtcttcttgttaatcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggtattgtaaatgaacacgtttttattttagaaaaacttgaattcaaggacttagcatatttgctttagtaatgtttacggagaatgactacttattgtgttggattttcctctttgatttcttcttcatagtaataaataatagtgtccaggaaatggttaaatactgtggagtgcctccccgcctttctttaagatggagtctcgctctgttacccaggctggagtgcagtagcgcgatctcagcttacggaacccctctgcctcccgggttcaagcgattctcgtgcctcagccttctgagtagctgggattacagacatccgccaccatgcctgtctaattggagtgttcttttgcaaagcttcggatcctatcacgttatttttgaatactttgtatttgattttagagtagattgattcatttttaatgattactttgtgaattttattatgtaatccttttatgtatgtattactattgctttccctccagcattttattatgaaaatttcaggcatttagaaaggttgaaagaatgtgtggaagttatcagtattgaaatggagtcatttatgttacattttaatgaaaaaggaaccctcatgcgcgtatgcctatgacagaaattattgcagggaccttctgaaaaccacacaaattccagataagttgcttctgtgaagacattgccctaccaacagccagtacaggttgagcatcccaaatctgaaaatccagaatgctccaaaatccaaacttttttttttttttttgagacggacttttgcttttcttgcccaggctggagtgcagtggcgcgaactcggctcatcacaacctccgcctcctaggttcaagcaattcttctgccttggcctcccgagtagctgggattacaggcatgcgccgccatgcctggctaattttgtatttttagtagagacagggtttctcagtgatggtcaggctggtctcgaactcctgacctcaggtaatccacccgccttggcctcccatagtgctggtattacaggtgtgagccactgcgcctggccaaaatccaaactttttgagcaccaacatgacactcaaaggaaacgctcattgaaacgtttcagattttgaatttcctgatttggcatgctcaaccagtaagtataatgcaattatccccaaatctgaaaaaatcccatatctaaaactcttctggtcccacatttcagataagggatactcttatctataccggcaatgaaaacaaatgccacctcctgtgataagtccctgtaaccaatggtctttgtttcagaacagtttgcgtagactcctcccttgtatctttaaaaacttctccttgccccagcaccctcagttgtacctatggtctgtcatagcacacatatcccacactgtaatcccttgccgttcccgaataaactctttgttttggagacccggtctctcacccatttaagttgacaaatggtaaagtgaacatccatatacccaccacttagattctaagatcgttaatattttactatatttgctttatcacatatccatccaccaatccatcataatttttaatgcatttcgaagtaacttgcaggtagcagtttgtttgatcccaaaacacttccacatgcgttaactagaattcagtatttctttataactcttgcttagttttaagctgctgttttttaagaagaatctttaaaatacaaatgttatggaagcatgtagtaggaaaatggaattggaacttacaatggttggaaatatttggggtttactttgaattttaagtgttaagatatgtcttcctactggttatttagtagagaaagcacttcaggctattacacatatcatgacagcagaaccaagaagcattggcagccagtcttaaacatttaacacttcttgagagtcttgtaagagagcataatccctcatttcctatgtttagtcggctctctgtatctgaggattccacatctgtgaattcaaccaactgtggataaaaaatattccaaaaaactcaaacagtacaacaataacaaataacacaaataaaaatacaatataccaactatttatatagcatttacattgtattaggtattataagtaacctagagatgatttaaagtacatgggaggatgtgcatacgttatatgcaaatacgatgccgttttatatcagggagttgagtatctgcagggagttgagtattggtcctggaaccaatccccggtggatacttagggacaactgtatgtcttgtctctcacctagattgtaaaatccttgggggtgggaaccatgtcttatgtgataacaccttacctatcaggaatagctgtctggcagcatcaccgttctgcaacacaccaatatacaggaaataggcaaccaggaaaaaaaaagactttgaataattaaaatataggttgctgcaaaatctgtggatcttattcctaggagaatctcttaggcctcactcaggaacttactcatgtttagatgtgatttcaaaagtgtggtgtttggtttccaaacaaaatgtaaaaggaggaactatttaataaagtgtgtacatttgtaataatgacagtgatagtgatgtgagaaccaacagcttgatagggagggaggagacaaatatacacaaaactcaaagagtcatctggggtcattgagtgtggtggcccacctccctgcccactgcatgttcttagtcgccctaatgtgccaagaaaaggttgaaataatgtttagtggacgtagtttaggaaggcaagaaaatatcaaatgtagtgattattgtaagtcagtaaaataaaaataccatgctagctagaccaaacattgattttaacctagagatcctaacaaaaccagctggacagaattttgaaatctttattcttttttttttctatatttcctgtgaaataatttatgtgaaaaacatttgaaagcacaatccaaatgtaagtggcacttctgttaattgggattcctgtctttctaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggtaaatgtcaattcccttttaatactcttaaatttttttttaatatctcatggatgccaaattaaaatttctcctgttagtgcatatcacatataccttaagaatctatacacctgtggatgccagaaaaagaattatttgtaagacttgatgaaagggaatattttgggctcaaaacccacctttctttatgcttactaggtttgtgaatattgatgttcgttgttgatttcactgaagttttctttagcaagctgaggtagaaagctaactgtaaaaagttaagttttgcttctgcccgtgttactgcgtttattactttgctattgggccttattatctaatgccacagaaatcattgtgaaattaaaaaaaaaacttctaatgatactggcttgtcttcagtttaaaattaattctaacctcatgtatatatttggttgatttatatatgttttttaaagttcaaattgatatcaactaaagccaactctgaatggatacataagaattaaatagattaagaacctcatgcatgcagagcatgcatttggacatttgaggggatctaaagttgaataaagatgtcctttgtcctaaggaaatttatattctggggagattgacagtactaaactaagtccaaaaataattgcaatatcagaacagaataagccctttgagtaaaaccagtgtgcttagggtagttaaagaagggaatagtcacatttgttgggtaacaggaaagccttattagaggagctatgttctgaaggagggtgggggctgtctcagatggagactacaatatgagtaagcatggaggatgttttagatatagcaactcatctgttcctcacacctggtacatgtaagcactgaggatggatgggaaaactctgggtaccaggaggcttttttgggaaccaggactctactttctttcttctgcatgggatttagtatttccattaaaaataaacacatacatacaaattcaagtatcttttagagtggattttattagtccaaggacaaactaacttttgaacctgttcttttcatttgctgttaactttcggtgtcagaaatgtgttccctcaaagtggtctttttttctgccctggcctcagacctcctgttggaatatcccagagtatcttcagtgatcacaagtgaaagtttttggttggtcttaatgttgggaagaaggggggatagaaaataaacataagacttgtcttagctctgaagtcaggattatttttctagaattaatattaggctgattttttttgagactttttttctctttctgtaatttttaatttttgtggatacatagtaggtgtgtatatttatggggtacatgagatatcttgatacaggcatgcatgtgtaataatcatatcgtggaaaatggggtattcatcccctcaagcatttaacctttgtgtttgaaaccatccaattattcttagttattttaaaatgtacagttattttgactagagtcaccctgttgtgctatcaatttttaagagactcataaaatactggtggaatgtttaatatgcatgaattgagaaggaccacttcttttctacaggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggtgggtaactgtactgaaagaagcgtgagtttggctgaatgtgtcagtaggctggaagaatgaagaatagccattaaatgtcccaagatctctacctagtcctttttaatattgaaaaaacttctaaagtaaataacttatgtcattaataatgtatcctcacataattaacatactcacaatattttgatgagcattcttaaaaatatatatatggaaatttaaatacattctgtcaaattcattatgcttctctaaaatacacataggtagtcttttagacattgcttcaatctagcaaagaaaagatgttattggttagtcttaaaaacaaatacatcttggttcctgggtggtgcgatgtacgagcctgtagtctcagctgctcgagaggctgaggtgggaggattctttgggcccaggagtttgaatccagtccggggaacatagtaagacctctatctaaactggagttggaaatttagatagagtgtgtcaaaataatattagtaacactttgtactaatatatcttatacgtaattactttctcatttgcacgtaacagcacagtgatataaataggatcggtattacaggttgaacattgctaatccaaaaatccaacacctgaaatgctccaaaattcaaaactttttgagtgccgacatgaagctcaaaagaaatgctcattgaagctttttggattagagttagtataatgcagatgttccagaatctgaaaaaatcagaaatccaagatactctgggcccagatatttctagtaaggaatactcaacaagctcagatgaattgaggtctcatggtctcaactttctcaggtctcatggtgggtaagtggtgaatcctaaactagaactgatattttatgacccctttcagtagctgcagtccattgctggatgattttagggaccttgaatctcaggggattggagtgagaatgacatcagtggaaacaatattttagaggggacccatgtaaatgtgcttttcagtggggaacagaggatgatactttttgtgtttagttctcagctactttgagttacatttactccttcagaaatggcatgaaattttaatgtgttatcccacattattcataagaatcaggaaacaatacattttttggctggctttttgagttaaaagtcagtaattttggagtgaaagggaagaaagagttttgtcgtgggagtctctttggagtttaggttttccatttagatgagaaaagtttgttacgtgatatggatccatgcaagtttggagaatgctctagtagacattggaagctcttagtttctattataatgagagtgaatagactgattcatttctgttgccttagcattgcctttctacaaacttaaaccgatttctaaactttagctattgaacacacatgatcttacataccaaagtgtttttagctttactgagagatatcaaatacgctatagctgcaataaaggatataaaaatcattttttaggccatacgagatgcagagcgtgtaaaggaaatgaaacgaatgcataaagctgtccagaaagatctgccaagaccatcagaagtaagtgttagaatttctggtttaggaagttttaagtttctttttatatgattgctgcgttttacatcattcataaagactataaaacaaaatttcatctactttctggaatatagcaaagtagttctcaaatccaatctttaaaatgtttcagtagtaccagaaagaatttagaaggaaaaaaatggaaattgcttttgaaaatgtaaaaccgctgtttaattcatgctgtaacaggtaataacattaatatattatagtgatatgtttggtaattgtatttgttttaaaattttaggtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggtatgattgagctggaatatttcttcttgagatttaggtagttgttaggtgctgtgtatcatggacaaataatgaacttatttttccctgttggtattcataaacaactgaaatgtatgattaggagatgcatgtttagattaagtgttatgaaaaggacatgctttaaatacctccatcccccgtgttcagtgtgatagacctttagcaaataaacaccgccagggtgtttttggttcatgggtattaatggcttcgttgacagttgttacagttgccgttttctgtattcagctctgctatctctgaataaaaattagatgcctttagtacttaaacatcacttatttagaataatatgaagaggtgagagagactaatataaaaatgtttatagattaaaccttttagctattgaaaggaaggaagtattttttttactgaatatattcccctcacatgatttccccctactcttttggataaggacatgaagaaatgatttcttatatgaagtctgtatctggtcttttcttctacatgcattttattccttctgttttgacagagcaaacaactgtgattgtaaatagaaatctccataattgtataagaagatacagtgggtctcatcgttggaagcagagtggtcattagcttaaaagtctttttttctttagccttcagccctgaggagcagtgatagacctatggatttggaatgagctgctgtatacttaggataaaacaaacaagattcttacaaactctcctgtcttctctcctgcattcttcctctttcttcgcttttcacaatttcttactttgtgttttctttattgcataagtaatacattatttattataggatttttagaaaatagagaaaggaaggagggtttcgatttatatttcaataacttgtccctgatttcagaataactgagtcactcattttttagtaagtgcagtagggaaactaacatctgttgagttgcctactctgtcgagcacatttaatcattgaactgggattgagaatcaggctacgaaattgatacttgcacagtttcctcttttgaaagtgaaaatatgaggggaagaggaatttaggaaataaattttcctaaattgtatgtatggaaacctaaaacaaggatcacattgttgcttttggagattctgtagagggtaaaccctaacacaatttttgaaaaataataattctaagtattggtttgtaattgtttgaaacaaagtagcttaaatattctctcatattttatctgtgtatatctctctttgttccaaaaagaatttgaagcagctatttagttagcagattatttatggatagtttaaagataacttagccatattctctcgtaatgattataagatctgaacttgtaaatttttactctgtgcagtttcagagtgaaatagcatttctcttttaataaactgtcagattttctttttctttaatatactttaagatatgttaacattgatttgtttccattatttcccttaaggtattaagtgtccattttttcttctatagagatgattttccgtttcttttgttaaaattttttgtttatcaatcatttctcttgattttgtagattttgatgtgtttattttcattattactggaaagattgaaagccttctgtaaggcacagaaggtggttcccagtttttcataagccatgaagcaaagggctgggaaaaaattcatatgcttatggaattctgtgtgtctggcattgggctaggctctatagtatattgttcacttaatcctaataacaaacacatctgatctaaggtcagcatcatcattgcttggaaagctgtttttcagctttccaggctgaaaaagccctgagaaatgggctcagataaattaagcaagctcaaagagctgcttcaatggtaaagctgtgatctgaacccaggcctgtccagctttccctctcattctgtcattttacactattttctttagtagtgaactaaactggtttatgatctatcatctaattcgtgccccagtctcattatctggcaatgtcagggcattccttcaggatgagaaaaatgccatgtgacaaaaagatgcctagctcccctttaccatcacgtgaggtcctgcacacatggtggagtgggagagtggaaggggcacacccagtggtgccatttgtattctgcctcatctgcctactaacgatgtggtcttaacaagtggttgaatctctatgagccttagtttcattagcttttttttttttttttttttttttgagactgagtctcactctgttgcacaggctggggtgcagtggcacgatcccagctcactgcagcctccacctcctgggttcaagggattcttgtgcctcagcctcctgagtagctaggattacaggcatgtgccactacgtcctactaatttttacatttttagtagacacgaggttttgctgtgttaaccaggctagtcttgaactcctggcctcgttatccgcccacctcagcctcccgaagtgctgggatcataggagggagccaccgtgcctggccaaatttcattagcttttaaatgaggttaatattggctaatttgtaaggtgattatgatctttggatataatgtaggtaaaacttttaaacctagtttctcacacacacaataggtacctgagaaatgatagctgctgttatagtgagtgaaagcaaaggatgtttatacttttgaggaaacatggatgcttgatttttaaaaagcagtctgcattgactcaaaggcttcttaagctatttttcctaggtattgttatccacccttccaaaaaacaaccaaccacatcttggatttgactcaaggcatgagggaaaaaattagtcttctaaagctctctggatatggcaagtgtttgtagtacttaaacttattgaaattattattgtaaacaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgaggttggtatccttttaaaattttaattttaaatgtactttgattgagataatgaactaaataatgccactggagacaatgtcagaaaaacacacctgaggtgcttattgcctttttagttgttggagaaaactacacttaagtgttggatcttcttggccttgttcattgtttttttttgtttgttttgtttttgttttttttttaaagaattgttggccttcatgactaaagagtgccctgcaagttgaccagaggtcaatcagaacctttagatgtgggagcaaggagccaagaagccaatactagtcactcagaacaggcaggtcattgctagcatagcctgttttctctgaagaggaatctcagcagtaacgaggagttttctttttataacaaagagagtacatttacaaaacttaaatacaattctgttcatccttggattactgtgagtttgagttagggagggcagagctggattatctagttagtggcttccatgatttttcatgtctgtgaaaatgttgaaaacatactagatgcagtttcaggacatgtggtttcttaatatagtttgcatattttgaattccagaatctgtgtaggcattttgccaatggcatgtaaattgtggttcacagaccaccaggctgccttgtgcattctttttttttttttttgagacctagtctcagtctgttgccaggctgcagtgcagtggtgcaatcttggctcactccaacctctacctcctggtttcaagcgattctcctgcctcagcctccctagtagctgggactacaggcacgccccaccacgcccagttaatttttgtatttttagtagagacagagtttcaccatgttggccaggatggtcttgatctcttgacctcgtgatccacccatctcagcctcccaaagtgctgggattacaggcgtgagccaccatgcccggctatgccttgtgcatttttaatggtaatctttaggggcatttctaaggccaaggtgggatgggagagaaggggtacttcaggcagtcatatacagaaaatcgtcttggtttcctcttttatgtgattaccagtttctctttacaaaaagtgcatttgaaaatatttttatttagggttaaagccagaagtagtaaaatcacttggggtggttggggctgtatggggctgaggaaatgagcaggaaaaagcagtatcttttaatttgagttattctgagttttaatttaaccattaagatcacatatatataggtagctgatggttaatgcctgtgaacctctttttttctcagtgagaaatgactggttctgaagtaattctcatcttgggtaaaatcttagttcagtgctgctaattatttgtattaccaacttccagcagggtgtgctgttgctctgtgttgtggttcagtgttaaagccagggaaaatagaacatcagtggttaaattgtaagttacatttttttgttgtgtaggcttcatttcttataaatggtagttagcagtgtaattgtgatctaatatcagcatcatcactgattgaaaagctatttggaaagcttctttgtattatttatatataaatacttaggtttcttacttagtatgaaaatcttctcatttgaggtgggtaaactctttttgccgcaaatggcaagaacattttgtgcttttttaaatggtagaaaatttttttctccctaaatctcatttactttgttgaggtactaactttcatgacagcaaataaatgtgtcacacagtgagtggtgccataaagtacagtaatttttatttctgtgttgaattggtcttatgaattttaaagggaaaaatacagaaagagccactcctgttcttttggagatttatttgggtcgtttatgagcaaccattaaaaacatgtggttctctttgttcagttcagtaccaggaactgaaatcttccgttgaactatttttgttgaaggattggtgattttggagaatattcataaagcagtctgaagtcatttttcttttcttgactcttggataacttactttattgtttacccagctagttacttttaaagaatacttaatcaagtcctttaatttggtaaactgtgcttatttcaaatgaaagttcatgaaatcttttaaaaaaagaaaagcagctcaaagacttgaataaacaaacccccattttatttgtatccatcactaattcagaactaggtttcttttagcttgttttagtttttgaagacacagttctattggtttgaaatacataaatattttatttcaattgtggtaattctttcatttcagttgattgctaaattataaacattattcaaagtttgttgtggggaaggaactccagttatattgtataaactaaatgctatacttaaattatcctttccactcttaggttcaggagataagcccttctctgtaagcactgtatgccatggctgccagtgtgtttgatttttgctgccatgaactttggaaccgtgaatctaaattatggccctatcactgcctatcaagcaagatgaagtccagctttgtcgtggctggtgtctcctgaatggattaaaaaaaaaaaatgccctgaggtttatattggaggtagtctttgagccattcattactcatgattaatatttgaaacttagcacttaagtgaaaatccttaagatactcatttaaaactaatagaaccatctcagattttatgtagaatgtggtagaggatgtgtgtgtgcaaggagtttgttaaataaatagaatcagaatgcagttacaggtcagaaataagtggaaaagacttctgaattgtaaccaagtccatgtattttattctgctttggaggcagaattgagtttagaaccttgccagacttttgtgtgtaaaataagacagcaagagcaaacacagcaatgacagttaatataaggaaaggaaaagttatgagagcataccatgctgtgtccatttttacatggtggcaaaaagcccagtgtattttaatagctttaaagacactaagatacattgcaggggagtaaagtgattgctatttatagtggtatcccaaattaataagaaaaactttatttcttttcagtgtcatgtttttttaaaagggcgggatggctataattcagtgtaggaaacattttcacaaatggttaaaaataaaagagctttagtacttttatttattcacacattcagtaattattactgcctatctaccacgtactggatactgttctaggtcctggggataacagcaaggaacaaggcagacaagttctctgtgtttgtgggcttcagttacctggaaaatgcttaatgtgtggagaacctcgttttctgatgatgccagataaatgagtcattactgtatttgggaagtgcaaatagaattttaagtgttctaatttgtttctactttaagtggaaataggaaatcatctgaagacataattattttgagtgaaataatttccagtgggtgcaaaagtgaaatgagaagtctgaatttaggcatgccgttaaatttaatagtatttgaaatagtatctaaactgctgtgttgaggaagtttggctgaaaagtggattttgtcatgttagctgtaaaaatggaaaggctttccttagagatagaaaataggtccagaagtaatactacttctccctgtaatttactggcacagtcaactgtagtcaagaaatattatataacatagacttcttagaagtaaagtaacttaaagaacacagataacacacttaaaatccttctcagtgtacttgtagctcttatgaggacccctgacttgtctgaaggttatatttctgcaaaattggctgcacagtagatctcattttctcagtgattttcattataaagtcagatatttttacacaggaaaaaatttccttaatactttaaagagggaaaacttagggcaaggatttagttagtagacagttctgggtagagtgctatatgttgtcagatatcagcaggtttatgcttatgttgccttgtgtagaggtgggggaagtgacttgtggtacaggagaggaattcacagtactttggaatactctctctttcccaaattctgttctttgctatgacccttataggcactgacagatttcgtagttgtctctggtaagaactttatgagctggaacagacatcctgatacaaccaggttgcttctgttatgcctcaacatgaattgaatttgttttatgcagtttacgtatttcacttcctaatgtatgcagatgtacagtgctcttgtattgctttgttcatgtattactgtccttataaaggtttttagtaaggttttgccttcctggttagcatgcttttcagggatgcaatctgatggttgctaactcatagatgcaaacaataattactttcttggacctgcgtctcatcagagtagagaaggttcactgataaaaatgctggtaattggtatagagattaaaggagaatcactcatagactcctgttgtttgcaaatgttttggtgattgaaccacatcttgactattatatgggatcatattgctgattgatggactgggaagtggagctcccattgactgcctgtttattttgggtatccttaaacctgtttttccagtggtataaggttatattctgggcccccaagcaagagtttcagtgaggggtgctcttaatgtttctgaacctcactgtaacggacttttactgaagacagtattggagacccaaggataatgtgtttattttggaattacttaagcttagtaaccttaacaaacttagcttgaaagtaacagttacactttcataagtcccatacagctcccttttgtaatgacccgaggaaacacttatggttccactgattcatctcctggggaccatcagttttccattggtctctggccagtcttttttagacagtttctcttctatgcatttaaaaaaataacatttctaggcgtctttctataaataatacctgtgctttgtagaagttttaaaagaagtagaaaacataagaaaaggaacctactatccagacataatcaccttaaacattgtggtgtatatatgcaccccgccccccctgcccccacatactcccatatatcttttttttttttttaaatgtttggatgaaggtgtttaaaactaaactgggatcatattctacatttttcatttaatagttgtaaatatgattaaacactagttatattccaccctacttctaaaaaggtggtaagtggaacctttttttctgtataatttttttgagagatatttgttttcttatagttttatagcttgttaataaaagaatttagaattttaaaatacaaactgaggaaagtaaaagcttttctcaggtgtcaaaattcttataagtgggtacatgtaggtgagagtctaaatcagggtaagaatgatgggcagaattgctaattaaggtcttatttcttgtttacatgtgtctagaataatttatttttcagggagctgtctggtgaaatttaagccattcatttccacagcttaaattttttcaggcatgtttgcatttcagggggctgagccaaggagggggacagtcagtttattagcagtggtgtgaccagtgtattggactttcaaatagggcacaactgcatggcatcgtcccctggtggctgtggcctagggcaagccacaaagccactcagtgatgatgccagcagttgtgccctacttaacctctctgggtctcacatttccttatctgtaaaattgggtgagtaatagtttttgttttttttttttgagatggaattttgttcctgttgcccaggctgagtgcaatggcacgatcttggctcgctgcaacctctgcctccagggttcaagcaattctcttgcctcagcctcccaagtagctgagattacaggtgcctgccaccacgctcggctaatttttgtattttagtagagacgggtttcaccatgggtcaggctggtcttgaactcctgacctcaagtgatccacccaccttggcctcccaaagtgctgggattacaggtgtgagccaccgtgcccagccgagtaattgtttttatttgatggaagcatgagtttgagataatataagattaaatgagatactgtatgattagcaaatagcaggtgttagtaaatgggaattctcctcccatgtgtcttcaagtctatatcacccttagagttacctaaattggattatacttggtttgatactatgaggtattaggaactaacctcactttaaacaatcgggtggctaagtttttatattctgtaaattttgaggaatgtctgaaattttagacatgggctgattttaggagagagattgttgtactgagtgaagcttaaaactcagattttggttagcgtaaatagattttacatcgtggattttaatctaacatttcatgtatacattttggtgtgttgaaatagttgacatatttgtaaattttaatgtctcattatatttcactacattgatgtttcatgatttgtggtgtatggtcttgagaaagtagcctttagagtagatacaatattgaatttgacttttaaaaaatcttataagaattttcaaatgtaccccagagtatactggtataataaatcctcatgtattctcacccagctatgacagtcatcaatcatagccactcttgtttcccctgttatccccccttccactattattttgaagcaaattttagataccgtattatgaaatagaattacggtgcgtgaaatttgtcagcttggccttcctaccgatttgtatgtggatatattcttaatttcctgctttgaattgaagtttaccctttcatatttgatcaagtcagctttaattgtatcaagtgtcggtctactttaaattcctatcagtgatagtgaacttcattttatttaagactattagaaattttttgtcagtacatatttaaagcacagtgtggtggcttctaaagtaaggtgtccatcagggcagttgctagtgcttgttttaaaaaattaatttagaaatctgactggttaaatctgagtctgattttccctttttctttgaattttaggaaataaagttttatactctcttgtacctcagtgttgtttctgtgtgtggatgggtgttgggaggagctgggctgatttaagctagtcctgtccctgtatgcatgtacatttcatgcttgaggtttattggcttgaaaaagaccagaaactgtaggttaggatttttcctcttaaagcatattgagcagtcataggttgagcattttacaaagcatgcagataccctcctttgtgttttaataatcaaatgacaggcgtaagataactaagttcaacttgaatattaaaagctgtagtccatttcttctttatatgtttaatgactatatagttatttggctaaattaatttttttctgtgcttaagttaatttttgtacaatttatgtccatatttgcttggaaccttagcgcaatatttgagccagaagacttgcaaagcttgagctaaatgaaataaaattgttggcattaaaggaaagctaacaactttgaagttttaaaatctctgatggtttgagtataagaaatgactccattggatgaggtgaggtaattccaagatacagggtactgataatactaaacgtaccttgatgactaattaagcagtttctgagtataggtattatgctgtaaaaccaaactggaaatggactatccatggagcatagtgtatagctgagttatcaatgaaaatgttaattcgtatgattaatttttaaaaagcattatatgtattaatttgaaattctttgctgttaaggttttggaatgtgtgtttgaatccaaatgtgattggagtatgtaataatgggtattcttagaacatgctgaattgttttacttttttggagacagggtctttctctgttgaccaggctggagtgcagtggcgcgatcatggctcactgctgcctccaacctctcaggcttgggtgattcccgcctcagtctcccaagtagctggaaccacaggcatgtgccactatgtctggctaatttttgtattttttgagagacagtgtttcactctattgtccaggttggtctcgaactcctgggctcaagcgatccacctgccttggcctcccaaagtgctaggattacaggtgtgaaccactgttgcctggctgaacatgttaaattatagaagaaggaacttgaatgtaacttgatggatttagttgttcatatcttattggaaatgaggactttttggtagatatagttgagaaaacaactgatacctagcttgtgtaatgactctggctgaaacagagtttgacatcctaattgcctgttagaatcatttgggagtttttaaggacacaaagatctgagaccatttaaatcagagtctctggagttagggcactggtgctggtagattttaaaaactccactggcaattctgaagtttagctgtggttgaaaaccactggcgtaaaaagacatactccagaaatatttgaagtggaagagagtgagtacaaattattgtcttctttccttgatggtgttgtaaaatttatgtggtggaagttttgtcttttttttttttttttttttttaaactctaactccatcccactactgcctttctagaacttagaaagtactgcttttgatttctggggaaaagtatttttgcattttgtatccagaagaattgaagatgaggaatttttttttctcctgtggaggtaatgtttctactccttgtataccttatttttataatatccttactgagatataaattacataccataaagttaagacaatttaaagtgtatagttcagtggcttttagtaaattgacatagttgtgcaaccattattggaacatttacatcacctcagaaagagattctgtatcagcagttactcctcattccccccaacctgctcacccctaggaaaccattaatctactttttgtatcaatagatttgcctattttggatatttcacataagtggaatcatgtaatatgtggtcttttgtgatgggcttcttttacttaacataatgttttcaaagttcatccatgtggtagtatatattagtatttgtttttatggctgagtaccattccattgtgtggataataccacattttatttatccatttatcagttgatggatatttgggttgcttctacttttacctattatgaataatgttgctatgaacattcgtgtacaggttttcgtgtggacatgttttcatttctcttgggaaatactgggagtggaattacttagatacttccttcacctcatttgaacttcagggttagaaaatcttcccatagagttgggaagcaccgcgagtccatgttctaacgctatttttacactgtaggacagaggtccagtgtgtgttgtttggtcttgtggtccacaaggggcaaactcctcacttaaaagaaggaccagctgtttttccttgctgtgtttccaggaaagggtccacatagacttatattgaagttggaattttaatgaagcttttaaagcctcatccttttactcccttagttgttagggaaaagagcaaaatgtttgaactcttagtatctggaaaataataatggtaatcagacctgacatttgttgactgcttattctgtgccaggcactggacagctgaggctttttatgtctatgatcttatttaagcttcataacaacttgtagcaatgactgccattttactgatggagaaatggagacacataggttaaataacttgcatcagctcaaaacagctgggcagcaatgctgggttgtaagagtgactcactcttaccccgctgtactgtactgcctgccttcaaccagtatatcctaactcccttaggagacatataatcattgccatggaacttggtttgatttatcagaggttcatttataaaggaaattaacagttttcatgaatttattgttcaagtaaattgcagaggaataaaagcttaacttttataaaaatctgaagaaatgaatggttttaaaggagcttcttcatttaaattaattttagatccatctcatgtttgtaaggcacataacatgcagtgttactcgcctgcctccacctcccatgggcttgacttagactttttttttttttttttgagatggaatcttgctctgttgctcaggctggagtgcagtcgcctgatcttggctcattgcaacctccgcctcctgggtgtaagtgattctcctgtctcagcctcccgagtagctgggactacaggtatgcaccaccatgcctggctaaattttgtatttttagtagagatgggggttttgtcatgttggccaggctggtctcgaactcctgacctcaggtgatctgcccaccgtggccttccaaagtgctgggattacagttgtgagccactgcacctggccatatttttaaaagttctattttaattgacaaataataattgcatatgtttatggagtaagatgtgattttttccatacacatatgtgaagtgattaaatcagctaattaacatattaatcccctcaaatacataccacttctttgtggagagaatatttaaaatcctttttttttttttttttgctatggagtcttgctgtgttgtccaggctggagtgcagtggtgtgatctaggttcactgcaacctctgcctcctgggttcaagcgattctcccacctcagcctctggagtagctgggactacaggcgtgtgccaccttgcctagctaatttttgtatttttaatagagatggcgtttcaccatcttggcaaggctggtcgtgaactcctaacctcaagtgatccatccacctcagcctcccaaagtgttgggattacaggtgtgagccaccatgcccagcctaaaaatcccttcttttagctattttgaaataaacatgattctgtgattaccatgctatgtaatagatcaccagaacctattcttccgtctaactgaaactttgtacctttgaccaacatctcccctttccctatctaccctttaccccagtatcctctggtagccaccattgtactctctacttctatgagattaacatttctagattccatatacaagttaacatcatatgatatttggctttctgtgcctggcttatcatagttagcagaatgtcctctgtgtccatctgttgttgcaaataacaggatttcctgttttttaaagactgaatagtattccgttttatgtgtataccatattttaaaaatccgtgtcttggctgttgtggataatgctgtaaagaacgtggaagtgcagacatctctttgacatactgatttcaattcctttggatatgtatagccagaagtggaatggctggattgaatgataattctgttttcagttttttgaggaacctccatactgttttccataatggctgtactaatttacaataccaccaacagtgaacaggggttctcttttctccacatcccttgccaacacatactgtttttcatttttttaaataaccagtctaacaggtgtaaggtaataccttattgtggttttgatttgcatttctctgatgattagagatgttaagcatttttttcatgtacctgttgaccacttgtatgtcgtcttttgagaaatgtctattcaggtcctttccccattttaaaaatagggttacttgttttttattgagtagtttgaatttttttgtttgtttgtatattttggatattaaccccttatccaggccgggagtggtggctcacacctgtaatcccagcactttgtaaggtcttgttctttttttttttttttttttttttgagacagagcctccttctgtcgccaggctggagtgcagtggtgcgatctgtgctcactgcaacctctgcctcctgggttcaagctattctgctgcctcagcctcccgagtagctgggactacaggcgcccgctaccatgcccggctaatttttatatttttagtagagacgggatttcactgtgttggccagaatggtattgatctcttgatctcatgatagacccacctcagcctcccaaagtgctgggattacaggcatgagccgccatgcctggcctactctatgccttttgattggggaatgtaatccatttacagagtaattattgataggtgaggacttaaccagtgccaattgttttctgtttatagatcctttgttctattcctcctctcttgcttgtgtgtgtgtgtatgttgtgtgtgtgtgtgtgtgtgtgtgtgtgtgtgtgtcttaatggctttctgtagtggtatgctttggattttatctttttatctcttgtctgtctgttacagacttttgctttgtggttaacttgaggcttacataaaacagcttatataacggtattttaagttgataacaacttaattttaattgcatacacaaactatacacttttacacccctttctcccatattttgtatttctgatgttatacttaaaatttttatataatatttattcccttaacaaattgttgcacttcagttgttaatagttttgccttttaacctttatactagagatataattgatttactcactgccattagagtattagaatgtttggatatgacaatgtatataccatgccctggcctggataaggggttaatatccaaaatatacaaaaaaagttttatactttaataaattttcatgttattaattagtgttctcttccttcagcttgaagaactccttttagcatttcctgtaatgcaggtctagtggtgataaagttagctattgattgaaaaagtctttatcatccatttggttttgaaatacagggttgctgggtatagtattcttggttggcagttttttttctctctctttcttctctttctttttctttcttctctctcctctcctgccctgtcctgtccctgtctctctttcttttcttttccttccttccttcttttcttttcttttccttccttccttttcttttcttttcttttttttctatttttaaatatatcatcccactcccttctggcctgaaaggtttctgctgagaagctatctgatagtcttatggaggttcctttatacatggtgatatgcttttttcttgcagttttcaatactctgccattagtttttgacattttaattgtgatgtgtcttggtgggtctctttgaatttatcttatttggtgtcttttgggcttcctggatctagctttccatttccttccccagccttgggaatttttctgccattatttatttgaatatgttagttgttcttttctccttctggcacctgataatgcataagttgttctccatgatggtgtcccataagtctcttaagtcactctttttcattattttttctttttgctcctgagattagatggtttccagtgacctgtcttgtagtttactgatcctttcatctgcttgatctagtctgctgtcaaacccctatattgaatttttcagttcagttttggtatttttcagatctatgttttctcattgatactttttaatattttctgtctctttgtggaagttcttagtttgttcttgcattgctctcttgacctcggtgagcatctttgtgaccattatttggaatttcctgttgggtaaatcatatatctccagttcacttgagttggtttctgttgatttattttgttgcttttttttttttggaatatattttcctatttcttaattgttcttgactctctctgtgttggtttctgtgcattacgtgagacaactgcctctctcagtcttcttagccttgtgtagcagaaggatctcaccaatccatccagctagagattttaagataccttttaaatctttgtatttgttcagactgttgtctctattcttggtgccatattccattagtaccctgtgatcagtaaggcagaagccagatgcatagatgtagctgggaaggttgaggtgttgggtatgtgtcctagttccttctgtcatcatgttgaagtcaagtgcttgattcttccactctttctacactaagccatctctgtggcaaatgcctatgcttgtgttgtggctgcactctacgatcctggggagatatctgctggaagtgggcttgtagtatgtccacctctgttttctgtggtttagggagattcaggaatgcaaagccctgtcacttccagagcttaggttgtgaagggtacagtcccttgtctgtgtggagctataaaagtgtggcactcagtctgtggacaaactccttttaggaagaatgagtaggcctggaattatcagtgggatgtgctgggggaaaggctcaggatatgccaagttcctgctcaggctgcctgaggggtactgtttgtctcccccattagctctctgatgcaagttagaggccaggctgtcaagtagcgactggaagagtatgcagttataaaccctttttggagagaaaatgagagctgcatgttccagactcttttcttcactgctcccagggagtgtagccctagaaagtatttgcacacctgtttaaaaccacctccttgtttttttgatctagagagacatgcatatgcctagtctcttccattaccacatctaggagatttaggatatagtcctttgggtggatgctgtgcaaattgaggcatttgatgtgtggacagactccttctaggaggaattggtaggcctaaagttactgctggggcaggccagggggaaaggcttggaaagtgtccagctgctgcttaggctgccagaaggctacttttgcactgtcccattaactcccccatgcaagttaaaagccaggctgtcgagtagccactggtagactgtgccatgagccccttccagggagaaatgtggagcttcacattcttagctgcttctctgcactgcccccaaagggtgcagtccctgaaagtacttgcatgcttgattaaaagtatctctcttgttctagggatttagtgatctaggaagacttgcactagatccctcagctcccagagccaggagatttaggatgcaggcacttggatggaaattataaaagttggggtcttgatgtgtgaacagactcccagaaataaatttttgggatatagatgatgaaggtggcttgcagctagtcccaaaataaatacgttgaatgatagcagaagtcattttcagaaagtagacattagtttttcccatactgtgacattcaagccctctttgaagttcaatcgtgggtcaaattattataaatagattatagattatttaggactcacctataaaaccctttaggtgcaagataaatccttcttaagcttgatattttgttacagtaattgagctataaggagttctagtgtatttttgctttgagacacatacatgaacgcatggtacctttttagccctgttatttaatagcctgcttttctcatgtatgctgatgtgatcttcccctgctctccagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagaggtaacgttatatattgaactgttgtttaaaaagagtgctgcaaagaattatcagggctgtcctcttttacttctcctatgtagactgtctctgaagttggtactgtcaggcttttaaaaatgagagcctaaagtgtttgactttctaatctagaattgcctctgtgtagatggatagaccaggcaagttgtagatacaaaggccttcccttactcattttctgtttccaatatgtagatacactgtgaaatggaatacttagcccttgtgatttgtccccttgaaacttaattgcatcccattcatgtagctcagtgaggggaaactaaaccagtatctttttgttttataccttatgttgctgggaacatagctagtccttccaaaccatcaaattcctatgaccaggtttggattgaatttatctcccaaatgtgcataatagctcctgtccagctaaagggcagtcagggcttcttgaagtgcatttgtgggtattgataagacagtagtggtttgtttatttgaagtagcagcaggatttcatatgaccaaatcaaagaatggctgtgatactggttttatagcaaaagtatttgatatgtttgtttctctttgagaaatatttaactcttaagaatcatgatttaactcagctggtttttaagataataaagtactgtagatttttttcagtatagttacatctaaaataattacttaattttttttctttaagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttattt

SEQ ID NO: 17577 - DNA, 15077 bp, Human; identical to SEQ ID NO: 12441

SEQ ID NO: 17578 - DNA, 43726 bp, Human
  misc_feature (1)...(43726): n = A,T,C or G
cccttgacctcaaagccacgcttggctgcaaactggccaggcagccacaaggctgggcaagcagaacgatccctaatccccacccaaagagccacaccgaccctcccagccgctgtgacagctcctgcagagacaaacacacggcctactcttgtcacccgggccggccaataagcacggagaggcaaggcctcagaccctggacagacatcctccctccagaggcacccagggcctcagccttctcctccctccctgggcctcaatttctccacctgtgacccagggcaggtggatccagggagaagaaccttctggctccatctcaccgtgggtcctgccagcacacacaaagatttggcctctcaaagcctagctctgccagcgtccttctgctcaagaactctccatgactcccagtggccctaaggacaaagtcctggcatttgaggccctcccaatgcagggccagactctgcctctccagcttcctgtccccaccacacccctgctggtctcacggtggtccgactgtttcctgcttctgtgcctttgcttagtctggcacccctgcctggcatgctttcctcaccccttcttctccccaatcccaactcacccagtctttcaaagggcaggcctaaataccaggccctccaggtggcccaggattccttctctgagctttcatgggcctggccctgggtgctacctgtgagtagtcccacggtgggtacatagtaggtgcgcttactgtttgcagaatgaacatgggacagtttggggactgtcacccagctcagggagcactgatggggaagcatctcctgtatgtcccagggctcagtgctgtagtgtcctgaccctcagaaatctcataatggcttggtcaggaaggcatcgtgccccactttgcaaacagggggtgctgagaattgaggggccttgtccaaggtctcatggctaggagcaagcagaatcggatttgaacccagggccacgtgacttcagaagtgccattaaagtccccataatttggagctgtcttctttttttttttcttttcttttttttgagaccgagcctcactctgtcacctaggccaggagtgcagtggtctgatctcagctcactgcaacctccgcctcctaggttcaagtgattctctagcctcagcctcccaagtagctgggactacaggcgcacgtcatcatgcccagctaacttttgtatttttagtagagatgggttttcaccatgttggtcaggctggtctcgaactcctgacctcaagtgatccgtctgcctcggcctctcaaagtgctgggattataggcttgagccactacactcggcctggagctgtgttttgtcggtgaaggattttccacccatgaaggggtcagacgtgaagtgtgtggccctgggcagctcctctgagcccagagacgccagccctagccgccttgctgtgccactttgggacttccctccctagcctgagcttcagttttcctgcctgttaggcagccccatgtcaactgcacttagtaggccgggtttgatgcccgacaagacgtgaagtggtggaggtgggcaggatcccagcgctaccatcttcttgaaccagtgatctcaacacatcggatttctgtttcctcatctgcaaaatgggatcagtgagctcaggtgggtcacaaattctacaggaactactttagccaagcccggccccctgaaagttcccctcggtgggctgttagggtgattgttttcatctgtggggctccctgatgcgtcccacccaccagccttggagagggtgggatgggagggtggggtgcttggggagacaagcctagagcctgggccctcccaccccactgcctccccccatcccagggccccccacccagtgacaaagcccgtggcacttcctctacccggttggcaggcggcctggcccagccccttctctaaggaagcgcatttcctgcctccctgggccggccgggctggatgagccaggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtaggtgtccagggacccagggtggggagactcggcctccggtgcacggaccaggccccaagtattcccggcctccttcctgtatcctgagctcacgcccagcagagccatccttggggctctggagggtcaccaaccctcccagtttgctggaactaaatggttatgcaggactttcagtgttgaaagaaagcctcgggcaaactgggctgactctttcactttaaccctggtctctggcgtctgctcacccagctgcgttccattactccccgggaagcctaggtcccagaatgctgtgcagcgacgggagagtttcctggcctctctgggccttgagtttccccatgaggaatggatgggaaggagggcccacagcctgggctctgagcaccgtctctgggttcaaatctcacataggcacttccttgtggtgtgatcctgggggactgccttcgggcctctgagcgaagtggggaagagaacagacttccctctcagagctgctgaggaggtgggtggtgagggatcattgcagagagggctctggcagactggccacttctgtgttgttttatttttagctttaagttcctccagctcaccttccccagggcctttgggcagctcctcaaaccctttgaacaggccaaggctgcagggccctgccctgcctccctcctacctccctgatccccagaaagggtgcaggagtgggtgcaggccaggttaggggttctgtggggctccttggcctgggggctcttccaaggggtcatggcctctgctgctttctgaaactgaccagaggaggggtggtgaggagcaagggacccccagccccatgtcccactccctatccctcggccacctcaagccgctggccggtcctgtggacatcctttgacccacctgtgcatccaggggcttcctgacagatttgggggaagaggggcagaaatgagctgagagtgtggggaggaaggggaaggaaaacagcggtggggcagccaacttctccccacctccccacctgatggcattttagagtccctgattctgggtctctaaagctctgcccaccacctgattgacaggaaactgagtctcagacatattaagtgacttagcagggatttgactcccggcctgcggctccctaaatgtttgctcctagtaaggtgtgatagggcgaaccctcttaatgcggctcacaacgaccctgcaagatggctgccatcatcatccccattttacagaagagaaaagggaggctctaacctgccaagttcacatggctaagacggagcccctacctgagctccaagatctccctctctcgtatttgtcgctgcagtaacactctcttcctcttggtcgttagagaaaggtccatgcagacatttagggcctggttttaaaggatcaaaggcagtgatatgctgctgaataattaacaacggggtggggagctcaatttgtagcgtttgtggattttcacagcgtaagtactcccacccggctgacttcaagccaccaactcaccaagtttggagctgggaatcagtgcccggtagcacctggcggttggttctccagagtctctgcaggcgcagatcacaccgagagcagagatgacagtcaggggtgtaaaatgattagaaagaaatgagtttggacattcatgaccttttaaaaatatatagtaatagctatgtaacagccagttggaaaaactcctggaaacgtatccgtctgttcctgtgagcaggtaggagctggtcccagtgcaccaggagtcacaggctcaaaggtacaacagaccatcaacccaactcatttatggtctgggaagctgaggcccatggaaggcagaggggagcctggggccagggcctggaagccagctgggggtaggggtcggagtgaccctgacctcctagaaatgggtctagaatttgggggcaccacttgtaagaatctcctaaaactgtaccttgcatgtgacttgataccctcacaaatcagccttcagtagtcagccttctaaagttattcgtccaactctgtaaagatgcgtggtccgtgggtacctgtaacaaaaacccgataactggaaatcatctaagtgtccatgagcaaagactgttaataaattaccacacgacggaatgtcatgcagcaggcaccaagaaggcagagtcatatgaacactgccatggacggatgtcagggacacactgttaggtgcccaaacaacaataattccattttggcaacaataaaatagtaataatgtacaatatgcacagagaaaattctggaatagagttttctatttaacccactattactgttctctggtctggggttttctctgtgggactttcactttcttttttaaatttttttgagacagtcttgctcttgtcacccaggctgcagtgcaatggcacaatctaggctcgctgcaacctccgtctcccgggttcaagcagttctcctgcctcatcctctcgagtagctgggactacaggcgccggccccacacccgcctaatttttgtatttttagtagagacggggtttcaccatgttggccaggctggcctcgaactcttgacctcgtgatacgcctgcctcagcctcccaaagtgctgggattacaggtgtgagccaccatgcctggctgggactttgactttctaagacacactttcctgtcatgttgggtttttttgttttcttttgttttagggacaagcaggccgggtgcagtggctcacgcctctaatcccagcactttgggagggaggctgaggcgggtggatcacctgaggtcaggagttcatgaccagcctgaccaacatggcaaaaccttgtctctactaaaaatacaaaaattagccaggcgtagtggtgggcgcctgtaatcccagctacttgggaggctgaggcaggagaatcgcttgaccctgggaggtggaggttgtgatgagccgagatcaagccaccgcactccagcctaggtgacagagcaacactttgtatcaaaaaagaaaaaaaaagaacaagcatgtagagatttttttaaagcaattaaaattaaccatatagctgcctcagcttgcccctcaaaaaaaatagagaaaagggaaaaaatcacctcggaactcctttattgatacaggtaccgttagtatggtggtagatggcttactagtttttttttctaactttttaagctacttttaatccagatgggtccacattttgggagtcttttgtctatttctttcgaaccaggtctccatgttgtcctgtggactccatgaccatcctcttgcacttctggaatattctgtcccatcaacttgtcaccgtttgcttattgttaaatatttaggtggtttcccctttgttctagttataaatactaccacaatgcacagttttggtacgtgcaccttttcctgtattttggattatttcatgtggattgcgtcccggcagcaaggctgcagcggctcgtggcctgtgctgggtggctgggattgaagagtgttcctgagtgtggaggatcctttgctggaggacttaaagtccccatgctgctggctgtctgtgttggagtctgggacttgctggagaagggtcagtggcgcaagagcgagaccacaaacacctgtctcttagaggctgcgttcccatttgctaggaggaaaaagagcctggagcaggagccgtgtgaaccaggagagggtgggctccccgagacacgggggacgtgaccattagcattctccctcaccccagccagacagacgtgacccagagggacagagggacttgcttgtggtcacggatgtgttggtgctgggccctcgggcgacagacccattcttttgccccagggctggaggtggatctgggcaagagtgaggcggccacctctcctctgtccccagcatgtcaggcataatgccagctcctccttgcctctatccccagtttatagatgagaaaattgaggcttgggacaaatgacaggtccagatttcaactccaggccgtctgcttccaaattcagcttcttttccccacaacttttgtgacctgaatgctggagacctaaagaactgtttacccttggctctgggaccctgcttcctagttccagcccaggctttggggcaccagccttggaggctgaagggaccctcagccagggttcagctggcttcaacccctgtggcaggagtgggggtgggataaagagataatataacaactgacatttattcagcacttacagtatgctagacgctgctctaagcgtggtatgtgtactgtcagacttaacgcttgcaaaagccctacaaaggagatactctttctgcccccatttgacagatggggagactgaggtactcgtataactcagtcaggtgaagaaatttacccaagtaacactgccctgaaatgagccactggggctcaagccctgggcctaagcactgcagtgtgctgccacagtggagaggatggggatcttcctcttgcctgatcttctccccgcaggcactcagccttttctctggtccccataacggccctcccatccggggtacaacccctgggaccctgcctttaccttcagcagtcccatctatgccctgctctgtcttcctcctgccttcatccttaggtgaaatctcagactgtcagacccctagtagaacttagaatatgtcctatccacccccgctcttccccacccactagccatagggaaacagagtcccagaatggtggggggacttgatgtgggtcacccagcaggtcagaggcagccctgaccagccagttccacaaatggatgtttgtggtgttagaaacaaaatgcttgttcctcagtgccgcaaagaaatagcacttgaacataaatttaatcttctcagcaaggcaatttttacttctacagaagggtgcgattcaagaatggagtaatggcgagagcacatctgaacaagggaggggaaggggttcttactcctgacgcaggtagcccctactgctacgtcgttcccctacgggctagtgttggaccgcacagtctaagctaattccagttagctattttagagagagcaggggtatgagccagagtggcggggtgagtagtttggagggaaggatggttaggaacaggtaactaaaggtgacttaggtcaaagcaggtgaccaggggtttgtgaggtcaaagcacatgaccaggatgagtcaggatggagcaggtgaccaggggaacagatgtgaactactgattaaaactggtggaaaaggttgtttactgaaaccatgaggaagttaaactttaaaatggaggacaaagaactgaacatactgacatactgattctttgaagagaaatctagaactcactgtatccagtggaagtggatgtttgctctgagccctggactaactgattgggacatggaatgctgtggactctccttgtcctggaaaaactcactgtctgctgggagtgcagacacactgacaaatcaaaacagcacacctgggcatgtatggtctggttctccaaggacacccaaggacggatgcacctaagaaaggagggactggcttcagtgagattttcaggacagggttttgaaggatgaatagaagttcgctaggggctgggcatggtggctcatgcctgtaatcccaatgttttgggaggctaaggtgggaggatcacttgcggccaggcgttcaagaccagcctgggcaacatagcaagactctttctccacaaatatttttaaaatttagttgggcataatgactcatacctgtagctgctcgggaggctgaggcagaggattgcttgaggccaggaggtggaggttgcagtgagctatgattgcaccactgcactccagcctgggcaacagagcaagaccccgactctccaaaattaaaaaaaaaaggccaggtggtcaaacaaaggatgagcgttggtctgggaaagggcatggcagaggcaggagcgaggtgtgtttaggggaagagcccacatatccccactgactgggcataaataattgtgatggtagtcaccagttcctgagcaacccccacttagcaggagccggcctagcgctgtgcaggtgtaatttactggcctgcttgccgactccatgggaagctgttatgatgaccctcatccccatgttacagatgagaacactgaggatggaaaggcagctggcaggtggaagaatcaggacctgaacctttggcatctgtcaaatcgctgtgcttttcacctctactgtaggctgcagtgcaggaacttgaccctgcaggcatcgtagaaccaggggggagcccggggccaaggcatgctgagacctcctggtggctgggggcagtggctgggctggatgctgggaaacctgtgaggctgtaattgggcctgaaaagggtaaagagtggcccgggggtactgaacaagacggggcaggcattgcagcaagaaggacccttgttgaaacgtatcttccttgggaggctgagatgggtggattgcttgagcccaggagtttgagaccagcctgcgcaatacggcgaaaccccgtctctacaaaaaatacaaaaattagctgagtgtggtggtccacttgtagttactcaggaggctgaggcatgagaatcgcttgaacctgggacggggaggttatagtgagccgagatcgagacactgtactctggcctgggtgacagagtgagactctatctcagaaaaaaaaagggggggtggcagcgggaagaaaagtatctgtcctagtatgatgaaataatattcacagcttctgtgtctggggcacctacttagtaccaggcactcaacaggggttaccccatcaaactgacacactcagcctgtgaatgcctgctgcttgctggagccagactgtctgggtttaaatccaggccgtgacacttagtagctgggtcacctcgggcagctggtcttcagtttctttaaccgccctggtcttcagtttcctggagtgtgcatgggtgtaatagcgccgcccacctcacaaggctgctgtgaggatcaaatgagttcactcgtgtaaagctgcctaggctcccagtaagcatgatgggagcatctgcagtgattattggtggtctgcaaatggggaaactgaggctcagagaggttaggcttctgctcaaggtgaccagcattttaagaggcagagctgggatttgatccaggccatctggctccagagctgtttttcttgatcatcctccaaggtgctgaaggtagccctctggaaatctgggaggtgctgtgtgcacatgggtggcgagggtggagaggggacagtggtgggaggtggcttctgggtctctcacttggggttccagtcacccaggcccccagcggctcctcctctgacccagtcccgggaggccctggcgtttcccttggtgccaggggattgttttcaacttggtctgggcccgcctcaggctccgggagacaggcccaggcgtcacactccctcctgtctccccattctcgtctgcggggtgggggcggccaggattcgaaaaggccccaaaataaatggacctcttatctgatctccccgccaggcctgttatctgatcattacataatggccaggcttgtggcctctcccgctggctgacggcatggaggaggcggccccaggcggccccagcaatccgggaggaactggggttcctggaagtctggggagggggcagggaaagtcccaaagggaaggagggaggcgctgcgataatctgcaggccagacactgggtcatgttgggagacgcgggtccgaggcccggcctggtcaaccatgtgctgtgagactttgacctgtcccgtccctccagacctcagtctccccatctgagtaggaggggcttaagctaggtaacagccaaggaacctgcgctcaccgatgaggaaaggagagggtggggagaacatgggggctggtgggtcagagggactggagacaggagatggcaccagcccttgattttgttggggtgagggagatcccagtgacctctccatcccagaggaccgtcacctggaggccaccccatcccgccacttcaccccaccccttagaacagtcaattctacagtgactgaagtcagtcaaataattgtaattaagagaaagctgccggccaggcatgctggctcactcatggtggctcacacctgtaatcctagcactttgggaggctgaggcgggaggactgcttgagctcaggagtttgagaccagcctgagcaacatagtgagacccagtctctactgaaaatttaaaaaattagccaggcgtggtggcgcccaactgtagtcccaactactcgggaggctgaggcaggaggatcgcttgaacccagcagctcaaggctgcagtgagctgttatcacaccactgcactccagcccaggagacagagggcaaccttgtctgaaaaataaacaaatagaaatttaagaaagaattgccatgtgcccagtctcatggagtcctcccagccacctctgtggatcatgtgggctctgttgtcattttatagaccaggtattgaagccccaagaggtgaaatcattcaccagagccacatagctggtaagcattgggcctgagaggcaaaccaggtcagcctggctccagggagcttgcttttaaccaaaatgccactatgtccaggcactccagagtccctgggacatgtaggatagggtcagagagacgacatataaggcctgggcccccgtggcagccagaagtcctcatccagatcttctccttcccaagacagagctgggaatggcgttgccatggcaaggggtgaccatctcacttcctttgctgacttctggggcccagagcccaacgtgctgtgggaaggtgaggaaggaggccggtgaggctccagacagcccagggttcagcagaagcctccctgccccctcctctgagccggccttggctggacatgaagccagtctctccgcgcccatctttgatctccaagaaaacaggaagtgagcgcgacaagatggagacacaaacttccaaacagtctccccttctgtcctccttccctcctccggagcccccttcccccggcacattcctcaggacgaggtgtaggagcctcatttccttttccgaccctgctgggtcagggtgaaattccattcctttccctcaggacctgtgtttccgggctctgcggtctgctctggcagcctccaaacctgggccgccttctcggctcgccctgtcccttggggctagggaactctcaaccccttcagaccattcctcccaccaccttgaggcaagagaggggaagctttgtctcctgagctcagctcctgccttacctggagggagacttgggttcacacctaggccctgccatgaagttagggttgccagatacatcaaatgaaaatcagccgggtgtggtggctcatgcctgtaatcccaacactttgggaggccgaggtgggaggatctcttgagtccaggagttcaataccagcttgagcaacatggtgaaacctcatctctataaaaatgcaaaaattagctggatgtggtggtgcatgcctatagttccagctactcaggaggccgaggtgggaggatcacttgagcctgggaggttgaggctgaggctgaggctgcagtgagctatgattttgccactgcactccagcctgagcaacagagcagagtctgtctcaaaaaaataaaaaataggccaggcgcagtggctcatgcctgtaatcctagcactttgggaggccaaggcaggcggatcacctgaggttgggagttcaagacgagcctgaccaacatggagaagccccatctttactaaaaatacaaaaaattagccaggcatggtggtgcatgcctgtaatcctagctgctcgggaggctgaggcaggagaatcacttgaacccaggaggcagaggttgcagtaagtcgagatcacactgttgcactccagcctgggcaacaagagcaaaactccgtctcaaaaaaataaaataaaataaataataaaaaataatttttaaaaataaataaaaaataaaaatataggaggctggccgggcacggtggctcacgcctgtaatcccagcactttgggaggccgaagtgggcagatcacctgaggccgggagttcgagaccaacctgagcaacatggagaaaccccatcgctactaaaaatacaaaattagctgggtgtggtggtgcatgcctataatcccagctacttgggaggctgaggcaggagaatcatttgaacccaggaggcggaggttgcggtgagccaagatcacaccattgcactccagcctgggcaagaagagcaaaactccatctcaaaaaaaaaaaaaaaaaaaaaaaaaaaaaaaaatatatatatatatatatatgtatgtggatgtgtgggtgtatatatgtatatctatatatgtatatatgtatgtatatatgtagatctatgtatatgtgtgtgtatgtatatatacacacacacatatatacatggggcccagtgaaatccgaatttcagataaacaatgaaaatttagtataagtacgttccatgcaatatttgcaatatactaatacttaaaaaaatgcactcattgtttatctgaaatttaaatttagctgggtgtccttctattcatcgaccctatacgtagtagcgctgtgaccttgggcaggagacgtttcctctcctagccttggttttttttaatccatggaacgaatataatgatatccacctcataaggtggctgtgatgatgcaggaaagccgttagctcatgtcaagtccctaggagacgtttggaaagtaggagtcattgtcatcaccttattctcacctggcctctttccggatgtttctccaacaggtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacggtgagtgtcccatggcagggtcgggtgggggctcagaggaagctccaaggcagatggggtgaggggtgccttccttgtggctgtccctggggcagtggctgagtcctcgttaggccccctgccaagagagtgatgtgggcatctcacagggcccataagaggtggcatttctaggggcagggtctggatcagggcagtcttttgggtgccaccagaagactcaggtgggaagagctgagtagagaagagccagatgggtgggggggaccaggtgagtgttgcttatgcacctccaatgatggagacctcacagaatctcagaagaatgcagctcctctctagggagcttggactttgaaaagtgcttcttgggccagccacagtggctcacgcctgtaattccagcactttaggaggccgaggcgggtagatcacgaggtcaggagatcgagaccattctggccaacatggtgaaaccccatctctactaaaaatacaaaaattagctgggcgtggtggtgagcgcctgtaatcccagctacttgggaggctgaggcaggagaattgcttgaaccagtgagttggaggttgcagtgagcttgagattgtgccactgcactctggcctggtgacagagtgagactctgtctcaaaaaaataaaaaataaaaaaataaaaataaaataaaaatacaaaaattagctaggcatagtggcgcatgcctgtaatcccagctgtacttgggaggctgaggcaggagaatcgcttgaacccaggaggtggaggttgcagtgagccaacattgcaccactgcactccagcctgggtgacagagtgagaccctgtctcaaaaaaaaaaaaaaaagaaaagaaaaagagaagtgcttttcagttgagcccagatctttctccctggaatgtcccctgctgaatatctgtgaccctcagagatccaaaggctgctgccggcctggagacgattctccccaggagacccccactcccagcccaccatcagtttgtctgatacgtctgtcctgaataataacaacacctttgttaagcgctatgtgctagagactgtgctagggccgactctatgccaggaattaagcatctcacatgtattaagcctcccaaggctcatctgccagggtctgttattatccccacttcttggagaaggaaactgaggctggctgagagcgatggagtgacgtgcccagggccagagttcacaccagatccctggggatgccagagccagcctgccacttggttccccacgtggatctcagtgttcaggtggcttctggcctgttggactggagattacacctggttgatgtggcctttggtcccgatactgacttcgccgtgtcagctccgggtaaacttatggccaatctgcccccaaaactgttaagttgccttgcgtttgtgcagtgataagaaagtgctcagaccaccaatatcgggggaccctgctccccaccgccctgccctctacgaggactgtgggctttgataatttccaaatcatagatagtgccaaacacactttgtgtggtttccataggcattgtcatttttttttttcaaatttggtaatgatattcaaaatacgactgcctctgttagttcgcattgtttgttttaatgttcaggtccctgtgcctcctctgggtgactgggatcccccaaccctaattgctcaatactgggccagggtgagaggagggcccctaggcaggtgtctaggtctatgggagataggtgtgtagatagccagccaggatccaggggactggtgcattctcacggggcacagggccagggcactccagctgctacgggattaggcatggcttgttacggccacaccatcctgaacacatccgacctcatctgatcttggaagctaaggagacttgggcctggaggaagaaacatcatggatgtccaggagctcaccaaggaaggaggtggtgtggaagagcacagaatagagtgaatgcggaggcagagggaacaggctctggggtcatcaggtggcaggagctagaggttccccagcaggacaggggagatggcaaaggcctgtcgccatattaagaagtttgatctttatcccgtgggcaataacagttcttggagggattttaggggcatggcagggggccactgtaactcatgccatattccaaggatccttgagttcatgacaacaaaatctccctgttagcctctgcctcttctagagaactcgctccagggagcttccaacttttaattcaaggagccaggctgcaggctccagggctttgagggatgttcatttgaggaggtggtagagacatctggggtccaggaaacccagggttcagtcctggatctgtccctggccagcacctcgcatagcatctggtgtgcagagggtggtccttctccccacttgctggtagacacacctttctcggactcaggagctcacctgagaacacagagtagcagaacctggcccaggggcctggcttacaccaaatcactctgtttgtttgttttttgttgtttttgtttgtttgttttttgcctcagactcctgtagctgggattacaggcgtctgccaccatgcccagctaatttttgtatttttagtagagacagggtttcaccatgttggagaggctagttttgaactcctgacctcaaataatccgcccacctcggcctcccaaagtgctgggattacaggcatgagccactgcgtctggccccaagtaactcttgaacgtgtgagtgaatgcacgcatgcgtgcacaaatgtgtgcgccgctgtatgaccttgatgcaggggttgagaacacaggttctggagccaggcagccctccagctgaactgtggctccgcctctgagagccacatcgccttgggccacctccgagctttgattttcccacgggaaacctggacccattagcagcacctacctcacaggtgtgttgtaagaatccagcaggacggtgcaagcaaaacaccaagcgcaggacctgcctggagtgacggctcagcgtatggtggctacggttattgttattattatttctctctgggttccatttctcctctgtgaacatccccattttgccagggttgttaccgtttacagaatgtcttcgtatcagttgaataatttgaacctcaatggttattgctacaagatcaatggggcaggtcaggcgcagtggctcacacctgtaatcccagcactttgcgaggctgaggcaggcagatcacttgaggtcaggagttcgagactagcctggccaacatggcgaaaccgcatctctactaaaaatacaaaaattagccaggcgtggtggcaggtgcctgtaatcccagctattagagaggctgaggcaagagaatcgtttgaacccgggaggtggagattgcagtgagccgagttcgcaccactgcactccagcctgagcgacagagcaagaccctgtctcaaaaacaaaacaacaacaaaaaaaagattaatggggcagggctgtgaattcattttcagcagggcaagctgaggtccagcctcatggagctgggccttcctcctcctgctgcttcttgtctccctgctctgagggttgagcccatgatgctgccagcccctactgctgtgaccactgaggaccctgtggtttccctgggaggcaccttcctccccaggcatcccctaagagtggggtctagagctcacagtccccattgcgcagccctcaccaggtgccactctgtgcccagcctgtgttgatgatgcagacagaaggtagagccagggaggcagaggtggcatcagcagccctggtatgagtggtgggatcagcaaatggggcttcagggggccgcaggtgatggggtgatgagcactgaaggtagaggagggaggggcgttagggaaaaggcccctggtgtctagcccaagagcagggtagagggcattccaggcagaagccagtgcacagcaaaggcctagcggcatggggctggacgtggtagtgggggtggtggcttttagcagccagccggatccctcctgacctatggccggcttcttcgatctctggcacagagaagtggctttcccgtccatccctcagaatcctcagatttcctgtgggtgggtggtagatgggcggtggcagccgagagccttggggaagtgccgctcagtgcgtgtgctgggcaggtctgcagacagccccgctgggcaggggctggatctcgctgggtccctgaagggcaggccggagcctggattccgggagggggcccagggtcacatcctgaccctcggagacaggaaaccagcctggtgtctcagcaattcccgtcaggctgactgggccgatctgctatcctcctaacaaatgcacaggctgccaggccagggcagagctgggtcagcactgattcacccactcctgggcaaacttggggcagctgagaccccacccacccctgaacagacacagcctgtcaggccccagcactgactcactcttgaccagaggggcaggcaacaccactcaggcagagagagagagccgggagggaccttagctcccccagactgtcctgggaggcagtgggaggccatggaaggcagtacagccctcagacttgggcaaaggggacccctgcctgggcttgggggaagcagtctccctctggccctctgccaatggcagccctctcccagggtggggactctgtggggccaaagggatgtacccccctgaaacctgcacccctcccttctagatgatgctctgggtacccaggaccccaaaatcccaaatggctctgagcctcctctcagggctgcagggatctttcctgttccatcctccaggggagcactgcatggctatgtgagctcccccagacctgaaggatggttgagttggctacttggggaggcaggcatggtggagtttgggtatccgggctgagctgtccacatgtggacacatgagcacccttgctggctgtcagaaccacagtgatgagaaggagaaagcactggggccagaggctgccatttgtattcttgtctcaggccttgcaaatattagaggcaggcttgctgaaggggcaggattgggggttggggagggtcagacaggctgagcagggattgtgcctgccctcttactgctgaatctttggtgttaagctcgaagtcagcccaggaatcaatatctgttggatggatggatggatggatggatggatggatggatggatgcattcatgcatggatgagaggatggatggataagggcgggagggagagagaataaaagaaaggaaggaaaaactgtacattcttataagcatttggtgattggctattcccaagtgggctgatgatgttccttgctgtttatgtctggtcgttcggaggtgttggtttgttctctgccaagctcttgaggacagagttatgccttttctgtcctttgagaacacagaagccccaggctgggcccagtgccagcctctcagacaggcaaatgagttggagaggtgaggacacgtgggctgaccaccagaaaggctggaggtaccaggggccccctcagctgaggaagaagcatatctctccagggcattctgaaaacccactctgtggccatctggctggagaccaggactcctagatgtaaaatgctgggacccccagaaggcagcctgggatctaggggccacacaattctagaacatcactgagctcaactcctccctgcacagatggggaggctgaggctcagagataggatgccacagcgaggcatggctgagagatttgtagttctcaccagctgcagcccacctctaactggacccatgcttcccagcccctaaactgtggatggctctccttggatgactgtgtgcaaggggagaatcagagggattaaaaagccaaccaggccaggcgtggtgtctcacgcctgtaatctcagcactttgggaggccgaagtgggtggatcatttgggtcaggagttcgagaccagcctggccgacatgggcgaaaccccgtctctactaaaaatacaaaaattagctgagcatggtggtgggtgcctgtagtcccagctactcaggaggctgaaccagcagaattacttgaacccaggaggcggagattgcagtgagccgagatcgtgccactgtactccagcctgagtgacagagcaagactgtgtctcaaaaaaaaagccaaactactcccacatgtttagctgggcactggacaacctactttgcaggcagaattgcactgaaacctcataagtcaatgaagtgggaataccattttccaaatcaggaaactgaggcccagagaggcatagtgactgtccaaggtcacaggctaatgactgagcccccatctgaattcaggttggtctggctttgatcctttcccctgccaccctgcctgtaggaccatctgagttttctggggtggacagagggacggctggctccaatctgaccgcctccagtcaggccctgggagggtgggggctgcaggcagccctgaggctccactcctagaagaattgctggaagcgactttctataagtggctactagcactcagggcctcctcaccgaaatccccccttcctgccaccaactgctgggcaacaatggcatctgtgggacattggtacaaaaatagaaacgcggtctcccgcccacccactcagggagggggctgggtaggcgcaggctggccgggctgggggtgaggggctggccagactgcggaattcccagggtcccatgaggaaggctgggagcttggggttgggggcaaggctggcgccatcgttttttgcctctggggcccccggccgggagagaagggggaagtcggtgtgcgtgtgagtggccgtggcggtgagtcagggccgtggggagggaaatgtttgctgtagaaaccctgactgggtttttctggtaaccagctgtttttcagcttggccctgcagctcagagaacctgagcacccagctttccagcccccctgagtttcccaactactcacttgcccccacctcctacctgccctcaagcctgcagggaaggacttggtgacaactgagtggtagctttggttcgtgagctctgggatgagagctgagtgtcccaagaaacattccgaagttccagcctcctcgtcacccctcacagacagcatgaccaggctgtgacctgcacttcccttttttttcacttcctttatccatagcccaacctggtactggttcccaaccctgtcctacccccatttcacagatgaggaaactgaggcatagaggaacagggacagtggcggagcagcagtaggactggatggccatggggctccttcatccccactcagggcttggccaccagactgcactctggcttctgcagcatgcttggcctgtgggtgtcaccatgggatggcggatggatgtcctcatgcaccacaggctgtgctgtgtcctggccatgatctgactatccagagggcccatctcttcatcgtgtgggccttgcaattctttcctccaggttgggacaagcagatggggccgcacagcaatggactgtagggcaatctgggagagaggtgcagttgagagggaggacatggtccagggaatgcaggccccgctctggcaccacgcccagcctagaaagcgtaatatttttaaaaactgccaggcatggtggctcacgcctgtaatcccagcactttgggaggccgaggtgggtggattgtttgagtctaggagttcaacaccagcctgggcaacatagtgaaaccccatctctacaaaaaatataaaaattagccaggcatactggtgtatgcctgtagtcccagctacttgggaggctaaggcgggaggatcacttgagcctgaggggcggaagttgcagtgagcaatcacgccactgtactccagcctgggcaacagagggagaccctgtcttaaaagaaaaaaattatatatatatatattttattcaaaactgatgaaacaatatattttgaaaaccaaaagttataaacccactagaaaacattaatcaaaacatgaacttatacaaacataaatttgaaacatatcttatcccataaattagcataaaataattatttaaaaataaccaacctaactgggcgcagtggctcacacctataatcccagcactttgggaggctgaggcaggcagatcacaggtcaagagattaagaccattgtggccaaaaaggtgaaaccccatctccactaaaaatacaaaaattaggctgggcgtggtggcacacgcttataatcccagcactttgggaggctgaggcgtagggatcatgaggtcaggagttcgagaccagcctggccaagatggtgaaaccccatctctactaaaaatacaaaaactagccaggcgcagtggcaggtgcctgtaatcccagttactcaggagtctgaggcaggagaattgcttgaacccaggaggtggaggttgcggtgagcagagatcgctgtactttagcctgggcaacagagcaagactccatctcaaaaaaagaaaaaattacaaaaattagttgggcatggtggcgcacacctgtagtcccagctgctcgggaggctgaggcaggagaatcgcttgaacccgggaggtggaggttgcggtgagcagagatcgctgcactctagcctaggcgacagagcaagactccatctcaaaaatatatatatacaaaaattagctgggcatggtggcgcacgcctgtagtcccagctacttgggaggctgaggcaggacaattgcttgaacccaggaggcggaggtggcagtgagccgagatcatgccattgcactccagcctggcaacagggcaagactccatctcaaaaaacaataataaatagaaaaaaactaaatggcacactaaaatgaaaaaaaaaattgtgtttacaactaattgatcacaaccagttacagattgctttgttccttctccacactcactgcttcacttgaggagcctaaaaaaaggaaacaaaatatttgtgacacattgaaaatgaaatactattatttgttctttttgtgttttaaagaggaaacttaaaagcaaagagtaattatggtatcattattgagtaacagaaatatttctgggcagatttttccagtggctgaaacactgtctctggctttgtgacgtcagttggggaaatggcaagatgattaaaagttaaatctcaaaactttccactggtgtcttcatcttgaaatagccttcccctttttcataactttgaaaagagcttttggatcatcttttagactggcagcttttgtatgagagcactgggagtctgtgtttcagcaaattacatttgtctttgtcctcctgagttggtggcagggcttctgaggcatttacctgtcttttttttttttttttttttttttgaggcggagtttcactcttgctgcccaggctagagctcaatggcgcgatcttggctcaccacaacctccgcctcctggggttcaagcgattctcctgcctcagcctcccgagtagctgggattacaggcatgcgccaccacacctggctaatttagtatttttagtagagacggggtttctccacgttggtcaggttggtcttgaactcccaacctcaggtgatcggctcacctcagcctcccaaagtgctgggattacaggcgtaagccaccacgcctggtctacctgtcttagtctcagcactcacctgttcacatgccactagttcagaaagtctttgaggtcattctttcaatagacactggcttgtagattgctgtgttctttttcttcttgggaataaggttagaaaaatgtgctagggaaggatgtgctacacaaaaatgtgtggaaaaatgtgagagcggccgggtgcagtggctcacgcctataatcctagcactttgggaggccaaggcgggtggatcacctgaggtcaggagtttgagcccatcctggccaacatggcgaaaccccatctttactaaaaatacaaaaattagctgggcatggtggcatgcacctgtagtcccagctacttgggaggctaaggcaggagaatcacttgaacccaggaggtggaggttgcagtgagccgagatcgcgccattgcattccagcctggcaacagagcaagactccatctcaaaaaataataataaatagaaaaaaactaaatggcacactaaaatgaaaaaaacaattgtgtttacaagtaattgatcacaactagttacagattgctttgttccttctccactctcattgcttcacttgacgagcctaaaaaaaagaaacagtgagctaggatcgcaccattggggtttcaccatgttgatgaggctggtctcgcactccagcctgggcaggaagagtgaaactccatctcagaaaaaaaaaaaaagtgaaaagaaaagaaaaatgtgagagcacaggcctacctgggcacgaatcccagcccctggctgacttcctgtgtcatcaaaggcaaatgacttcacctctcagggtcttggttccctcatctgtaagtgaaaataagaatagtggccgggtgcagtggctcatgcctgtaattccagcactttgggaggccgaggcgggcagatcatttgaggtcaagagtttgagaccagtctggccaacatgctgaaaccccatctctactaaaaatacaaaaattagccaggcatggtggcaatcgcctgtagtcccagctactcaggatgctgaggcaggagaattgcttgacccaggaggcagaggttgcagtgagccgaggttgtgccactgcaatccagcctgggcaacagagcaagactctgtctcaaaaaaaaaaaaaaaaaaaaaaaagaatggtagctcatgtctgtaattccagcactttgggaagccgaggtgggaggattgcttgagcctaggaggttgaggctgcagtgagccatgattgcaccactgcactctagcctggaaaagagagtaagaccctgtctcaaaaaacaaacaaagaaaagccagcctggccaacatagtgaaaccccatctctattaaaaatataaaaaattaatctggtgtggtggcacacgcctgtagtcctagctactcaggaggctgaggcaggagaattgcttgaacccaggaggcagaggttgtagtgagctgagattgtgccactgggttccagcctgggtgacagagcaagaccctgtctcaaaagaaagaaaaaaaaaaaaaaaaggccaggcagggtggttcacacctgtaatcccagcactttgggaggccgaggcaggtggatcacaaggtcagagttcgagaccagcctgaccaacatggtgaaaccccgtctctactaaaaatacaaaacttagccaggcatggtagtgggcgcctatagtcccagctactcgggaggctgaggcaggagaatgaattgaacctggtacgcgaaggttgcagtgagccaagatcgccccattgcactccagcttgggcgacagagcgagactccgcctcaaagaaaaaaaaagaaaaaaaaaaaaagccaacctggccaacatggtgaaactccatctctagtaaaaatacaaaaaattagccatgcgtcgtggtgggcacctgcagttccagctactcgggaggctgaggcaggagaattgcttgaacctgggaggcagaggttgcagtgagccgagatcacatcactgcactccagtctggacaacagagggagactctgtctctaaaaaaaaaaaaaaaaaatggtatttacgtcttaaggttgttgaaaggattaaatgagttaatgtgtaaagcacttagaacactgctgggatttaataggccctatttacgtggtaggtaggtattgctgttgttataaaaacattctaaatgtatacatcattgaacaattaaaaattttaatgcagtgggtacgtctcaagacataaatgatttcaacttcacattcttatatcaaaataatggcattataccaaaacaaccccccaggattttagtactttaaaacggtaagacaagcaggaatattgcaaactgggagagcaattgtgactgtctcatgtgggctggaagcagagctgtcactcagggactgcaggaaaggtggtggggacgatggggcaggggatcgctgcctccatgcacaggacactccctaaggcccagtacacaacaggttctcatttgatccttgatggatgaagttcaggctcatcccttttttttgtttgttttttgtttttttttttgagacggagcgtcattcttgttgcccaggctggagtgcaatagcgcaatctcagctcactgcaacctctacctcctgggttcaagagattctcctgcctcagcctcccaagtagttggaattacaggcatccaccaccaccccacctggctaattttttgtatttttagtaaagacggggtttcaccatgttggacagactagtctcgaactcctgacctcaggtgatccacctgcctcagcctcccagagtgctgggattacaggtgtgaaccaccatgcccggccttttttttttttttttttttagatggagtctcactctgttgcccaggctagaatgcagtggtgccatctcagctcaatgccacctctgcccccagggttcaagcaattcttgtgtctcagcctccccagtggctgagattataggcacccaccaccacgcctggctaatttttgtatttttagtacagatggggtttcaccatgttggtcaggctggtctccaactcctgacctcaggtgatccgcccacctcagcctcccaaagtattgggattacagacgtgagccaccgtgcccagcctaattttttttctctcttcagatttgccgggcttacctccttcatttgtttattgtgaattccctgaggatggccagagggacaggcactaccctgggcactgggaggtgagggtggacagagcaggcagggagagtggagtggaagcatccaaatcatcactgcctgtctgggtggcacaacctatacaaatctgactggactgtgtgtgtctctcctctgtgtcccccagggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacgtgagtgtgttccctccaaccccaggctgaggctctggccatgggaggtccctactgtccatctctgtgggtcagggtctcccaccccagcggcccagccctgcttctccctttcatcttgacattattcaccagggtcctgcctggtgaagccaatggtctctaccagagagaacccagagggcaccaggactacagtaaagagtctagaccaagaggtgggagtcaggttgatgtgcagccctggccaactctgatcctctgcataggctcagtttgcctctctgtccagtgggacaactgaactcaatattttatatgataatcttttcattgtctttgaaaaagttacacgacatatatttgaaaatatttaaagacagaggaaaagggccaggagaaaacctaacgtgttaacagtggttatggctgggaagtgggattaggagagacatttagttggttcttcacactttgttgagtttgcaagagttgctctaaatggatttggcctattttggagaaaaaagtatttttaaaaaactcaagttttcaggtcagctgtggatttgggaaaaacaattaaaaacaaacaaccaaaagcctcaacttttaaaagtgttagctatatccaccagagagaggaggtcagggagctgggacccactgccagaggtcagggctggaggaggcagggtggcttgccagcactgcctcctccatgaggaatgtctgggaggtggcccccagatgtgagcagctgttgtttacaacagagaaagcagagggtaggaaggggagagcccgggggagagcaaagatagcaaaggggagagaggcatagaaagaaacatgcccactgcgggagggaggcaggcttgagcgaagttgggcgtgggggacaggggagaagcttccggactggtgacagggacagcacagagacagtcagacatgaccaagccagcatgccaaagtcctaggagggagggggccaaatccaaccaccagggccaagaggatttgactccttgcagcccatccctcggccgcccagaaggggaatcgaggtcccagagggggcgtggcctttaccatggatcctcccccttcccgatctgagtccgtgcagcccagggtgaggcaggaacatgaaacgcgcccgccagccggaaggtcgcagtagccgccggctctggcctcggccgcgccgccttcctcctggggccgcgctgcttcccgagcgggctccctggggccggtggccagaggggacaaagaggccaaggcgcggcctcggtggccgacccagtgccaggcgaccaacagacgtcgtgccctgctgtatccccattttacaggggctgactcaaggatcagatccctttcccaacccagctgtaaagccagtgtcccagccctttcccattccgcgggctgggttcctcacccaagatgcccatcactttgcccccttgttgaatccctacagagaaggtatctacttccttctagatgggccattctagggtgtcttgtctactgttgccatctggcagtcctcaatatctagcttgggccaggcgacctggcttatgtctgtaatcccaacactttggtaagccgaggcaggagggtctcctttttttttttttttttttttttttgagatggagtttcactcttgttgcccaggctggagtgcaatggccccatctcgcctcactgcaaccttcgccttctgggttcaagtaattctcctgcctcagcctcccgagtagctgggattacaggcacctgccaccacccccacctcattttttgtatttttagtagagacagtgtttcataccgtgttggctaggctggtctcgaactcctgacctcaggggatccacccgcctcggcctcccaaagtgctggtttacaggcgtgagccactgtgcctggccaggagggtctcttgaggccaggagttggagaccagcctgggcaacatagtgagaccctcgtctctaaaaaattataataaaaaatatttttaaatccaacccgaagcccttttgcccttctgctgctgctgtttcattcagctcaatgcccttggctttggagactgtacactaagagctcagtcagtggccccaacagcttcctctgaatccttcagctttccagagtcactcttccaggaagtcttccctgtctgctttcctcctcacccccaacccccatttcttctgaggcaatggcagggtaggcagtgagatgctgaagccacccagactccccatccctgtccaaccaggagatctgtctggctcctttgtttcttattaaataaaattctgtcttctattgtttcaaatgacttgatgcatgtctagtttctgaatggtaatatcccctagggcagggaccactgatatctgtctttaattcattaattcattcatccatccctttcttctttcttccctttctccctgtcttcccataggcggggagcacccatcacatgctgggtgtcagggtgacgctggcatgtcaggatcctgtgatgggcccagggcccagcacaaagtcagacaaatctctctcagtgcgtactacgtgtcaagcactgtgcaaggatgggcaaggtagacgttgccccctgtagaccctcacagtgtagggagatccagagcctcagggtatagggagagacagccgcaggatggcgtagatgtgggttgaatgagaacagctctggaggggtgggtgatgtttggacaggtggatgaacaaggtggtgtgttcatctggccccccaggtatgcaagggagaaggggctgatctgactgctagggggctccgggctgactgcagatccaccagccagcattctcagctccggcctctttctctcagccaatgggctgactccacaaattacttcctgacctcctacatgggatagagagggcacagggccaggaacagcgtgctgagcctccacatgtctccccagaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaaggtcagtttccccagcaacctctctgggctcatgatactgctcaggaggaatctgagctcctctggcccacacctcaaacttgggcaccaagagtgcaggaggggacacgctgtgccacagttcacatgccacaagccagtgctgccttgggacagtgatggctcctccaccaaatatcagattgaagcatgtggaatatgccaggttctgacctaaaaccccagcattttcatacgatctattgtgcatctactatgtgccaaagccctatcatgctaggcacttggggacacactcaggccctgccttcctggagctgatactgtgatgagggaggtgacaataaacatgtacatgtacacagataaatctataatttcgggtcttgctgggtggtttcggggctgcagcctaacatgtgtcatgggctcatcccttatgttaacacacggaggcccggggacttgcacagggtcacttggcaggtgagtggtggaagggaagttcgaacctaggtcctctgacgcctctccccctctgcagcaccgtcctgcctgccccaccactatctttggctgtgggtgagggcggggctctgttaggtgcagggctgctgagggaagggactgaggtgcgcgtgtctctgcagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggtatggctctcgccccgcccctgacactagtccccaccccgagagaccaccccccctgacccccccccgccccctctccggtcccttataaagccccaccccagtcccagccccagccccgccgcagccctgtgagagcacagtcgctttctcctactctaggctacgccccctatgggccccttccctttgggcacaagcctggccccagtcccatccctatcccataaacccacacctggccaggtaagagtgcagccgccgcccacccgacgccaggcctcgctccccgcctggcctgtccgcttcagtgttccatccgcgtctgtctccccgcaggccccggacggtgacggtgaaggtggaactgagctgcgcacccggggatctcgatgccgtcctcatcctgcagggtcccccctacgtgtcctggctcatcgacgccaaccacaacatgcagatctgggtgagttgtgcgcagctcccgggacacaaaacccaaactcccaacctctggatcagggaagtttcctggaaaggtgaacccccgagctgagctgaaggacaaatcacctatgcccatacgtgagggaaggggccaggcagaagacgcagcaggagtggggacacagcaggaccgaggcctggcataaccctggctggcctgctgtggcacagactgtgtccatggccccctgttctgcctctctccccaccattagaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtgagcacccttcccctgcccctcccttcccttcccctcccttggatcagtggccacactgttggtgaagcacctctgtgtgagcttgggcaaggtacatcagcctctctgagcctcatttttctcatctgcacatgggaacaatgggagtagctaatcatagaagagcctgagaatcgcttgaacctgggagatggaggttgcagtgagccaagatcgtgccactgcactccagcccgggtaacagagcaaaactccgtctcaaaaaaaaaaaaaaaaaaaaaaaaagcctggtgcgggcacacagtgatcacacagtgaccagccgcctggcctgcctctgctaccccacaggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcggtaagggaactcctgcccctctggctcaggatgacatggacatctggttcctcccctagcccaagactcttggggtcctagcccaggcaggggggcaagtcacgtccctctgcaagccttagttttcccacttgtataatggaattgataatggtacctaccacgtggtgagaattaaaggcagtctgacaggccaatcacgtggcacagtaagatgtggtacatagtaagtgcttagtaaataatgccagcactaggtagttgtcattattaatcctaaatgctccctgagctggctggtcacttagcagaatacctacacaggccaggcatggtggttcacgcctgtaatctcagcactttgggaggccaagatgggtggatcacttgaggtcaggagtttgagaccagcctggccaacatggtgaaaccctgtctttactaaaatacaaaaattagccagaggtgatgggacacacctgtagtcgcagctacttgggaggctgaggaacaagaatcgcttgaacccaggaggcagaggctgcagtgagccgagatcacaccactaaacttcagcctgggcaacagagtgagactctgtctcagaaaaaaaaaaaaaaaaaaaaaaaagccggtgcctgtaatcccagcactttgggaggccgaggcgggtggatcacaaggtcaggagatcgagaccatcctggctaacacagtgaaaccctgtccctactaaaaatacaaaaaattaaccgggtgtggtggcaggcgcctgtagtcccagctaatcgggaggctgaggcaggagaatggtgtgaacccgggaggcagagcttgcagtgagctgagatcgcaccactgtactccagcttgggtgacagagagagactccatctcaaagaaaaaaaaaaaagcctatacaatatgatcactgcctggttgacaaacaaatatatttgttataaaaataacacatggtgaatacaaaatattagccaggcatggtggtaggcgcctgtagtcccagctacttgggaggctgaggcaggagaatggcctgaacccgggaggcggagcttgcagtgagccaagatcatgccactgcactccagcctgggcaacagagcaagactcgtctcaaaataaaatgaaagaacacatgctggccaggcacagtggctcacacctgtaaccctagcactttggaggccgaggcaggcagattgccggagctcaagagtttgagaccagcctgggcaacacggtgaaaccctgtctctactaaaatagaaaaaattagccggacgtggtggtgcacgcctgtagtcccagctactcaggaggctgaggcaggagaatcgcttgaacccggtagagggagattgcagtgagctgagattgtgccactgcactccagcctgggcgacagagcgagactccatttcaaacaaacaaacaaaaaacatgctttaaaaaatatgtgaaaattagaaaatcttaaccttctgacacaaagacaatggctgccaacattttggtgtgcttctttctagagcgttttctctgtgtatttcttatattgatgtaatcataagagatgtgttcatttgtctcttactatttcacttaatgtatttttagagctttgacagctgtacctaatatcatgtttaataagcacatattattccatcatattgacatgctataattaactcctcttcccttgttacacatttaggttgttcccaattctgtagtattataaatatgcaaaaaatgtcattgtgcatgaaacatttctttatataggattattttctcaggatagatttccacattagtggaattactgggtcaaaatgaatgaagtttcaatacatgttgccaacccactttcccaaagatgatttgaattttcaccactgatttacgagaacacctcaacctcttcgctgtctccagactataattcaaaaaaagagaaacctttgccagtgtgggaagaggcacatggcgttccattcttgttttagttgtaattctctggttagtagtgagtgtgggcatggttccacgtgagtgatgagaacctcagtctccttatcattgaggcttggtatttttcttgatgatttttataagttttaataaagaaaaaaaggttgcccctttggccaccacttcccttgatttgctgtaattctttcaattttggctacagtggtttttcttttcttttctttttttttctttgagacagtcttgctctgtcacccaggctggagttcagtggtacaatctcggctcactgcaacctccacctcccgggttcaagtgattctcctgcctcagcctcctgagtagttgggaatacaggcgtgcaccaccacgcctggcttttttttttttttttttttttaagacagtctcacactattgcccgggctggagtacaatggcacaatctcggctcactgaaacctctgcctcccgggttcaagcaattctcctgcctcagcctcccgagtagctgggattacaggtgcccaccaccactcttggcttattttttgtatttttttttttttagcagagacggggtttcactatgttggtcaggctggtctcgaactcctgaccttgtgatccgcccacctcggcctcccaaagtgctgggattacaggtgtgaaatcaggcgcctggtccgcagcctagctacttttttgtatttttagtagagacagggtttcaccatattggccaggctggtctcgaacttccgacctcaggtcatctgcctacctcagcctcccaaagtgcggggattacaggcgtgagccactgcaactggccttctttttcttgttttagagacgaggtctcgctctgtcaccaaggctggagtgcaatgatgtgatctcggctcactgcagcctcctcctctcaggttcaagcgattcttgtgcctcagccttcccagtagctgggactatgggtgtctgccaccacacctggctaatttttataattttagtagagtcgggtttcactatgttggctaggcaggtctcgaacttctggcctcctgtgatctgcctgcctctgcctaccaaagtgctgggattacaggcgtgagccaccacgcccagcctgtgctagacttttatatgaccggcagtgcaataagtttgcttacaccagcatcaccacaaacactaggcaatagaaatttttcagcttcgttataattttatgggaccagggaccaccatcatatacacagtccatcaccgaccacaacattgtcccatggtgcatgacagtatttactatctggctctttataggaacacttcgcccacgccaggcctgagactggattatgcttgcagggtttgcatgcccttggggctgtgagtgatgattatatgtggaacttgaaggaatatatatatatatattttttttttttgagacggagtctcgctctgttgcccaggctggagtgcaatggtgcgatctcggctcactgcaaactccgcctcccgggctcacgccattttcctgcctcagcctcccgagtagctgggactacgggagcccgccaccacgcccggctaatttttttgtatttttagtagagacggggtttcatcatgttagccaggatggtctcgatctcctgacctcatgatccacctgcctcagcctcccaaagtgctgggattacaggcgtgagccaccgtacccggcctgaaggaatatttttaatagttctgtatttattttgatagatataagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctatctctactaaaaatacaaaaaagtagccgggcatggtggcacgtgcctgtaatcccagcaactcaggaggccaaggcaggagaatcgcttgaacccaggaggtggaggttgtagtgagccaagatcgagccactgcacctgggcaaaaagagtgagactccatctcaaaaaaaagaacttttaagtggtgtaggatgatgacatctaacaaaaatgaagagggagcagggcaggggaatggctgtgacttgggacccctgggttgtggtcagtccttggtgctggggtgtggcaggccacagagaccccagtgcctcctgatggtgcccctctcttccgacccagcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggtaagagctggggccaaaaaggtatcaggaccagcctggttggtgccccctcaggtgccctccctgatcccccagggtggaggtgtgtttgggagagcaggctgcaggggctcagaacacaagacaagcttggccattggttggcttagtctccccatctgcaaaaatgggcgtattgggtgggataccctctggggtcctttctggctctgaccagctccctggctttatccccgcaggcggtggtcaatatcctgtcgagctcatcaccacagcgggtgagatggacagtcacgtgctaacccacctggcccaggggctgctgctgggccggggcctcttcctggcctgggagggagcaggcctcgggaaactcctggcaagccatgtgtgtctggaatgcctcggtctccccttctgtatgaccggagcaggactgctgagggtgacgctctcggtctctcaagtcagagggcttagcacatactggctgtgtggccttgggcaagtcactttagttttctgggcccaaaggtggcctaagaaaggactctgcgccacagggtgcttctgggcagccaatgaggtgctgtgtggaagctcttcacacagcctggcagctggtgcctccttgataaatattagtttaaaaaaaaaaaaaagggccgggcgcagtggctcacgcctgtaatcgcagcactttgggaggccgaggcgggcagatcacgaggtgaagagattgagaccatcctggctaacatggtgaaaccccgtatctactaaaaatacaaaaaattagccgggcgtggtggcgggcacctgtaatcccagctacttgggaggctgaggtaggagaatggcatgaacccgggaggcggagcttgcagtgagctgagatcgcaccactgcactccagcctgggcgacagagcgagactccgtctcaaaaaaaaaaaaaaagagagtcaggcaactccacagggccatgatgcctgttcctccccacacccctcgccctcctggctggcgccgccagattgaccaagtctccctcccgtcctcccccagaaaaaggtgcactgcctcaacatggacagcctctctttccagctgggcctctacctcagcccacacttcctccaggcctccaacaccatcgagccggggcagcagagctttgtgcaggtacctggcatgcctgtcacccctcgggcctcccagctcctggaacttcctctccgcctttcttcccaccatgactccagaggagatgagactcccagagtcaggagggagacagcctgggtgcacgggagagggagagacagagaaggcattgctcagggacactgacaaggatgtggccctgtcctcctcctctgccccagacaggtccatgtctttctttccactgtgaggactcaggggtgggaactcttaattctagccgatatttgaaggcagcaggtggggtggggtgaagagcagctgcccatgccgcgtggccctacctacccatgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggtgagtggggcctgggccggccccagcttcaagtgggagcttccaggtctgtggtttgcaggaagggacatggcagcccacagggatgtggggccagctggtgaggggcggagccttaatcaggcatgtggcctggcagtctggctgccagcagcactttctgccacccgagagctttctggtgggactgctgtgtctggggcactggcagactatgcagctgccactgtccatctatccatccatccatcctttcacttacccgtccgtccatccatccatccaccctcccacccaggaatctaaccacccgcacatccatgtagtatggtcaccagtgtaatctcaaagaacaggagacctgagggaagagaggcggacaaaggacacacactcctggctttctgtatttgccagtcacaacacttcaccatctggtgacccccactctcaggcaatctatcctggacgcccccagagtcacccccaggcccttgcacagacaggcctccaggattacaaacttctctggtcataggaagctagggaagccttcaactcccctaagtgggcctctccctccagccagagtgagcctgggactctgggctgacctggctcatagctccaaagtgttcacaagggtgagggatgcatagtgcttccacagtgctcctgggcatcaaggcctccaggaactcacaggaaacatttcagcagcagccagggatcgtccactaggcaccctcccacagcacagatcttccaggactcacccagaggcatccagctacgaagcggtggagatgggattcaaagccaaggctctagggtgggctggggtcacggagccagggagtaaacctggaagccgcctcccaaaggtgccacatactgctctctctttctcctccaggaagtccataggactgtcttcatgcgcttgaacatcatcagccctgacctgtctggtgagctccctccaggtctctcgggtttgttctagtggctgaggtcacagtagggcacagcgggcagccctgagaaacggcctgggcacatagcacatggcaagggggaccccagagaaagcggcccagaaggggcaggaggagggcttcccagagccatagcagcctagagcaggggccagagctgcactttgcagatggagagcccttgcccgggaccgccctgtggggtgggagtctaggcctctgcccccactcacggctccactccatccccacagttattggctgaccttgctgggaggatggagtctcctgggtgagacagaggccctttgagggtgggtgctggccttgccttccttgaggcctctccctgcaggacgccccctctagcctctccatcagttccccccaggcccaggcccacaccaggcagaagagtcccgacactggtggcagaggcaggggtgagggatgggggcacctacctctttgccaccccatccaggccaggatggagcctccactcccagcccaggaccaagaaggcagggctgataaccccatgacacagaatcggatgtcagaggctcaaggaaagactgcttggcccatagccacacaggagtcaggaatgtggagggaatgaggcttggagcaatccaagagcagagctgcagggcactcggagctgctctggcccattctctacctgctaaaggcctcagagaggggcagggttgacccaaggtcatgcagcaggtggggcaggctctgtactcccgagcctcagtttcctcacgttaccccatccatcctccctgaaaacgccatctccatcagccttgaggggcagaggcatgacccaaaaggcctggctgggccctctaggtggacagtcctagcaaccatggctcaatgccaggcctggctgtgatgagcccgtttgctgcaagaggagactgaggttcagagaagtcgagggtccatggctgagcagagctggcaccaaagcccacacgggccagcacaacagggtaggggatggggcaggggcagagtggcagtgctgatggcgtcggccctctctaggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggccaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaaccagtgatgggttgggctgggagaagggcagtgacattcaaagccagggtggggtgagggcacaggacagggctgcttttgtagttggcccccactgggctggcctggtggcaggggtggcatcctgaacagtagcagcatccagggcacagcaggttttcattcagccagttcccctctgccattcacccactcgacagcacaccccagggtctaggctgcaagaaagcaaacaccaggaggccccatccacactctcactctggggttccgaacacaggccctcgactgctctaagttcaaatcctggacctgccaccttgttggcctgtgactgtaggcaggtcccatggcttttttttttttgagatggagtcttgctctgtcgcccaggctggagtacagtggcactatctatctatctcagctcactgcaacctctgcctcccaggttcaagcaattgtcctgcctcagcctcccgagtagctgggactacaggcatgcgccaccacgtccagctaacaatttttgtatttttagcagagacggggtttcaccatgttggccagatggtctcgacctcttgacctcatgatccgcccgcctcagcctcccaaagtgctgggattacaggcgtgagccaccgtgcccggcctccatggcttcttgaaaccagccacagttccctcgtctgtcaaatgggtataattctccatcacaaggtctctgcaagggggtctgcagaaagcactgcctggcatatggtgaacaggcttcagtctggtcttcttctcatctcacagacaggccacctgaggcgcacagggagggagggacttgttccaggccacacagccaggctccctctacacagtgcaggtccctgaccaccagcagcccctccctccgtctctgctgagggagcagggggtcaagggtcagtcgaaggctttgccatttctttaaaaaacaaaggctttaattcactccagccaccctctgtcccgcagtgtcccaggcagaggccctctcccttcccagaaggcactgggaggaggaaatctaccacccagcacatggcaagacccagggcctggccaggcagcgcacacaataagctgggcctgagccaggaggcaggcggggtgttgggggagacaggctgaacggccaggccactgcaacagtgagagacccggggagcccctctgctatctcagccaagaggaaggagagaccaaggcacagagccttaaaaaagacatcctctcccggcctcccatcccaaagccctggcccctaggccagtctagacagaaccaggaaagccaaaaacaaaaggcacctagtatgtaagttcatggggagaacgcaggcaggtgtgggaagctcccacctccaaccccgggccttggctactgggacagtgcgggctccagcagcttcaggacaccacccaccaggtgcaggctgccagtgactagcacatggatggcagcagcctcacggagtatgctggccccactgtgagccacagggtgggtgaggaggccctttgggggactaggtggctggaagatggggtctcggccttggctgatccattgcaaggcatgtgaaatgcagctgaagacgagggagctggcactgcaggtgtggggtgggtggggcgccagaagcagggatgcggacccaccgggctctgggctgggggcactccagaggtccgggctggcctgctcttcgtccaggtggttccagtgctgctggtgttccaggcagcggagcaggacctggtccagtgtcactgtgaagttctgttggtctgtggggcacagagaaaggcctatcagcgaaggggagagggagtaagggacaggggtggagaaaggggcgggtgcaccgtgagcacctgcttcgcaccaagccttttacgtcatcaggccagcagtctcggctagtggccttctccatgcacacagtgaagaaactgaggctcaggc

SEQ ID NO: 17579 - DNA, 7736 bp, Human
acctccacctcctgggttcaagcaattctcctgcctcagcctcccaagtagctgggactacaggcgcccaataccacgcctggctaatttttgtctttttagtagagacggggtttcaacatattggccaggctggctccaactcctgaccttgtgatccgcctgccttggtctcccaaagtgctgggattacaggcgtgagccaccgcgcccactccaatggcttcttgcaggaagagagggtaacgagagtctgggggagtgtaggatcaggggagcaccgccctgaacgcagaaaggcttggggagacagtagagagatttgcatggccacagcttgaggggtggggtgtgaactggaaagagcctccaatgtcacattcaggttcttcggggacagagaggccagactggggggctaggtctcaggatccacccgcagagggctggagaggagggggcagattgaagcggggcagaggaggcagaaaagacggctttgctggaggctgtccttgggcagagctggagggggaatctgggggccgctggagccaggaagatgcgagggaagggatgggcgcgatgggggagggagatggggggggtgaacggtgagctcgcgcctgcataaggacagcaggcctccccactgctatcctcctggcccaacagcgaatagcgtgagtcaagagaatcccctcactcagacacccaggttcgggtcccaactttgtcgccgtgtgaccttgggcaaatgacctcacctctgagcctcaacgtcttcttctgcaaaatgggttagtgatcctgactatggggctgttgattcaggattcggcgggaacgcccagcacttcctgagtacacaagagtgctgagaaaatggtagctgttttttgcgattactgactcggggcccgaccagctctggcacgactcagcggaggtgggagtcctgcgggtcccatccctgcctcccggagagccagaccccagcgatagaaggcccgggcgttgcttgctcgtcgccgctagtgccgccgcgccccctggcggccgtcggttgccatgtcaacggagggtggcggggaccgggggaggcggaggcgggggccgttctctcctcccagggccggaggacgctccctccgcgcctcccgccttcgcctctgtgggggcactccgagccggggaggaaggggctttccgctgcagccgacatgtgggggtaaactgaggcacgcggcagggcgcccgcagccaggtgccgagcgcggggccccacctccgaaggcggaggaggggccgcgggcggtgacgcgccgagggcggccggcggacagcgagcgggcgggcggtggcggcggcggcaggtgcggccgcggagggtgggagggaggagggcgggggcgggcggaggaggaggggagggcgaggccgggcacctccccctttataacgcgccccctcttgggctctcgggccgtctcctagtcggctcttcccgtctcgccccctcgcccggccgccccgggcccgggtccggccagggagctcccaggccgcggctcgggggctgaccccccgcccgccgccccgcgcagcccggcggaggcggcgccgtcggaggaggaggagcagggcactgcggctggccccggatcgggcgccagagcggcagcagcttcggcagcagcggcggcccgggcccatgcagcgggacgcgccaccccgagccccagctccggcgccccggctccccgcgcccccgatcggggccgccgctagtagtggcggcggcggaggcgggggcagcggcggcggcggcggaggcgcctctgcagctccggctccccctggcctctcgggaactacaagtcccagggggcctggcggtgggcggcgggcggaagaggcggggtcggcgccgcgaggccggaagtggccgtggaggcggaagtggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcgggtaaggctgggcccctcggggccgggagccctgggcctgcacccctagggccgacgtcgggatgcccgggcccccccccgagttggtagagaagtcgtctgtccccgggcttgcctgctggtctctaggccgcgccgcaccccgccccggcctgacggagccggctggtggggaggagcctgaggcccgtggtgggggcggggaggggctgcagagaggcgcccgtgaggggagcgggatctctccaagggacgcccaagtgaggagaagggactgagggaaggaagcagaggctccgaacgagacaggctgccgggtggcggggtagccgcgtgccctgggtacctagcccagccccgcccgggaatctctttgctgctgcccctcctcctgtagtgggggaggggcgggccctgcggaaatggcctgatgagttctcgggtctccctttccgcctgcagggaggtgttcaaggccaggcaccgcaagaccggccagaaggtggctctgaagaaggtgctgatggaaaacgagaaggagggggtgagtacggatcgggcgtgcgggccggccggctaactgcccgggaccccgggtcggttttccaccctgctgcttctgggagtctcaggttgagatttaatttttttgtagtagttcagaaatttccagggaatgtggcttccaccctaaaactaaatgtttcattcttaggcagttatgggtgaggccaggagggggagttgatgcatgcatcgtgtgcactttatttcacgaagttaggaagcctttaaacacctttttttagtgttaaatttcgcttaatgtaaaagaaagattatatatgcatgctttttgaaaggtgtctgatactcaattatttaatgtatttaaaaggagcggtcccttctccaccccatcttagctctagtacaacttcccataaaccttcttttgcgtaatgtgcattagcaaggacatttttaaatcatcatgtttgttgccaacgaaacagccatagagctgaaatttgaagactgaaaccgccgagcatttagtggctaatagcaaagtattgctgtttcagtttgttgtctcaaaccatcatcttgaagtgtgcatgctactaatatccattttatagacaaggcttctgagacagctggtttcagagcccatgatcttgctctgtctcccaacttggctgtcagtacagaccccagggctgggctctgtactgcgctcactcttgaccactttcccctctttctcacccagttccccattacagccttgcgggagatcaagatccttcagcttctaaaacacgagaatgtggtcaacttgattgagatttgtcgaaccaaaggtaagttatttggttcttacgagaagatgacacttgtagcctaaggttttgtttgtaaacttggaactaggcacacctaaactgcctcttcttaactcagatggacccatggtgactgctttttctggtcctctttcatcgtagctggtgcttccttggggcctgccctggcccagaagaggcactcagaaaatatttgaccggtgaaggaaggaacagacagatgctctggagggcatgggtgcccgtgggttggagcaggaagaaagaagctggttgtgggaaagtgtgttgggtgtggttttcttgactttttcttctttctattcctgcctcagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaaggtgggggccagagctgggaggaggacccaggcttgggctggtcttggctcccactcccgggtggatgtcactaaaggacccactcttgcccttcctgcagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggtgaggactcccgagcgggccaaggggggtgagggccaggcatctacctggccccttccccccaactgccagggcttcttgagctgccggccctggggcattgagcctcaggaggccctcgggctcaaggggccctcctggtgcgctcttcttcccaggggagcgggactacggcccccccattgacctgtggggtgctgggtgcatcatggcagagatgtggacccgcagccccatcatgcaggccaacacggagcagcaccaactcgccctcatcagtcagctctgcggctccatcacccctgaggtacggggccccggtccccacggggtgcagagatcgaggtcccccggcagaggaggagtggggagtagaatggaaggagcgctcctctctggaagggaggctggtttggtgacagggcctgtcttggggtggggagtgtgtgggagaaaaaaacacctgacacaggctgtgcgccagtctcggttccatcagctgttctgtggccttgggcagaacatctgagtcagcgctgggtttctcttctgtgaaccagaaatgtgacgtgtatcagggttggagcccatattccaggtgatgtgggtggaaggacctggcacgtggtatgtgccaatccatagcgggcactgcttctgggaggggtcgagtagcagtctgggagcctccgagtggagcaggtattttagtccttttaggcctttatgaagggataagccacgcacctcctgaccggactccatattctctcaacgccccctccctcccaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaatttttttttttttttaatttttttttttcctccaggacttgtgtgttttgttctgcgcacacaccgccaactgttcccccacagtcagcagcaggttgggcctgaccattgggacttgattgtcaagtcactggaggtcttgacttttttatctcagttcatgttctcttccataattggaaaggacctttgtctgtttttcctcttgggtgccttccagaacgcatctcatgtccctggtgagggaattggtgagggcctgctgtgagctgctgtggctgcgatggtcacccagctgggcaaatcactggagtgacaatttgacctgtcacctgagaaggatggtccctcagactgctgggtagagggcctggggcaggctggagagagaaagtgggcagagggtgaagggatcacaggggtcttggaaggtggcagtagtttggacgggggtggggagtatgtgggagaaaaaaacagactgaaggtagaatccttgggaacctttgaggagcggcacattctggcaggcacgttttctgtgagcctgaagttaggaagagacgttctggaggtcaatttcctacatcctcttacaggcggagaccttgaagtggggccaggaaggaaggttggcaaaacctttgaccagaactgtccttcatttacagaaactgacccagaccacaacacaaaaggccagtaaaagtaagaaaaaaaaattttttttttttttttggagacggagtctcactctgctgcccaggctgaagtgcagtggtgagatctcggctcactgcgacttctgcctcccgggttcaagtgattctcctgtctcagcctcctgagtagctgggattaccacccaccaccacacccagctaattgtatgtttagtaaagatggggtttcgcagtcttggccaggctagtctcgaactcctgacctcgggtgatccacccacctcagcctcccaaagtgctgggattacaggtgtgagccactgtgtccagccaaggaaaaaattcttgattggtgtatttgttttcctgagacttctataactaattgctacaagcatgctagtttaaattaacagatttattctgttggttcccaaagtcattggtggcagggttggttccttctggaggatctgagggagagagaatccttcccgtgactcctggtggctgctggcagtccttgcatcccttaggcttgtagagtcgtcactccggtctctgcctgtgttcacatggcattcttcactctgtctcttttttttttgagatggagtttcactcttgttgaccaagctggagtgcaatggcatgatcttggctcactgcaacctccgcttcctgggttcaagtgattcacctgcctcagcctccctagtaggtgagattacaggcgcctgccaccacgcctggctaatttttgtatttttagtagagacggggtttcaccatgttggccaggctggtctcgagctcctgacctcaggtgatccacctgcctcggcctcccaaagtgctgggattacaggcatgagccaccacgcccggcctatgtgtctgtcttgtatggacaccagtctggatttaggggccaccctaacccagtttgacctcatcttaaccgattacatctgcaaagaccctctttccaaataaggtcacattctgaggtttggagaggacatgaattcggggggcacacttcaacccagtataagtagtcaa

SEQ ID NO: 17580 - DNA, 12250 bp, Human
tcgaggccacttctcagggcttcactgtggttgtccctggcccaggacgctccccctcccatgggcagctgctgaggggcacttggcagctcctacccccgctgaagcacactcagcaggaaaagtggctgccactcctgcctggggcagcaggggcatcagcaaagccacttcagctgctactgggtgccaggcccagcgtagcagaaactcagggccgagttggaccctagctggccctcgaaccagtctgtcctcctccccatgcctcagtttcctcccaagatggcagtgaggatggaacgaggctccccagccctgtgctcagcccatgccaggcccagtcaatgggatcccaggcccgcagcacagaagaggggcccagtacagcgtggttgtgcagtgcagggcaggtttccaggaggcacctgccagtgtgggagtggagggcagagtccaggaaggcttcctgaaggaggtggcacctgagctgagtcccacacaatagcaaggtggggaaaggcatccaggcattgggtacaacatctgccagtggcagctgatagggttgcagagggcagcagaggtcagctcaccgggacctatccactatgtcaaggggcccaggctttgtctgggagccgagagggccacacatgcaaggttgtaagcgggtgtgtgatgtggtctgatacttgccagagaaaatcctgcaaattgcgtggcagggtgtggaggcttcaaggcccatgtggaggcgggggcagtggcccaggccccttacttagcacaggacatagtggtgaggagacagacggagagagcctggggaggggagggttgggcagtgggtgtgcagggctgtggagaggagagaggagccttcacactgactcagcctgtggcttggccataggggcctggagctgggacttggggagggctgttcagagcctgagaagcctgtggggcttctggggcctgtctcgggggcatggatgtctggggctggagagaaaggcctgggctgcctgcacagggatgggggtccttggagcctgaagccaagtagagagggtggtgtgggtgccttgggtggaggtcccggtgcgggtggggtcgctggctggaggtcaaggctggaggggagtgtggctgtggtggttgcgagtggccttggggagggctggtggctgggagtgaagaagtggaggccaaaggtgtccagagggcagttctgagataggggggcgaggtaggggaggtcctgggggctgtggcagcacagggtggggtcgcaggtgtgattgggctcatgggcaggctgagggcaaggtgggggcagtaaagccaggtcctcaaagggtgggggtgcaggggacatgcgtggggctggttgttgggcctgtagaggtgaagagcctgggaccgcctcactttgacaactgtaaagggctgtgttcatgcgagcggctcctgtagattccttcaccccaggcctctgtcccttagaggatccccatccaaacctcatcccagacacacatagttcctggccacctcccacctcctggcagcttccctctggccctggggagcgttgtcaaggtgtctgggcagacgctggccccgcgccctgttttctgggagtttcgaggggagcagctctgcagttgtgtggccgctgtttatgtccctcgtgccatcctcactgtcccagcccctccagcgggaacccaggtggatgggagggggctactgcccttctgtgacaggtgaggccatggaggccagagaggaaaggtgacttttccaaggtcactttcccaaggtggctttctcagggaaggggtcctgggccttccctgcccccagcagccccctctgccctcagactgcatgtcgggcctggcacacaccagttgccttgggtgtggcttagtggaaggtgagtcagggtgaggaggaaaatccctccccaacctgtgcccttgtcttacagagcactgacacggctcccgggacctcggcaggatggaaggtatgagcctcctctccttttgcccattgcctgggcctcagtgtgcctgactattaagggggtgcgctctcagggagacattctgggaggggttggaggaggctctggggctgccggagggggcctggctgggagcctccagtatcctcctctggcctctcacgggatgtgccagctccaagattaattttagacgtgacgaggcctccccaaggctcctgagggccccagcgcacaccccctatgctgggtttatagagctgagaccctgccccatggagaggccacagatacacaaaacaccaggtctaatgaggacaaggcaattccccgtacctctccgggactcagtttccctatcatccagtgagggtgggccttgaggaagtcttggaccctcctagttcctatgggctgggacttagagggagacacgggcaggcagagagtccagaacgggcccgccctcagctgctggcagcaccatccgtccagttcctggcactgtgccttggcctgggcagctcttaaagacacccagcgggcctgctgctgctgctgctgctgctctgcctgagctccaaatatcaacagccatagggctgcggccactgcacccccgggataggggcccacaggaggagcccttcttgacagctcctgtagggctccagccttatggctgggagggcccctgggagccgcccagcccacctcctccctggggaaggggcagagaaccagagaggggcaggcctttcctaagtcacacagcaaggtgggatacagcctggtcctctatttccctgggaagcgggggagcctgaaagcccagtggggagcttgggttctggttttggttctgacatcccttgagcaggccttccctctctcgagctcagtttccctctgcccagtggggctgtggccttgctgggatctaacagcaggcaggacgagacagaggttggagccaagctcaccgccctctctgggcaagagttccacatgcccaccacagccctccaccccggcaactgtctccatggcaacatatgttgtggttgctaagcccccactgccgggggaggcgggtgatgggccggcccagggcctgagaggggaagggcagggtgcacaggagacacggcaggacgggaccatgggctgctgctcctcgagtgacccccgcagagaagacgatctgagagccagaggtgaccggccccggggtccaggcacccacagggaggcgccatgagggctggcggcccagcccgctggctgtgtggagagtacttagcctttaggcttttgcctctgcccgtctggctgcctggagcaccctcccttccctgacctctcccaggctccgagctcactcacatccctgctgactctgggctgtgacttgtctgcctccctgacaggagcgccagcggtgtctgtccctccgcctggggcccagcacaggcctgggactccagaggtgcctctggctgtgggtccagcgagtgactgagccctgctccccttttctctcccgcagagaagctgaagaaaaccaagatcatctttgtggtgggtgagttgcgggcaggcgggtggtgcagcaagggtcttcactggcactggagggagcccgggcctggggctgcaccctgggctctgcccctccctctctgggagaccctggcagcccctgttcctcctgggaccctgtgtctcggggtttatgaatgggtgggcgtttgcaggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggtgagtgggccctggtggggtgagaggcaggggatgacagtagccctgagtgggtgtcccaccagcagcaaagcccacggcacacaggcaaagctgaccgtaaccgcccccggctccaaacccttctgtggttccccattgccctggacagaaagttccttccagaagctcccaagaccttgcaggactctgccctgcccccaactctctcccttccctccatccttcagccaccctggcctctgtcccctcagactagccatactccttccagcctggaatattctttcctcttcagctttcagacttccctaactccccagatttggcctaagacctccccccccaattttctactccagaagccccacttctctgcccgtacaacctgtgccatgcttagaaatggagaaatcatctgtggaatgtgtctgtcccctcaccagcccctgagctccccagggcagggaaggcctaattggtccatggccgtgtcctcgggacccaggacagcacctggctggaaggagggtctcagtgaatactgttgagtgaatgcatcattcattcattcattcactcagtccaggtctccacaattccgaggaagcttcctggagggggaggcttgtttgggacatttgtgttggggagagggcatttcaggtggcaggagcagcgtgagcagaggctgggagaagggatggggaggagaggctcatggccccttcctcctttgctgtgccccaggagacagtgttggacatgctccgggatgccatggtggccaaagtcaatacttccaaaggcttcctgattgatggctacccgcgggaggtgcagcaaggagaagagtttgagcgacgggtaaggcactgacccaagtggggatcctggtgggctggggcaggataagactcccatccccatgggcgggcctgcgggggctgtgatgcaggtcagagttctgagcagaggctgattcatggagtgtgggtgaggaggaaaaccaggaagactttctggaagtgtagaagaaaatgtgtagaaggggaagcgccaggaggggcagttgccaaacctgggctcagattccagctcaacggcttgagatcttgggccagtcattctgcctcctgaacctcagttttcccatctgcaaaatgcagggagtgggaggaccaggtcacagctgccttaagggacagtgtggggactggagaggatgtgcccttccagtgtgggccttggctccctataaacacacagaggggcagggaacagcactggcagggctggaaaggcaaggccagtgtggggagaacagaatatgtgggcaggacaacaagggaggttccagcctggctggaggctgcaaatgccataaagggacatcagtctccttccaggggtcatgaggagcctggctggaaagagcaggcctggaaaatgatggccctgagcttcctagcacgagcatcctgcagatacaccttccccaggatggggcaccccacacacgcacacacgtggacgcttgcacatacacatgcacaagccccacaagttcatacacacaaggccaggggcatgtgcacacatgcacacacacggcagtggatactgcactcctgcacatgcatgtcacggacgcagcacacatatgcaggaatgcacacgtgctcgcacacatggccctgtgcacacacatacacttttacctcggtgtcacaaggctgtatgggagaaataaacgggactgcaagggcctaggagggagaggtcggcaagggctagggggagcctaaccagcatcctggtgggctggggcaggataagactcccatccccatgccccattcccatgccccgtctcgtagggccttctgggcttccgtagcttccagcctcatctggggataggaggccatattttctgacctccgagtggctgcatgagtggctgcaagacctcaggaaagtgtctaccccactctgcccctcaccttccctatctgaaatgggggttagctggattccttcagacctcagacccctgaccctgtgttaggtgccacagttctgaaagatgtcctggcctggctcacacataccagctgtgtggtaccacctgtgaccctcagggccacatctagaaaatagagttaatgaaagtcggccgggtgcagtggctcacgcctgagatcctagcactttgggaggccaaagagggcagatcacttgaggtcagggtcaaaaccagcctggccaacatggtgaaaactcatgtactaaaaatacaaaaattagccaggcatggtggcgggcgcctgtaatcccagctactcaggaggctgagacacgagaatcatttgaacctggctggacggaggttgcagtgagccaagatcacgccattgcactcaagcctgaacaacagaatgagactccgtctcaaaaaaaaaaaaaaaaaaaagtccccacccttccagggctgttgtaggtgccgctgagggccgcaggctcagccctggtcccatccctgctgtggcctccaggtgtccgggcagctggtcttcttggctctggacaccagggggcgccagggcttcaccgaaggagggagggtcagcctggaagtgtggccggctcacacccaaagcttttctggagactggcagtgcccgttgtggactccccgggctagatgtccattgtcctgacagggagactgaggccccacagccagaatctcaagcccagaggctgagctggctctcccagatttaccacctctgctgggtgtgtgtaaagagcctactgtgcttggtcctggagacccagatgaaccagagactgtgagtctgtgccctggaggagctcagcagctgatggatgatgatggggggtgggtgaccttgaagttgaggtcagactgctgcatccaggcccagcctttgcccccatggtaatctgtaaggtagaagcagccgctgggtggtacggagtcatctccctgaaggcagctgacgctgtcaccctgaatccttaactacggaggagctagggatgagcgctaggatgggtatcgcaggcgaggacaaagggcttgccccaggtcacacagctgaacagaggcaggggtgagcctgggtccaggtcagtctgacgccggaggtcaggctgcttctcgcctctgtccagctgtgtggccttggacaagcctcttggttacacagctggacagaggcacgaaacagcctgacctgagaggcagtgccccaaggccttgacaggggtccagggccaaagctgcgcagaaacccttgggggctggcccaggcagttggaagcaggagacagggtttgaaggtcccaatcccattcctaaagctgtggcagtcatgggtgactctggggtggctctgccctcccaaccaggcagctgtggtagctggattgagcgaggcaggggctgcagaaccttattcctcttgcctttccaaggcgtcccatggatgacatggatgacatgctgttccaatgacacggacattgctcagaaccccccaggactcagcagcccctcaccccttccctcatcccttgttcctttgtcaaaggaccccagaattgtgagacaagtgcctccctgccctcaggggcccttgggagacctgcttaaggaaagataaaggcgctggaagagcctgttccaggaggcggggagtactggggggcggggggtggcatcagagagactgccctgaggaagtgagcttcgcactgaaacctgatgcttggtattgaggtgaaggcgagttaggatcaggctcgggggagagggctcctagcagagggaacagcatgagcacaggtctggcatggaaggaggttgatgagagcctagagcagagagagtcaggctctctcagtctggcaagtagtgtggactttctcctgagggcactggggagccatggtgtaggtttgagcaggggagtggcaggaaagattggttttaggaaggtctttcaggctgccttggggaagggattgaaggtctgagggggtatctactggggcttcatagatgggaagatggggaggagatggccctagggggcaggaatggggtccctgtgacatggtgcccgcctgcagattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtgggccccgcgggcccaggggcagctccgggaagaacgggttcctatgtggctccgcctcagctcactgtgtggcctcaggccagcccctctctctgggccttggtttccccactggttcaatgaggggctgctgtcaattaggttgggctcggggaggcaggcctggtctctggggcctgccatggtgaggcccaccccactccacctggtgactcagccctcacggcccatctccccacaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcacctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgcgaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaatctattgaaagaagaacatgaaagaaataaacaggagttcagcggagctagcagaagacaaggcatgtagggggagccattctgtcccagggaagttgtggagggtaggggctgtgtggaggcctctgcagctggtcctcggttttccgcatcggcagaaaactgatggggcacgcagggacaccgcaggctccaggtcctgggtcctgcatctgtcaaaccagattcacacacacacactcacacacgccagcgcgcgcacacatgcactcacacatacacactgatccacacacttgcactcccacacacgcatgcacacacacttttacacacatgcatgtgcacacaaaccactcatccatacacacatttacacagtcacccacacgcactcacactgacccagacacttgcactcccactcacacaaacacacttgcacacacactcattcacacacatttacacatgcacacattcacacacttgtacacacaaaccactcacattcacacacatctgcacactcacagtcatgcagtgcacacaccacacacgtgcacacaaaccactcacattcactcttacacgcacacacactcactgtctcacacatccattctgtctcaggatgaagacaaagtaataaagataaggaggcggtttggtgggggggtcctagttctttctcatctaccttatctttattttgatcacagcttcattcatccgggtgagtcccagtttgtgaaacctaagctgattcaaattgtcaaacgattcaccacagaatcactttatccacgtaaacaatacctacctatcatctctctccctctctcatctgtctagatgcagatatcctctttgctgaaaacttggaaacgcaaaaagttttaaagccctgggaaccaccaccccgtccttgccaccgtaaaccttcctttgggaatttctttcatgcatgtttgcttgttctgtagacattgctggagcacccgccgtgccagcgagacagaggcttagaggcccctggcctgctgcgatatggctcccagcacgaggagaggcctctgttcgcaacatcccgtcagacccactcaaccaagaccagttctgggcagctgagtgcaccaagctcagaggagacctagtggtgggaggttccttgaccagagttctggggcagggccctgaagacacctgggagttcgccacaagacagagggcaagaaaggacagagggaacagctctgcagagccacagaggtggaaaggacctgtgggtgttgggagagctgagaccgcagaggggggctgtaacgcaggctagcggggtggcggtagcaagagacaaggctagcagtgtacgaaccagactcacagggtttctcataagggcaatgagaggctaagaaagaggtgttttttggttggttggtttttttgcaacagagtcttactctgtcacccaggctgtagtgcagtggtgcaatctcggctcactgcaacttctgcctcctgggttcgaacaatcctcccacctcagcctcccaagtagctgggattataagtgtgaaccaccatgcccagctaagcagggtttcaccatgttggccaggctgatctcgaactcctgacctcaagtgatctgcttgcctcagcctcccaaagtgctgggattacaggcatgagccactgcacctgaccaagaggtgtatttttgtgtgttttttgtttgtttgtttgtttgtttgtttagagacagggtcttactctgttgtccaggctagaatacagtggcacaatcatagcttactgcagcctcaaactcctgggctcaagtgatcctcttgcctcagcctcccaagtagctgggactacaggtgtgcaccaccacacccagctaatttttaaaatttattttattttgaaatggggtttctcagactcttgagctcaagtgatctgcccacctcagcgtctcaaagtgctgaaattacaggtatgaaccaccacgcctgggttaatttttattttttattgtagacaggggtctcagtatattgcccatgctggtattgaaca

SEQ ID NO: 17581 - DNA, 23796 bp, Human
atgaatcttgacctttcagctgagaaggcgaactcaatgctcatgcccataccactgcacattctgcctcctgatggtgatacccatgaaggatgtggtgctggaatttactcaagtccccaaaaggaggcaccctatattccagaagaaataggtccaaatccttatcagaccaaaatttcatctttatttttattattattagttttctgagacaggctctcactgctctgttgctcaggctggagtgcagtggcccaatctcggctcactgcaacctttgcctcccgggttcagtgattctcttgcctcagctcctgagtagctaggattacagacgtgcaccaccacgctcggctaagttttgtatttttaatagagacagggtttcgccctgttggccagactggtctcgaactcctgacgtcatgtgatctgcccacctcaacctcccaaagtgctgggattacaggcatgagccactgtgcccagcttatttttattttttgagacacggtcttactttgttgcccagggtggagtttagtggtgcaatcacagctcactgcagccccaagttccagagctcaagcaatcctcccacctcatcttcctgagtagctgggagtacaagcaagagctacctggctaatttttttttttttcctgtagaggcagagtctcactatgttgcccaggctggtcttgaactcctggctgaagtgatcctcctgcctcagcctccaaaagtgctgggattacaagcttgagccaccacgccagtcccagaatcttttttttttttttttttttttttttttttgagatggagacttgctctgtcgcccaggctggagtgcagtggcgcaacctcggcttactgcgacttccgcctcccaggttcaagcaattctcctgcctcagcctcccagggatctattaatgtttaaggacaagtggcaactgtggatgcccaacatggttacttaacaagaaaccaatttttcagaggccaagagtcccaacagggccgagaatctggccactcgcctatggctctggaggtggcatgacaaataagggtggcatgacaaatataggttaactgatttgttgcagggaccagagatcatagatggtgaagttaactaagggcctccaaatccgtgtcctttgtgccaacaggtgtgccaggctgctcacaagacaccatggtacgagaaaggatttctcgtagtcacctagacaccaggtttatggctgtgtcgcagcaaagttgggtgtgacttatgattttcgttctgaaccttatttgttagataggtcctggagtccttaaaacacgcaggtgaaagtcagggagtaggagccatcaaaattcgactctggtgggactcgaacccacaacctttgaatgaccacactaggctcagctagaagtccaatgcgctatccattgcgccacagagccggctgcggaacccggccgccccgctcacctctgcctgaaaccgccctcttagcgagcttctaggtgtggtgctgggtgtttgctgaactcggccggggcccgagagcgtgctccgggttttcggctgtggtgtggactggggtgctcttcctacatccgggcgctggggacagcagggggcaagggccggggtcggcagggaggaagggccggggtgaagcccgcctgtctcctcgcggactcgggggtctcctcggctgggtggggccgcgcggcgtggactacaactcccagcgtgccgcgcggcggcgccgcccgaagccgttgcgcgagcagggcgggctggggccgagcggcgtcaggcgcgctggggctgcgctgcgccgccggctctgtggcttgccggcttcggggaaggtgcggcaggcggtgctgcggcctggcacagcaggtttggggtgcgggaggcgggcggggtaggagcgcggcgggcggggccgggcggcgggcggggctggcggggcggccgggccatgcagggcgcagagccggctaaaccctgctgagacccggctccgtgcgtccaggggcggctaatgcccctcacgctgtctacgctgctgcaaccgggccgcatctggacggggcgccgcgcggcggagccgacgccgggtgagcatagaccgggctggtgggttcccgggtggggacatgtgccaggccgagtcgggcgaggtggcggtgcggaccccaggtggggggcgcgccctgcggcgctatttccccgacagacgcactgttaccttgctgtctaggggcgagggcggcacgcgtgacccgggacaggggcccgagggaactagtcaccctcttctggcctcttcttgccccagccttccaggacaggttcctgcccctctgctatggcgggctatgggaggccagagatctgaggaccctggaccctggcgttggggttgaggactctggttcagttcccccgcccccggcttttgcttttcgcgagggggagggggagatggtctcccagggcttcttgtggtccagaccattcccttttcctggcttggaggctctcaggccatttcacatttgtgaccttcatctactcccaagaacaggaaaactcggagaaaaacagtcccatcagatgtccccttgatcgagtcctcaaagctccaggaatagaacccaagagtcctagctcaacccagcccctgaagcacagtcaagtcattcgccttcccctaagccctagaccccaaagattcatccgagtggctgtgtgtgtctgtgtgatgggtggtggtgtcttcaaggtcctcctcgcctccctcaatcagctttgccccctgggcggtcacctttcaagcacttccaggctctaactcgttttctgggtcgccctctatagaccaacagacgcactgcgatacctgagtctatgggcagggaccaagcagggctccttttccagggagctgcccctttgacttggcctggtcatccacagaacctccctgggttctgggtggggagtcgagccagagactttttttttctttttttgagacggagtctcgctctgtctcccaggctggagtgcagtggcacaatctcggctcaatggaacctccgcctcccgggttcaagcaattcttctgcctcagcctcctgagtagctggggttacaggtgtgtgccaccatgcctggctaatttttgtatttttagtagagacagggtttcaccatcttggtcagggtggtctcgaactcctgacgtcatgatccgcctgcctcggcctcccaaagtgctgggattacaggtgtgagccaccactgccagcgagccagaggctcttaagtcagtacccacccccaggccatccggttttagggaccctggatgtcagaagagtgaactgtcatgttttggctagaaaagcctcttagaacacgtctcaggacaactcggtggtggccactgcgcagaccagacttcgctcgttctcgcatgcctcgctccgcttttcctccgcaaccatgtctgacaaacccgatatggctgagattgagaaattcgataagtcgaaactgaagaagacagagatgcaagagaaaaatccactgccttccaaagaaacgattgaacaggagaagcaagcaagcgaatcgtaatgaggcgtgcaccgccaatatgcattgtacattccacaagtattgccttcttattttacttcttttagctgtttaactttgtaagatgcaaagaggttggatcaagtttaaatgactatgctgcccctttcacatcaaagaactactgacaacgaaggctgcgcctgcctctcccatctgtctatctggctggcagggaaggaaagaacttgcttgttggtgaaggaagaagtggggtgggacgacagtgaaatctagagtaaaaccaggctggcccaaggtgtcctgcaggctgtaatgcagtttaatcagagtgccatttttttttttgttcaaatgattttaattattggaatgcacagtttttttaatatgcaaataaaaagtttaaaaacttaaaaaaaaaaagaacacgtctcactacacccattgcacagagggcagatactaaggtctaaaatgtgaaaaggtcttgcccaaggtcacttggagaatggtgggcagagatgggactatgagacgagaaccagcctcctgcttctcactcttggaattcctcacctcaagtgccaagcccctagcctgccccttccaggccaagcctggaaagggacccctgtggtcagtcacccaactcagtatggctaagccttaccacaggctgtccccttgggatcacagtggcctggctgtctgggctgggaggtaggagacctggagggttgggtgtttgggtccactaactgccctgtgtccgcaggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcgcgatatcttgtgagtacctggcccagcctttcctggggtctgccacactacagtgagcttctggtcccccaaatctccccaggccagacctcatgttctctaccagcacagggcagctgagctgagttccagaacagcagcctctgctccacacccgtaccctggcaatagtacctggtccctccatctccaaggtcaaagtcttctcccagggaatctccctaacttgaggctcccaggccttgggcaggcttggcctaggacgtacattgaacaccaagtgtgttgagacatctgcaaggggtcctgaggactctgtaagtttatgaaagggtaaagaggaattttggggaaaggccctgccctcaggttggcaggggtgtgagatggcacagggggcactgagttctagagcagagcccctactcagatgtctgggataacctgctccccaaagaaagcccggtatgctccaagggacatcctgtaccagaaatatctattcccgcttgttctctactaggtgccaggctagctttggggtccagagaggaataaggcagaccccatctgccaagctcagattggtcaggagaaagaaagggacacagcacatctgtaaattggcagtgccatgtgggcagagaccctggcacagccttgctcactactgtgtcccagcacccagttcagtgacccacaccccacacaggcagctcagcatttgtcaatcttggttgattgcaaaagaaggcacggagtggcacaccaggaagggtggtagctgtgggagcatggagcaaggagaaacagctgccagccaggaccctgggaatcagagaaggcctcctggagaaaaagcggctgtacttgagaggcgccttagtggtggtggaaggagatgaatccaaccagaaggcacagcatcagcaacaaaggcatggagtccagggctgggcgcagtggctcacacctgtgatcctagcactttgggaggccgaagtgggtggatcacttgacctcaggagtttgagactaacctgggcaacatggcaaaaccccgtccctaccaaaatacaaaaaagttagccaggcatggtggtgcacacctgtggttccagctacttgggaggctgaggtgggagcatcatttgagcctgggaagtggaggttgcaatgagctgacattgcatcactgcactccaacctgggtgacagagtgtgacgccatctcaaaaaaaaaaacaaaaaaacaaaggtggcaggaatgggatgttgccaagtgattccacaaacttattgaacatctactctgcctggcacaggacccaggggatagagtgttgaataagacagaagcctatcccagctaggctcacagggaggaagactggacagaccagcaaactcattcattatttactgtggtcatggtgggtcgagggagcagctggactgtgggaggccccaaacaaggagtttggacttttacaggaagctctggagacctaggaggtttctgctggagcagcaggctgagagggtaggagtagaactctggagccagagaggcctagagttcaaatctcagctcagccaccctccatccatgaagctttgagcaggccacggcaccacgagagccttgatttccttctgtgtaaggggaggggaatcatacgaactctcagtgttattgagaggcatcagtaaggcagtgcatgttcccagcaggagccaggagatagaagtgttgtagggggtctggctcatgaagcataggctggcgaggcagcagcctggggtagggtgtcaggacccctccctcccaaccatggcagacacagcgccctctcttgttcacacacagtggcggcctggtcctcctgaaggtgaaggcaaaggtgcgacagtgcctgcaggagcggcggacagtgcccattttgtttgcctctaccgttcggcgccaccccgacaagacggccctgatcttcgagggcacagatacccactggaccttccgccagctggatgagtactcaagcagtgtagccaacttcctgcaggcccggggcctggcctcgggcgatgtggctgccatcttcatggagaaccgcaatgagttcgtgggcctatggctgggcatggccaagctcggtgtggaggcagccctcatcaacaccaacctgcggcgggatgctctgctccactgcctcaccacctcgcgcgcacgggcccttgtctttggcagcgaaatggcctcaggtgagccccaagggggcgggggacaagcaggaaccccatgggatcttacacagaccacagctcccttccagccctgccaaggctgtgtgggtcagtggttaagggcacagagtggagtcagacagcttaggcagtgccacgagtaaacgagatcctggggaagggactgatttctctgagcctcagtttcctcatccgtcgttcctacctcatactgttttcaaaaaggtacttcagactgggcatagtggctcacagctgtaatcccagcatgttgggaggccaaggcaggaggatcccttgagcccaggagtttgagaccagcctaggcaacatagtaagaccctgtctctactaagaaatttttttgagacagggtcttgccctgtcacccaggctggagtgcagtggtgcagtcacagctcactgcagccttgacctctcaggctcaagcagtccctccacctcagcctcctgaatagctgggaccacagacatgcaccaccatgcctggctaaatttcacattttttgtagatactcagttttgccatgttgcccaggctggtctcagactcttgagttcaagcgatccacctacctctgcctctcaaagtgctgggattataggcatgaaccaccacacctggcctactaaaaaaagttttttgtttttttttgttttttttgttgttgttgttttgagatagagtcttgctctgtcgcccaggctggagtgcagtggcgtgatctcggctcactgcaacctccacctcccgggttcaagcaattctcctgcctcagcctcctgagtagctgagattacaggcacccgccaccacgcccagctaatttttttgtatttttagtagagacgaggtttcaccatgttggtcaggctggtctccaatccctgacctcgtgatccacccgcctcggcctcccaaagtgctgggattataggcatgagccaccacgcccggcctaaaaaaagtttttaaaaaattagctaggcttggtgacatggacctgtagtcccagctactcagaggctgaggcaggaggatcacttaagactaagaggttgaggctgcagtgagtgatgattgtgccacttcactctagcctggcagacagagtgagaccctgtctcaaaaaaaacaaaataaaaggccgggtgtggtggctcatgcctgtaaatcccagcactttaggaggtcgaggtgggcagctttgagatcaggagtttgagaccagcctggccaacatggtgaaaccccgtctctaataaaaatgcaaaaaaaaacctagccgagcatggtggtgcgcacctgtagtcccagctactcgggagactgaggtaggagaatcgcttgaacccaggagacagaggttgcagtgagccgagatcacgtcactgtgttccagcctggatgacagagagaggttacgtgtcaaaaaaaaagatacttacctgaagcactagcaacatggctgatgctaggtggcccctcagtacaatggtaatcatccttgtgactaattaggccgtatctagctcatctgtaaaatgggaacaaaattaattccccactttcctcacagagcctgcattttatttgctgccacattgggcacctgcaaagtactgaggttgctgctttccaagagcagctctaatctctataaagaccgagtgaggtagggatcttggttttatggatgatgagcctggagttcagaggggtttgtgaggagctcacccaagatcacacagttagtaagtggtagaactggggtttgatcttcagcttgatcacagcactctgttttttctccccacactgttgtggttgtgggataatgaatagggaagtcattaggatgctgaaagggggcctggcatggtggctcacgcctgtaatcccagcacttttggaggccaaggagggcaggtcacctgagctcgagagttaaagactagactggccaacatggtgaaaccctgtttttactaaaaatacaaaaattagccaggtgtggtggcacacgcctgtaatcttggctactcaggaggctgaggcacaagaatcacttgaaccaagtgagccgagatcatgccactgcactccagcctgggcgacagagtgaaactctgtcttaaaaaaaaaaaaaaaaagatgctgaaagggggccaggcacagtggctcatgcctgtaatcccagcactttgggaggccaaggcaggagaatctcttgagcccaggagttcaagacctgcctggacaatatagtgagaccctgtctgtctctatttaaaaaaagcaaaagaaaaaaaaaaaaaaagaaaggaaagaaaaaaatggtgctgaaaggggagagggaagaaggcagccagggaagaagagagggttgggcaaatcaagaggaagccaggaaggtggggccaagccgaccagcgctgctccatgcccgggggtgggggttatgtgatgtccgtgcagtgcgcaggggagcctgaaagcaggttcccgctctcggaaggggatggagggccactggcctctgacccgcactcctcccttctatctggtgcaccacagagtaagtagtgcgggatagtgggggggagcccagaccttgatgtgaggtagagctggcattgcacgccaggtccagcacattctagctgtgagcaggtcctctcattctcggagcgtcaatcttctcatctgtaagaggggctgtcaatggtccctccttcccagggctgtgagaccagggaatgcaggtaaagcggacctactctgtggttagcccatggctaatagaaccattgccggtgcccctgtcaacactgaaggcccagttgcttcactgcctctcctcctgcccagccagtatcctcagcaacatggccagccctgctgggagcagaggtccctgggaacatggggttttctggcctgcctgctgactgccctgtctccccacagccatctgtgaggtccatgccagcctggacccctcgctcagcctcttctgctctggctcctgggagcccggtgcggtgcctccaagcacagaacacctggaccctctgctgaaagatgctcccaagcaccttcccagttgccctgacaagggcttcacaggtgggctccatcccctccccatagaggggctctcacacaggccctggacagagcactggcctcagtgccagaaggaggcttttctggaaacttgccatgtgcctggaacatgtcacgtcacctccctttttccatctggaaaatggtgacagtaaacctgggccactccagggttactgtgaaggtgacatgagctgatgtgtatcagtgccagatacagggctgagaacacaggagctcacaaagtccagtgtgatttgttgaacaagccttcattgatgcctaatgggcagaatcctgtggactccgggaacctgcctggtctgggctttggttggggttgggtgggagggtgggtgaggagcaagaccctttgtatattcatcaagtgcctcttcagtgcaggacacttcaggatctccagctgtgatcctctcccagcactgtgctgcctccctgaccccacctccaggcagccttcctgagcctctcacccctcttcttttatactgtagcctacctggttcttctgctcttctcattctctttcctgtgaagccacattgcctggtggctcagagcttgggctgtcgagtcagatccgagtttatatcctggttctactgcttcctttgtgtgaaccctgacacctgccctgcccttggagcctcagttcccacagccataaaactggggacagtagcagaacctactctatggggtatctttgagggttgaaaaaaatacagtggggccagtcctgaagctagggtgtggcaggaggggctcagtaactggtcattgtcatcagcactgtttaacttctctcttgtatgtgaatctggtctcttgggtgcatttgtcagctgcttgagggcagggactctggctggttgctctggtgccctcatagtgcctagggctggcaaacagcaggcaggcagagagcatgaggtgtctcggcaggcattctaaacacgtggagtctgcctgtggagttcctgacctccagggaacctcaagtctggtagggccgagcctcacatagaaactctaacgtggcaatccctgtcgagggctgcagagtgggacagatcaatgctcagcagtgcggaagctacctcaacaccccacttcctgcagctaatgcctccctgtgctctatgacttggggcaggtgtcacctttatcgtgaagcccacctggcaccacctcccctcctgcaagcttgggccaaatgtggctactgggtttcaacaggtcctgtgccctccctcggcacttgttgcttagtattggaattgcctgtgtcctcatctgactgttccactgagctgtgactgccaagagggccaggcccgtgcccatcttactcactgatgtctctctccaccagggcctagcacagagcaagggcccaggaaatatttgttggaatggatgccggtgttagagctgaatggtatctgaggttatcagaacaggcttcctagcaagggtgtgatgggaacaggtgttgaagggtgcacacctgcaggtgtccatttgtgtgaccctttgcccagccctgagctgcccccgacagccactcgcgtctgttttctttagataaactgttctacatctacacatccggcaccacagggctgcccaaggccgccatcgtggtgcacagcaggtaaggggcaggtgcccagggtggggtaggcacaggcagggctggggagcctccttctgcctttctagggcccgctcagcccttggccctgtgccttcccaggtattaccgcatggctgccctggtgtactatggattccgcatgcggcccaacgacatcgtctatgactgcctccccctctaccactcagcaggtaactctagggctgtcacacagcctccagcacctgccaggtctctaggaaccccacccccatcaggcagtgtgctgcagtagaaacacacagctttgggccaggcgcagtgactcacacctgtaatcccagcactttgggaggccaaggtgggcggatcacttgaggccaggagttcgagaccagcctggccaacatggcaaaaccccatctctactaaaaatacaaaaattaggctgggtgtggtggctcacacctgtaatcccagcactttgagaggccaaggtgggcggatcacttgaggccaggagttcgagaccatcctggctaacacggtgaaaccccgtctctactaaaagtacaaaaaattagccaggtgtggtggctcatgcctgtaggcccagctactcgggagggtgaggcaggagaatggcgtgaacccgggaggtggagcttgcagtgagccaagatcgtgccactgcactccagcctgggcaacagtacaagactctgtctcggaaaaaaaaaaaagaaagaaattatctgggtgtggtggcgtgtgcctgtagtcccagctatctgtgaggctgaggcacgagaattgcttgaacctgggaggcaaaggttgcagtgagctgagatcacgccactgcattccagcctgggcaacagagcgagacactgtctcaaaaaaaaaaaaaattagctgggtctggtggcgtgtgcctgtaatcccagctacctgtgaggctgaggcatgagaattgcttgaacctgggaggcaaaggttgcagtgagctgagatcacgccactgcactccagcctgggcaacagagcgagacactgtctcaaaaaaaataaaaataggctgggcgcagtggctcacgcctgtaatcccaacactttgggaggtgagtggatcacgaggtcaggagttcgagaccagcctggttaacatggtgaaaccctgtctctactaaaagtacaaaaagtagctgggcttggtggcgggtgcctgtaatcccagctacccaggaggctgaggcaggagaatggtttgaacccaggaggcaaaggttgcagtgagcctagatcgtgccattgcacatcagcctgggtgacagggcaagactctgtctcaaaataaataaataaattaatttaatttaatttaaaaataaaaataaacaggattagccaggcgtggtgcacatgcctatggtctcagctactgggaaggctgagacaggagaatcacttgagcctgggagtttaaggccagcctgggcaacatggtgagacctgtctctaaaaaaaattttgttttaggccaggtgtggtggctcacgcctgtaatcccaacactttgggaggccgaggcgggcggatcacgaggtcaggagatcaagaccatcctggctaacacgatgaaaccccatctctactaaaaatacaaaaaaaaaaaaaaattagccgggcgtggtggcgggcgcctgtagtcccagctactcgggaggatgatgcaggagaatggcatgaacccggaaggcggagcttgcagtgagccgagatggcatcactgtactccaggctgggcgacagagcgagactccgtctcaaaaaaaaaaaaaaaagttgttttaaattgaaaaaaggatgagcacaccagcctcacagtgtgtgtggcagtgtcccacggggcatctgggcctgtctcatttcagtttgtttccacagatatgcatggcattgctgcttgtttgtaggggcttaagggaagacagcttgaataaatatagctcctgccctccaggtgcttagagtcgggtgtatatgtgagtgtaggagagaggcagggagcaagagggcagcaccagggaagagcctggtgatggaagccggggaggcttcttggaggaggtcacccaaggcaggcagatgtgaggtgcagaagcctgcagggcagcacaagcctgcctggctggatggcagtatcactgatttggggccggggagggtcttcatctcgctgaccctcaggggccatccctctgcctccaggaaacatcgtgggaatcggccagtgcctgctgcatggcatgacggtggtgattcggaagaagttctcagcctcccggttctgggacgattgtatcaagtacaactgcacggtgagcgagagcgggaagggtgagctgtccctttcccctagttaccctcttcccaactacactccggggcatctgtcttatagctgaggtggccagtcattccaaagggctcatttgtggcaaagttcccattgttcagatgggaaggctgagacccggagagggaaaggatggcatggccagcccctggggagagtaggggcttgagggatcaggagaatcctagtgtagtgagggcagcctctggagcctcgaatcacaccaagttcacccccagattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgcggccaggttggggatgggcgaggctgctgcagggatggcccacagaaggcactggatgcagaggggagggcagagttcgagcgtgagagtgtgggtgctggagtcccacttccccctcattgtccagttttgggcccatggtgagagagcccaggcccaagtcttggccttcgcaggtgggggcctgtggtttcaatagccgcatcctgtccttcgtgtaccccatccggttggtacgtgtcaacgaggacaccatggagctgatccgggggcccgacggcgtctgcattccctgccagccaggtctgccacttcggggtcagagagggaggggttggcctgggaaggaaggaggccaggcgcgtgtggatggggagccttgttctgaccagtggccatcagttatctctgctcttagggttacaagttactcatttatttgtgtatccatccattcattcattcattcgccattctatctgtacatcagtccattcattcattcttttttttttttttatttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaagcaattctcttttctcaccctcctgagtagctggaattacaggcaaaccccaccatgcccggctagtttttctattttcaatagagatggggtttcaccatgttgtccaggttggtctcgaactcctgacttcaagtgatccatccacctcggcctcccaaaatgttggtattacagatgtgagccaccatgcccggccctcattcattcattttcatattgactccaaatgaccctgagtccaggctgcttgagatttattctggctcagctccttagctctgtgtcatgggcgagtattcagcctcactgtgcctaagtccccttatctacaaactgtgcccatggcagcacccacacatggggctggcctgaggattatgtttcataaagaacataaaactctgagtgggtcccggcatggagcagaggcttggggcgctggctttgttaggctgtccccaaggagcctgacttatgttcatcctcccatcagtttcgagaacaaacatcactggctcagtgtgtccgacctgccaagatgagctcctgggctgggggagggtggggcatttctgtggcaagcagcatgactcaaatcagatcaagacacagagtacaggctgggagtggtggctcacacctgtaatcccagcactttgggaggccgaggcgggtggatcacctgaggtcaggagttcgagaccagcctggcaaacaggatgaaacccatctttactaaaaaataaaaaaaaaaaattagctgggcctgttggcgtgtgcctgtaatctcagctactcaggaggctaaggcaggagaattgcttgaacccaggaggtagaggttgcagtaagccaagattgcactgctgcactccagcctgggcaacaagagcaaaactccgtctcaaaaaaaaaaaaaaaaaaaaagacgcagggtacacctggtgacaggacgggtgggagaggctgcctagggcagatctgaccctgccttccccaccccaggtgagccgggccagctggtgggccgcatcatccagaaagaccccctgcgccgcttcgatggctacctcaaccagggcgccaacaacaagaagattgccaaggatgtcttcaagaagggggaccaggcctaccttactggtgggtccccagcccttcacagccccttcctgagggttgggggaggaggggaccttctcccacctccagaggacaccttcccaggactcccccagtcctggcccttgtggtcaaacaaatccttgggctccagcaaagcctccctggcttgagccctggtctcagagctggccaggcccagccctgcctcatccggcccctccctaggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggtatgtgcaggcaggcgcgaggtgtgggtagggaggcaccacccaggggcaccaccagctactcagtgtctaccctgccacccccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggtgtgtccctcccctgctccagctctcggatcccaggtcccttcccgtttccttctggagagacccggttggctgttacttgacctctgcacacagcctggccgggcagttggtaaagtgacctgcctgtgtagaggtgagcagacggggctggcagagaagacacacattgttccttagtagaacacatattaggtgccaggcacagcgctaagcctcgggatacggctggtgagctctggatgttttgccttcttggagttttagagcaggagagaggctggcctaggacaaggcattccaaaggtaaagaatcgaccacataatctgtcatgagattagagttaaacagataaaaagaaaaatgaaccacagagcaagctgataggaaagcaaaaaggtgggacgcttgggatgactagaaggctcctctgaggaggggatggttcagctgagacctgaatgaaaggaaggactttatggcggtgggaggcactctaggctgcaggaatagacactgtaaagcccccgaagcaggaaggagcttgggtgctggaggaacgaaagggggcccccaaggctggagccaagtgagaggggcaggcagtggcatgaagtgggagagaaaccagcaggggccagaagcccagggccttgcaggccagggtaagagtcgggactgtcccgggggcagtagggagccacagaagcatctcagcaaggccgggcgcagtggctcatgcctgtaatcccggcactttgggtgggaggccaaggcgggcagatcacttgaggtcaggagttcgagaccagcctgcccaacatggcaaaaccccgtctccactaaacatataaaaattagctggctgggcgtggtggctcacgcctgtaatcccagcacttaggaggccaaggtgggcggatcatttgaggtcaggagttcgagaccagcctggccaacatggtgaaatgccatctccactaaaaatacaaacataaaaataaaaaaattaggctgagcatggtggctcacacctgtaatctcagcactttgggaggccaaggcagatggattgcctgagctcaggagtttgagaccatccagggcaacatgatgaaaccccgtctctaccaaaaatacaaaaaaattagccaggtatggtggtgggcgcctgtagtcccagctacttgggaggctgcagcaggaggatcgcttgagccccggaggtggaggttgtagtaagctgagatcacgccactgcactccagcttgggctacagagtgagactccgtctcaaaaaaaaaaaaaaaaaaattagccaggcatggtggtgggcgcctgtaatcccagctacttgggaggctgaggcatgagaagcacttgaacctgggaggtggaggttgcagtaaaccgagaccgtgccactgcactccagcctgggagacagagtgagactctgtctcaaaaaaaaaaaaaaaaaaaaattagccgggcgtggtggtacatacctgtaatccagcgactcgggaggctgagacaggagaattgcttgaacccaggagacccaggagccacaggttgcagtgagctgagatcatgccactacactccagcctgggcgacagagtgagactctgtctcaaaaaaaaagcatcttagcaggtgggaacctggtcagactcatgctctacaaagctctctggctgctgtgtacggagtgggagaggattgcaggcagccctgagggagctgggagacgagggaggggctgttgcagttgtccaggtgggaggtgggcagcgggcccgcagtcgcccacaaggcagcaccatctttctatctgttggcccattggtggctctcaagagttccctggtgggcaggaaatgctgaggctcatgcccatacctgcccctgctttcctcagcccttggtgcctcttctgggccctccctggctgctcaccctttggagcacatttccctggccacctcccacgttgtcgtcatatcagtcctgccttgatggtgggcactccctagccaatgtggcttctgccagagagtgggtacctggagtgcctaaagcatcggggagggtttaggacttcagtgtggttctgaaggttggagacactgtggccaggctaatggccaagaccatgagcttccggaggattgagcagcaccatacttctgtccaggaaaggcagggaggctctcagaccttgtatttcagatgggctttgctgcagaacaaaccacccccaaacttacttgccccaaaatggctcgaaacaaccagtttattgatgcataattctgtgggtaagcaatttaggggttaagtgcagctgagcagttcttctattgaccttgctttggggtcatcacttagtaacttagctggggcaagaggcagttagatggcctcacccacgtgtctggctctcggctgcttacctctgcagcactgtccaacagaactttctgcagcgatggaaatgttctaggtttctgctgtccaacacagtagccactagcctggcagagctactgagcacttgaaaggtggctgctggctggacgccgtggctcacgcctgtaatcccaacactttgggattaaattttgtttaattaacttaaatttatttatttatttgagatggagtcttgctctatcgcccaggccggagtgcagtggtgcaatctcagctcactgcaacctttgcctcctgggttcaagtgattctcctgtctcagcgtccccagtagctgggattacaggcacgtgccaccacacctggctaatttttgtattttttttattagacatggggttttgccatgttggccaggctggtctcgaactcctgacctcaggtgatccgcccaccctggcctcccaaagtgccgggattacaggcgtgagccaccatgcctggccttgtttaataatttaaatgtaaatagccacatgaggtcatattggacggcgccggtctgggccctcacctgggatggctcatctctgctccacgtggcctctcaccctttggaaggctagactagccccagggcacccccaagcaggtagaggtggaagatgcaaggtcccccgaggcctagactcacccagaactcctacaacattgcttttgccaccttctgttggttaaagcaagttgtaaagccagtccagattgaggccaatggagattgaaaaagtcgagctcttgccaggagaagtgccaaagccacatagcagaggtgtgtgtgtacagggaggggaggaatctgcagccatttttggtagtctgtctcatccaggttccaatcccagttctaccaccctgagcatcagtcttctcatctgtacaggattaataccattgattgaaagatgcggccaggcgtggcagctcatgtttgtaatcctagcactttgggaggctgaggcaggtagctcgcttgagcccaggagttcaagatctgggtgggcaacatggcgaaaccccatctctacaagaaatacaaaacttggccaggcgcagtggcccacgcctgtaatcccagcactttgggaggtcgaggagggtggatcatctgagatcaggagttcgagaccagcctgaccaacatggtgaaaccccgtctctactaaaaatacaaaaaattagctgggcgtggtggtgggtgcctgtaatcccagctacttgggaggctgaggcaggagaatcgcctgaacccgggaggccgaggttgcagtgagccaagatcgtgccactgcattccagccccggtgacagtgcaggactccgtctccaataaagaaagaaagaaagaattacaaaacttagccaggcacagtggtgcacacctatagtcctggctacttgggaggctgaggtaggaggatcacttgaggtcggcaggtggaggttgcagtgagttgagatggcatcacttcactccagcctgggtgatagagtgagaccctgtctcaataaaaaagaaaaaaataccatgaattttttatgtacgagtaagaaaatatgtgctgctaattatactagttcagagatgttaaaatctgcaagcacgtccgtgttagaatccagagaatacggttgagcacctgccttatggggctgatgtacagatgaaataagctcacactgttacctggtaggtactcaaagggagacatcacagtcagaagacctccgttctggtccccactctgctgtcactcagcatgtgacactaggcaaatagcctcccttctccaggcctgttttcccatctgcaaagtaggggtgggtgggtaactagcagctgtccccatgccccaactttgccacagctgctgtatgaccattctttgcaaactgtaaagggctgtgcctcctcccccacttccctcccctgtttgtcctccagccctgctccctgccttcctcagtactggtggttgggaagctgggagctcgggcccctgccctgcactgagtcttcttccctgctctcccaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctcctagcctgtgtgcaaaccacccaagcccaccctgaccccagaaccccacagccccactgtggccgcttgatcccccacgccaaccccctggcccattgacccgcctcatctgttcattcacttatctaagctgagggtgtagcaggtaagatgccgcagcccctgcctccaatgtgctggttcagccgggggcagtgcccatgtgaatctggcaaggtgtttaacagtgtgggcttgaaagtccaaaccagctctgtcactctaagtgtgtggccttggggaaatgactcagtttcatctgtgaaatgggattcatcagttaagaggattcagaagctaaaagtgctatcacgagtaaggagcttgaggggaaactgtcacctcgggcaggaccctgactccgcctgaggtgcattttcccagttgtttaggggcgggaaagatttgcaggggtgggggctgcagtgagagccaaagcaaggctgcctggcagcccggacagaggccagggaagcttcctggaacagtcaacacagctgtcccaccagcagtgccggtggagagccagctgtctcctaggccccgatggaggagtcacacccacgctggaaactcactgcccaatgggaaggggttccagcacagcccagggcggtgggcagtgcaagcccctgggcctttatctccactatgggctttctaaggaaggaaccagaacttggaggttttcagttacatggccaacatctcacagcaagtagagagggctggaatggagcccgtgcccttcctgccacaccaccctgcctcctggtgcagaaggcgggggaagccagaaagcctccattccacgcatgcctgcagggccgccttggccacgccccgggccagcagctgacagtgcaggcggagggtagccaggctgaaagctggggtgcctcctgggggagtgcacttggaaagacagaggaatccagtgcctgtcttgggagaatttgggatgcagaggcagaactggagtgggggccttgcggagcggtgctgagtggagtcatgtggcaggtatagctgccgtgcctgagtgtgatcagcagagggcgtgtggagcttggagaatccactcctggcccttagccgagggaagcatggagaggctgattcccacctcagccgcgagcaggttcccaacttagaggaccctgtgacaggcctccgagggcctttggtcgggtttccaaggacctggatttggttggcagtgcggctttgtg

SEQ ID NO: 17582 - DNA, 7594 bp, Human
  misc_feature (1)...(7594): n = A,T,C or G
gtagttgggattacaggcatgcgccaccatgcccaactaatctttgtatttttactagagacagggtttcaccatgttggtcaggctggtcttgaacacctgacctcaggttatccacccgcctcagtctcccaaagtgctggagttacaggcgagagccactgcgcccagccgaggatacctttttttttttttttttaagacagaatatcgctctgttccaggctaaagtgcaaaggcgtgatctcggctcactgcaacctccgcctcccaggttcaagctgttcttctgcctcagcctcccgagtagctgggattacaggcgcctgccaccatgccctgctaatttttgtatttttagtagagatggggtttcaccgtgttggccagactggtctcgaactcctgacctcgtgatccacccgcctcagcctcccaaatgctgggattacagatgtgagccaccgcacccggcctggcagaggatactttttaaggtcaaagacagtagcagaggtggagttcctgggaacagggtcatgaggggaagagggggttcggagggagcgagtagccactggctacctctagaaagggaaggctttggtgcaacatcgttcccctgcagttttactcatctttgcttcctgccctttcatcatccaatcgggcaggcaggacagggcctgagggggcagggatccagtgggtgcctctctagactaaccccagctcaggactcccagagccccttccctgaggccctgctgcccccaagcccagattggggatcccaagcagcacgtaggcagagccagtgaggtccccgttagtcccattgaaagctctaaaaccagcgaaccctcagtccagcctcaggtcaggcatccaggacggcctcagccctcatgggtgagccatctctgcggacactgcacagggcctacgatccatcgctgcctcccgaggatgccagccaggcccccgttgagataactgcttccctgctggacaaggctgggaccagccatctcggtgacagttccagaacccctggcctgggctgctgggttcaatggaaaaaggctgtgactagagtcagggggatggtctcagtgacctcaaggataaggccagatccttgcactgtcagtgacccaaagcaacaggtgtccagagcagcagtgtggcgccttcacgcccccacacatcagcccaactcacccaggacagggactgtagcctcagcactcaacccatgtgccctgtgtggggtctcttcccactgcactcacaggagaggaagggtccctcaggggtccactggggtcccctcctgcaaatggggcaaggagaggggcaaggggctgtctcaaggcccctggagcacatgcaggtcctggactggggctcctgggagggccatgattctgggctccatgagttcagagcagacgccttgtttttccttgtccactgtcagccaccccacccttccctgacccttaaaagaaccaggaaacagcacatgatctgttggaaggaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggtgcagcactccgggaatgtccctcactctccccgtccctctgtcttgcccaatcctgaccaggtgcagaaatcttgccaagtgtttccgcaggagttgctggcaattgcctcacattcctggccttggcaaagaatgaatcaacccaccctagatcccataaatagggccacccaggtgagcctctcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggactctaggagtccagggtccaggtttcagctcactctgtgccaccagggtcccctggtggaaaccatgccccttccccccatccccaccccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgcctcttcccccaggactcccttctggactgatggcctcctgctcctgccccttcaccagtgcaggcccagcctgggccctgctgcccagctagaggggctcatggttccaagctgggcggcccagaggtgccacagggacagagctggaggggtggctcctagggccattcctgggttgtgcctcttatcagtcccttgcagttccaggggaagtggtatgtggtaggcctggcagggaatgcaattctcagagaagacaaagacccgcaaaagatgtatgccaccatctatgagctgaaagaagacaagagctacaatgtcacctccgtcctgtttaggtgagggccgacatctcctgggggtgtgagagtcagactgacgtcacaggcaagggatggccaaagctgagggatcctgtcgttcacctcgctgttctgcccggaattcatctgtgttcatccttcctctgttccttagagcaacgtttatagcacatttccatgcagacacacagacagtggtggggatggacatgcacagtcgttagaaaacaagacggagagaggaggggtgcctgggagcgggaggaggggacactggatccagcctggaaccccacccagtgccttcatggaaggcttccagggaggtggccttaaaagagccaacctgcttcaaaaggaaatgtggggtgttcccggcaggggctggagtcagagagagcccccccttcaggaaggagcaagccatcgcagggtcaccctgagcagagctgctgagcagcctggaggggcaggtggccacgctagcacctagcacggtcctcaggccccgccccagcggatctgctgcggagtggcttagagcagggctcttgggccgcagggtggggagacttggtggggtgcagcctagggggtcgggagaccagcgaaagtgaagcggggccgtcacaggtgtgagagaacaggcgcagggtgaagaggcagggagccagggatcagccgcccccagtgggtttctgactctggcagctgagtggattgggattggggcatttgtggagcaaggagcagaatacagacaggttggggagctcagccctggggtgccaggggatgggaagtgggaggactcaaggatggggtcaggtttgacccgagagctaggggaacggctggcatggagcagactggaagtaccgaggtggatccccgggagagggtataggaagggaagcagcaagctgagtgcaggggagaaatgcagggtttctgtgtgttgggtggcggcgggggtgaaagccacccagggaggcagccaaaggaaagaaggacatcgggtgctggagggtctgagtggggtccaggggccccaggcaggccaggagggacagcctggtgtcagctcagggagaaggcccaggcccatctcggctgggtggggtagggcccctccaggtagtgggggatgagctgtcacgggttgggccggactgagagcaacagaaccctgctgctgccctggccccaccttgtccagcacaggaggcccaagcctgggttgtctcccctctcacccacccatctctccctcccaaggaaaaagaagtgtgactactggatcaggacttttgttccaggttgccagcccggcgagttcacgctgggcaacattaagagtgagtcttgagtgaggtggggcactgagttggggctccggggagctgggtaggggcacagaccttcctgcccctccacacagatgtgttgtatggggagaagcccacgttgatgggctggggagggaggggacagctccctcctcccatccagggcagggctgacccctcaccgtccacgcctgcaggttaccctggattaacgagttacctcgtccgagtggtgagcaccaactacaaccagcatgctatggtgttcttcaagaaagtttctcaaaacagggagtacttcaagatcaccctctacggtgggtcctctcccatcccctcggggactggctcctgatcacacttagtgggaggggaggccggtcccccatgaggaagggatctgaggcctcatctactcattcaacgatatttatgtggtgtctgccggccactcactggccatcttggtcacagggagaaccaaggagctgacttcggaactaaaggagaacttcatccgcttctccaaatctctgggcctccctgaaaaccacatcgtcttccctgtcccaatcggtaatggccagtctggatgaggggacggggacatggggactgttcaggcaggatgcttccctaccagggatcagggagaggagggactccgtcctcagcttcagtcactggagcagtggatggtccaggagctccttggaagccactctgggcccaggaagactgtgccccaccccagggtctatgggactcccagggacccaggccgcaagtgctctttcctggcagtttagcccgggtctgcccagacaaggatttcaggcccaggcctgagtatccatttctcagtctcactggcctgacacctctggccaccctcccaggcccccttgttctgggccatctcccccgaccctcccaggcctcgtcaccctgggttttgctgtcctggctgtcctctctcccctggggacttgctcaccactgacttgggagctgtccttgactccagggagcctggcttgggcaggaggctccagccaggccattcagagagccactggcctcccccaggctgagagactgcctggactggtaaacaggcaggagacctgggtgcccgaggagcctgggagctgggcctcactcagggcagcccctccccaggcctttctcccacatcccctgccctgccatccacccctctgttgccccatctctgaaaggaacccccatatcttctgcagctgggccaggtggggcaggggctgcccaggggcagtgcagaggacctggcagtcagggatcacacacacacactcatacacgcacacacacacacagctgcctgttctgacggactttctccctaacagaccagtgtatcgacggctgagtgcacagtgagtgtggctgggcggctgcgagggggcttgtgggaggccagggtgcagtgggctgggggtcttgggcctgcctttgctcatccccctgccccccagcactgctgctgtctttattctgctgtccccatctcgggtgcctcccatttccccacccatcaccctcatatccacctctgtccagggtgccgccagctgccgcaccagcccgaacaccattgagggagctgggagaccctccccacagtgccacccatgcagctgctccccaggccaccccgctgatggagccccaccttgtctgctaaataaacatgtgccctcaggcctctgagtctacactgtttgacccctgggccttcgaggaaggggaggggcgggaggctcccactggcatcactctcagggtctgcacccccaggatggagcctagcgaacccagcctgggtgttagggctgcagagtgaagacacaagcccctggtcatcaccagcagctttgtggctgaccaccctgagtccttcccacgtggtgtaacaccgtcctccctcctgctgtgacatggcgcccagccccagagcagcggcagttctcacattcccctgcctaggagggtgcccagtccatcgcagacacggtgggccacaccccatcagagtgcgacaggggcatgcacagctggaggctgttccaggcagagggtcggctcggcggggatggtcccctgcccctctgccagcccactgtgggccccgtgggtgaggggccatgtccatgctaaccccgtttcagagcgtgctgccccttaccccacacctccccgcctgatgacatccaggccaccttgggggtgcattctgaagccaggggcagggccagggggaagtgaggaggggctgtgccgccaagaatccaattccccaggactcagagggctccaggcctgcacttatcacttggctgcctgtgtcaggcctgacaagcccctggtcccccactggccgcagaggcaacctctccaggtccgcatcatgcacaggcactccctccccagccccttctccccgtgcaagttcagaggccagagtgggtggggttctgaggaaaccccatggacagacacaccaccccgttcaccctcggctagggttagggttagggttagggnnnnnnnnnnnnnnnnnnnnnnnnnnnnnnnnnnccctcggctgggctaaggagagatgctggcactgtgaaccagccccagcctcggaccccaaggagcaggacaggcctgagacccaggcccaccaaatgctgccaaagcctcggaagtctggtccagactcccggaagaggccagcttggtgcagccccggctttgagagagggatgggactgttcccaagcccagagaggctcaggctgagaaagtcacccagggactgctagctggccaagggggtggaaagtgcacccagcacgcctggcccttgggctccaagtggggcagcagatctagtttcctagcttggcccaagcaaggcagcttcctgtcaccccctgggcctgctgagcctttgaggatcaaacccttagggcctagaagggctttgtgtttccttccaggtcgccataggtttgagtttcctattgccactattgaaagaggcaggatggccagccgcagtggttcacacctgtaatcccagcactttgggaagccgaggcgggcggatcaccaggtcaggatatcgagaccagcctggccaacatggtgaaaccctgtctctactaaaaatacaaaaaaaattgctgagcgtcgcagcgtgcgcctgtagtcccagctgctcaggaggctgaggcaggagaatcacttgaaccctggaggcagaggttgcagtgagctgagactgcgccactgcactccagcctgggcaacagagcgagcgagactccgtctcaaaaaaaaaaaaaaaaaaaaaataagtggcaggaggagacagacaaa

SEQ ID NO: 17583 - DNA, 44960 bp, Human
  misc_feature (1)...(44960): n = A,T,C or G
cctcccatttggctgggattacaggcacccgccaccatgcccagctaattttttgtatttttagtagagacgggggtgggggtggggttcaccatgttggccaggctggtctcgaacttctgacctcagatgatccacctgcctctgcctcctaaagtgctgggattacaggtgtgagccaccatgcccagctcagaatttactctgtttagaaacatctgggtctgaggtaggaagctcaccccactcaagtgttgtggtgttttaagccaatgatagaatttttttattgttgttagaacactcttgatgttttacactgtgatgactaagacatcatcagcttttcaaagacacactaactgcacccataatactggggtgtcttctgggtatcagcgatcttcattgaatgccgggaggcgtttcctcgccatgcacatggtgttaattactccagcataatcttctgcttccatttcttctcttccctcttttaaaattgtgttttctatgttggcttctctgcagagaaccagtgtaagctacaacttaacttttgttggaacaaattttccaaaccgcccctttgccctagtggcagagacaattcacaaacacagccctttaaaaaggcttagggatcactaaggggatttctagaagagcgacccgtaatcctaagtatttacaagacgaggctaacctccagcgagcgtgacagcccagggagggtgcgaggcctgttcaaatgctagctccataaataaagcaatttcctccggcagtttctgaaagtaggaaaggttacatttaaggttgcgtttgttagcatttcagtgtttgccgacctcagctacagcatccctgcaaggcctcgggagacccagaagtttctcgccccttagatccaaacttgagcaacccggagtctggattcctgggaagtcctcagctgtcctgcggttgtgccggggccccaggtctggaggggaccagtggccgtgtggcttctactgctgggctggaagtcgggcctcctagctctgcagtccgaggcttggagccaggtgcctggaccccgaggctgccctccaccctgtgcgggcgggatgtgaccagatgttggcctcatctgccagacagagtgccggggcccagggtcaaggccgttgtggctggtgtgaggcgcccggtgcgcggccagcaggagcgcctggctccatttcccaccctttctcgacgggaccgccccggtgggtgattaacagatttggggtggtttgctcatggtggggacccctcgccgcctgagaacctgcaaagagaaatgacgggcctgtgtcaaggagcccaagtcgcggggaagtgttgcagggaggcactccgggaggtcccgcgtgcccgtccagggagcaatgcgtcctcgggttcgtccccagccgcgtctacgcgcctccgtcctccccttcacgtccggcattcgtggtgcccggagcccgacgccccgcgtccggacctggaggcagccctgggtctccggatcaggccagcggccaaagggtcgccgcacgcacctgttcccagggcctccacatcatggcccctccctcgggttaccccacagcctaggccgattcgacctctctccgctggggccctcgctggcgtccctgcaccctgggagcgcgagcggcgcgcgggcggggaagcgcggcccagacccccgggtccgcccggagcagctgcgctgtcggggccaggccgggctcccagtggattcgcgggcacagacgcccaggaccgcgctccccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcaggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgggcctccccggggtcggcgtccggctggggttgagggcggccggggggaaccagcgacatgcggagagcagcgcaggcgactcagggcgcttcccccgcaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcaggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggtgaggaggtggtggccgtcgagggcccaggccccagagctgaatgcagtaggggctcagaaaagggggcaggcagagccctggtcctcctgtctccatcgtcacgtgggcacacgtggcttttcgctcaggacgtcgagtggacacggtgatctctgcctctgctctccctcctgtccagtttgcataaacttacgaggttcaccttcacgttttgatggacacgcggtttccaggcgccgaggccagagcagtgaacagaggaggctgggcgcggcagtggagccgggttgccggcaatggggagaagtgtctggaagcacagacgctctggcgagggtgcctgcaggttacctataatcctcttcgcaatttcaagggtgggaatgagaggtggggacgagaaccccctcttcctgggggtgggaggtaagggttttgcaggtgcacgtggtcagccaatatgcaggtttgtgtttaagatttaattgtgtgttgacggccaggtgcggtggctcacgccggtaatcccagcactttgggaagctgaggcaggtggatcacctgaggtcaggagtttgagaccagcctgaccaacatggtgaaaccctatctgtactaaaaatacaaaaattagctgggcatggtggtgtgtgcctgtaatcccagctacttgggaggctgaggcaggagaatcacttgaacccaggaggcggaggctgcagtgagctgagattgtgccattgtactccagcctgggcgacaagagtgaaactctgtctttaaaaaaaaaaagtgttcgttgattgtgccaggacagggtagagggagggagataagactgttctccagcacagatcctggtcccatctttaggtatgaagagggccacatgggagcagaggacagcagatggctccacctgctgaggaagggacagtgtttgtgggtgttcaggggatggtgctgctgggccctgccgtgtccccaccctgtttttctggatttgatgttgaggaacctccgctccagcccccttttggctcccagtgctcccaggccctaccgtggcagctagaagaagtcccgatttcaccccctccccacaaactcccaagacatgtaagacttccggccatgcagacaaggagggtgaccttcttggggctcttttttttctttttttctttttatggtggcaaaagtcatataacatgagattggcactcctaacaccgttttctgtgtacagtgcagaattgctaactcggcggtgtttacagcaggttgcttgaaatgctgcgtcttgcgtgactggaagtccctacccatcgaacggcagctgcctcacacctgctgcggctcaggtggaccacgccgagtcagataagcgtcatgcaacccagttttgctttttgtgctccagcttccttcgttgaggagagtttgagttctctgatcaggactctgcctgtcattgctgttctctgacttcagatgaggtcacaatctgcccctggcttatgcagggagtgaggcgtggtccccgggtgtccctgtcacgtgcagggtgagtgaggcgttgcccccaggtgtccctgtcacgtgtagggtgagtgaggcgcggcccccgggtgtccctgtcccgtgcagcgtgattgaggtgtggcccccgggtgtccctgtcacgtgcagggtgagtgaggcgccgtccccgggtgtccctgtcacgtgtagggtgagtgaggcacggcccccgggtgtccctgtcacgtgcagggtgagtgaggcgcggcccccgggtgtccctgtcacgtgcagggtgagtgaggcgcggtccccgggtgtccctgtcacgtgcagggtgagtgaggcgcggtccccgggtgtccctgtcacgtgcagggtgagtgaggcgccgtccccgggtgtccctgtcacgtgcagggtgagtgaggcgccgtccccgggtgtccctgtcacgtgcagggtgagtgaggcgcggtccccgggtgtccctgtcacgtgtagggtgagtgagttgcggcccccgggtgtccctctcaggtgcagggtgagtgaggcgctgtccctgggtgtccctgtctcgtgtagggtgagtgaggctctgtccccaggtgtccttggcgtttgctcacttgagcttgctcctgaatgtttgctctttctatagccacagctgcgccggttgcccattgcctgggtagatggtgcaggcgcagtgctggtccccaagcctatcttttctgatgctcggctcttcttggtcacctctccgttccattttgctacggggacacgggactgcaggctctcgcctcccgcgtgccaggcactgcagccacagcttcaggtccgcttgcctctgttgggcctggcttgctcaccacgtgcccgccacatgcatgctgccaatactcctctcccagcttgtctcatgccgaggctggactctgggctgcctgtgtctgctgccacgtgttgctggagacatcccagaaagggttctctgtgccctgaaggaaagcaagtcaccccagccccctcacttgtcctgttttctcccaagctgcccctctgcttggcccccttgggtgggtggcaacgcttgtcaccttattctgggcacctgccgctcattgcttaggctgggctctgcctccagtcgccccctcacatggattgacgtccagccacaggttggagtgtctctgtctgtctcctgctctgagacccacgtggagggccggtgtctccgccggccttcgtcagacttccctcttgggtcttagttttgaatttcactgatttacctctgacgtttctatctctccattgtatgctttttcttggtttattctttcattccttttctagcttcttagtttagtcatgcctttccctctaagtgctgccttacctgcaccctgtgttttgatgtgaagtaatctcaacatcagccactttcaagtgttcttaaaatacttcaaagtgttaatacttcttttaagtattcttattctgtgatttttttctttgtgcacgctgtgttttgacgtgaaatcattttgatatcagtgacttttaagtattctttagcttattctgtgatttctttgagcagtgagttatttgaacactgtttatgttcaagatatgtagagtatcaagatacgtagagtattttaagttatcattttattattgatttctaactcagttgtgtagtggtctgtataataccaattatttgaagtttgcggagccttgctttgtgatctagtgtgtgcatggtttccagaactgtccattgtaaatttgacatcctgtcaatagtgggcatgcatgttcactatatccagcttattaaggtccagtgcaaagcttctgtctccttctagatgcatgaaattccaagaaggaggccatagtccctcacctgggggatgggtctgttcatttcttctcgtttggtagcatttatgtgaggcattgttaggtgcatgcacgtggtagaatttttatcttcctgatgagtgaatcttttggagacttctatgtctctagtaatctagtaattctttttttaaattgctcttagtactgccacactgggcttcttttgattagtattttcctgctgtgtctgttttctgcctttaatttatatatatatatatattttttttttttttgagacagagtcttggtctgtcgcccagggtgagtgcagtggtgtgatcacaggtcagtgtaacttttaccttctggcctgagccgtcctctcacctcagcctcctgagtagctggaactgcagacacgcaccgctacacctggctaatttttaaattttttctggagacagggtcttgctgtgttgcccaggctggtctcaaactcttggactcaagggatccatctacctcggcttcccaaagtgctgaattacaggcatgagccaccatgcctggcctaattttcaacacttttatattcttatagtgtgggtatgtcctgttaacagcatgtaggtgaatttccaatccagtctgacagtcgttgtttaactggataacctgatttattttcatttttttgtcactagagacccgtctggtgcactctgattctccacttgcctgttgcatgtcctcgttcccttgtttctcaccacctcttgggttgccatgtgcgtttcctgccgagtgtgtgttgatcctctcgttgcctcctggtcactgggcatttgcttttatttctctttgcttagtgttaccccctgatctttttattgtcgttgtttgcttttgtttattgagacagtctcactctgtcacccaggctggagtgtaatggcacaatctcggctcactgcaacctctgcctcctcggttcaagcagttctcattcctcaacctcatgagtagctgggattacaggcgcccaccaccacgcctggctaatttttgtatttttagtagagataggctttcaccatgttggccaggctggtctcaaactcctgacctcaagtgatctgcccgccttggcctcccacagtgctgggattacaggtgcaagccaccgtgcccggcataccttgatcttttaaaatgaagtctgaaacattgctacccttgtcctgagcaataagacccttagtgtattttagctctggccaccccccagcctgtgtgctgttttccctgctgacttagttctatctcaggcatcttgacacccccacaagctaagcattattaatattgttttccgtgttgagtgtttctgtagctttgcccccgccctgcttttcctcctttgttccccgtctgtcttctgtctcaggcccgccgtctggggtccccttccttgtcctttgcgtggttcttctgtcttgttattgctggtaaaccccagctttacctgtgctggcctccatggcatctagcgacgtccggggacctctgcttatgatgcacagatgaagatgtggagactcacgaggagggcggtcatcttggcccgtgagtgtctggagcaccacgtggccagcgttccttagccagtgagtgacagcaacgtccgctcggcctgggttcagcctggaaaaccccaggcatgtcggggtctggtggctccgcggtgtcgagtttgaaatcgcgcaaacctgcggtgtggcgccagctctgacggtgctgcctggcgggggagtgtctgcttcctcccttctgcttgggaaccaggacaaaggatgaggctccgagccgttgtcgcccaacaggagcatgacgtgagccatgtggataattttaaaatttctaggctgggcgcggtggctcacgcctgtaatcccagcactttgggaggccaaggcgggtggatcacgaggtcaggaggtcgagaccatcctggccaacatgatgaaaccccatctgtactaaaaacacaaaaattagctgggcgtggtggcgggtgcctgtaatcccagctactcgggaggctgaggcaggagaattgcttgaacctgggagttggaagttgcagtgagccgacattgcaccactgcactccagcctggcaacacagcgagactctgtctcaaaaaaaaaaaaaaaaaaaaaaaaaaaaattctagtagccacattaaaaaagtaaaaaagaaaaggtgaaattaatgtaataatagattttactgaagcccagcatgtccacacctcatcattttagggtgttattggtgggagcatcactcacaggacatttgacattttttgagctttgtctgcgggatcccgtgtgtaggtcccgtgcgtggccatctcggcctggacctgctgggcttcccatggccatggctgttgtaccagatggtgcaggtccgggatgaggtcgccaggccctcagtgagctggatgtgcagtgtccggatggtgcacgtctgggatgaggtcgccaggccctgctgtgagctggatgtgtggtgtctggatggtgcaggtcaggggtgaggtctccaggccctcggtgagctggaggtatggagtccggatgatgcaggtccggggtgaggtcgccaggccctgctgtgagctggatgtgtggtgtctggatggtgcaggtcaggggtgaggtctccaggccctcggtaagctggaggtatggagtccggatgatgcaggtccggggtgaggtcgccaggccctgctgtgagctggatgtgtggtgtctggatggtgcaggtctggggtgaggtcaccaggccctgcggtgagctgggtgtgcggtgtctggatggtgcaggtctggagtgaggtcgccagacggtgccagaccatgcggtgagctggatatgcggtgtccggatggtgcaggtctggggtgaggttgccaggccctgctgtgagttggatgtggggtgtccggatgctgcaggtccggtgtgaggtcaccaggccctgctgtgagctggatgtgtggtgtctggatggtgcaggtctggggtgaggtcgccaggccctgctgtgagctggatgtgtggtgtctggatggtgcaggtctggagtgaggtcgccaggccctcggtgagctggatgtgcagtgtccagatggtgcaggtccggggtgaggtcgccagaccctgcggtgagctggatgtgcggtgtctggatggtgcaggtctggagtgaggtcgccaggccctcggtgagctggatgtatggagtccggatggtgccggtccggggtgaggtcgccagaccctgctgtgagctggatgtgcggtgtctggatggtacaggtctggagtgaggtctccaggccctgctgtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggttgccaggccctgctgtgagctggatgtgctgtatccggatggtgcagtccggggtgaggtcgccaggccctgctgtgagctggatgtgctgtatccggatggtgcaggtctggggtgaggtcaccaggccctgcggtgagctggttgtgcggtgtccggttgctgcaggtccggggtgagttcgccaggccctcggtgagctggatgtgcggtgtccccgtgtccggatggtgcaggtccagggtgaggtcgctaggcccttggtgggctggatgtgccgtgtccggatggtgcaggtctggggtgaggtcgccaggcctttggtgagctggatgtgcggtgtctgcatggtgcaggtctggggtgaggtcgccaggcccttggtgggctggatgtgtggtgtccggatggtgcaggtccggcgtgaggtcgccaggccctgctgtgagctggatgtgcggtgtctggatggtgcaggtccggggtgaggtagccaaggccttcggtgagctggatgtggggtgtccggatggtgcaggtccggggtgaggtcgccaggccctgcggttagctggatatgcggtgtccggatggtgcaggtccggggtgaggtcaccaggccctgcggttagctggatgtgcggtgtctggatggtgcaggtccggggtgaggtcgccaggccctgctgtgagctggatgtgctgtatccggatggtgcaggtccggggtgaggtcgccaggccctgcagtgagctggatgtgctgtatccggatggtgcaggtctggcgtgaggtcgccaggccctgcggttagctggatatgcggtgtcggatggtgcaggtccggggtgaggtcaccaggccctgcggttagctggatgtgcggtgtccggatggtgcaggtctggggtgaggtcgccaggccctgctgtgagctggatgtgctgtatccggatggtgcaggtccggggtgaggtcgccaggccctgcggtgagctggatgtgctgtatccggatggtgcaggtctggcgtgaggtcgccaggccctgcggtgagctggatgtgcagtgtacggatggtgcaggtccggggtgaggtcgccaggccctgcggtgggctgtatgtgtgttgtctggatggtgcaggtccggggtgagttcgccaggccctgcggtgagctggatgtgtggtgtctggatgctgcaggtccggggtgagttcgccaggccctcggtgagctggatatgcggtgtccccgtgtccgaatggtgcaggtccagggtgaggtcgccaggcccttggtgggctggatgtgccgtgtccggatggtgcaggtctggggtgaggtcgccaggcccttggtgagctggatgtgcggtgtccggatggtgcaggtccggggtgaggtcaccaggccctcggtgatctggatgtggcatgtccttctcgtttaaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcaggtactgtatccccacgccaggcctctgcttctcgaagtcctggaacaccagcccggcctcagcatgcgcctgtctccacttgcctgtgcttccctggctgtgcagctctgggctgggagccaggggccccgtcacaggcctggtccaagtggattctgtgcaaggctctgactgcctggagctcacgttctcttacttgtaaaatcaggagtttgtgccaagtggtctctagggtttgtaaagcagaagggatttaaattagatggaaacactaccactagcctccttgcctttccctgggatgtgggtctgattctctctctcttttttttttcttttttgagatggagtctcactctgttgcccaggctggagtgcagtggcataatcttggctcactgcaacctccacctcctgggtttaagcgattcaccagcctcagcctcctaagtagctgggattacaggcacctgccaccacgcctggctaatttttgtacttttaggagagacggggtttcaccatgttggccaggctggtctcgaactcatgacctcaggtgatccacccaccttggcctcccaaagtgctgggtttacaggctaagccaccgtgcccagcccccgattctcttttaattcatgctgttctgtatgaatcttcaatctattggatttaggtcatgagaggataaaatcccacccacttggcgactcactgcagggagcacctgtgcagggagcacctggggataggagagttccaccatgagctaacttctaggtggctgcatttgaatggctgtgagattttgtctgcaatgttcggctgatgagagtgtgagattgtgacagattcaagctggatttgcatcagtgagggacgggagcgctggtctgggagatgccagcctggctgagcccaggccatggtattagcttctccgtgtcccgcccaggctgactgtggagggctttagtcagaagatcagggcttccccagctcccctgcacactcgagtccctggggggccttgtgacaccccatgccccaaatcaggatgtctgcagagggagctggcagcagacctcgtcagaggtaacacagcctctgggctggggaccccgacgtggtgctggggccatttccttgcatctgggggagggtcagggctttccctgtgggaacaagttaatacacaatgcaccttacttagactttacacgtatttaatggtgtgcgacccaacatggtcatttgaccagtattttggaaagaatttaattggggtgaccggaaggagcagacagacgtggtggtccccaagatgctccttgtcactactgggactgttgttctgcctggggggccttggaggcccctcctccctggacagggtaccgtgccttttctactctgctgggcctgcggcctgcggtcagggcaccagctccggagcacccgcggccccagtgtccacggagtgccaggctgtcagccacagatgcccaggtccaggtgtggccgctccagcccccgtgcccccatgggtggttttgggggaaaaggccaaagggcagaggtgtcaggagactcacgagagctgattctgctccttggctgagctgccctgagcagcctctcccgccctctccatctgaagggatgtggctctttctacctgggggtcctgcctggggccagcgttgggctaccccagtggctgtaccagagggacaggcatcctgtgtggaggggcatgggttcacgtggccccagatgcagcctgggaccaggctccctggtgctgatggtgggacagtcaccctgggggttgaccgccggactgggcgtccccagggttgactataggaccaggtgtccaggtgccctgcaagtagaggggctctcagaggcgtctggctggcatgggtggacgtggccccgggcatggccttcagcgtgtgctgccgtgggtgccctgagccctcactgagtcggtgggggcttgtggcttcccgtgagcttccccctagtctgttgtctggctgagcaagcttcctgaggggctctctattgcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggtggctgtgctttggtttaacttcctttttaaacagaagtgcgtttgagccccacatttggtatcagcttagatgaagggcccggaggaggggccacgggacacagccagggccatggcacggcgccaacccatttgtgcgcacggtgaggtggccgaggtgccggtgcctccagaaaagcagcgtgggggtgtagggggagctcctggggcagggacaggctctgaggaccacaagaagcagccgggccagggcctggatgcagcacggcccgaggtcctggatccgtgtcctgctgtggtgcgcaggctccgtgcgcttccgcttacggggcccggggaccaggccacgactgccaggagcccaccgggctctgaggatcctggaccttgccccacggctcctgcaccccacccctgtggctgcggtggctgcggtgaccccgtcatctgaggagagtgtggggtgaggtggacagaggtgtggcatgaggatcccgtgtgcaacacacatgcggccaggaacccgtttcaaacagggtctgaggaagctgggaggggttctaggtcccgggtctgggtggctggggacactggggaggggctgcttctcccctgggtccctatggtggggtgggcacttggccggatccactttcctgactgtctcccatgctgtccccgccaggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtgggtgccggggacccccgtgagcagccctgctggaccttgggagtggctgcctgattggcacctcatgttgggtggaggaggtactcctgggtgggccgcagggagtgcaggtgaccctgtcactgttgaggacacacctggcacctagggtggaggccttcagcctttcctgcagcacatggggccgactgtgcaccctgactgcccgggctcctattcccaaggagggtcccactggattccagtttccgtcagagaaggaaccgcaacggctcagccaccaggccccggtgccttgcaccccagtcctgagccaggggtctcctgtcctgaggctcagagaggggacacagcccgccctgcccttggggtctggagtggtgggggtcagagagagagtgggggacaccgccaggccaggccctgagggcagaggtgatgtctgagtttctgcgtggccactgtcagtctcctcgcctccactcacacaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtaaggttcacgtgtgatagtcgtgtccaggatgtgtgtctctgggatatgaatgtgtctagaatgcagtcgtgtctgtgatgcgtttctgtggtggaggtacttccatgatttacacatctgtgatatgcgtgtgtggcacgtgtgtgtcgtggtgcatgtatctgtggcgtgcatatttgtggtgtgtgtgtgtgtggcacgtgtgtgtccatggtgtgtgtgcctgtggtgtgcatgtgtgtgtgtctgtgacacgtgcatgttcatgctgtgtgctgcatgtctgtgatgtgcctatttgtggtgtgtgtgtgtgcatgtgtccgtgacatatgcgtgtctatggcatgggtgtgtgtggccccttggccttactccttcctcctccaggcatggtccgcaccattgtcctcacgctctcgggtgctggtttggggagctccacattcagggtcctcacttctagcatgggtgcccctgtcctgtcacagggctgggccttggagactgtaagccaggtttgagaggagagtagggatgctggtggtaccttcctggacccctggcacccccaggaccccagtctggcctatgccggctccatgagatataggaaggctgattcaggcctcgctccccgggacacactcctcccagagcggccgggggccttggggctcggcaggggtgaaaggggccctgggcttgggttcccacccagtggtcatgagcacgctggaggggtaagccctcaaagtcgtgccaggccggggtgcagaggtgaagaagtatccctggagcttcggtctggggagaggcacatgtggaaacccacaaggacctctttctctgacttcttgagctatcgcagctacttgcaaatctcagcagaattttaccctcatggaaagctgatggccaccacctgtgcccaggtgtagaaagtcactagagcccaggagacccccccgtccccaccgcccacctgtgcccgggtgtagaaagtcaccagagcccaggagacccccccccacatccccgctgcagcggaagctaccgcccccaccgtgaccctcgttccgacctcgacctccatggtctccctctcccggtcttcatgtgagtgagatcaggcaggaggtgggttctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttcatgtgtggggtaggtggggatctgtggagttggtttttatgtgtgggggtaggtggggatctgtggagttggttttcatgtgtagggtaggtggagatctgtgggattggttttcatgtgtggggtaggtggggatctgtgggattggttttcatgtgtggggtaggtggggatctgtgggattggtttttatgagtggggtaacacagagttcaaggcgagctttcttcctgtagtgggtctgcaggtgctccaacagctttattgaggagaccatatcttcctttgaactatggtcgggtttatagtaagtcaggggtgtggaggcctcccctgggctccctgttctgtttcttccactctggggtcgtgtggtgcctgctgtggtgtgtggccggtgggcagggcttccaggcctccttgtgttcattggcctggatgtggccctggctacgctccgtccttggaattcccctgcgagttggaggcttgctttctttctttttttctttctttttttttttttttgataacagagtctcgctcttttttgcccaggctggagtggtttggcgtgatcttggctcactgcaacctgtgcttcctgagttcaagcaattctcttgcctcagcctcccaagtagctggaattataggcgcccaccaccatgctgactaatttttgtaattttagtagagacgaggtttctccatgttggccaggctggtctcgaactcctgacctcaggtgatcctcccacctcggcctcccaaagtgctgggatgacaggtgtgaaccgccgcgcccggccgagactcgcttcctgcagcttccgtgagatctgcagcgatagctgcctgcagccttggtgctgacaacctccgttttccttctccaggtctcgctaggggtctttccatttcatgactctcttcacagaagagtttcacgtgtgctgatttcccggctgtttcctgcgtaattggtgtctgctgtttatcgatggcctccttccatttcctttaggctttgtttattgttgtttttccggctccttgaaggaaaagtttcgattatggatgtttgaactttcttttctaaacaagcatctgaagttgccgttttccctctaaagcagggatcccgaggcccctggctgtggagtggcaccggtctggggcctgttaggaacccggcgcacagcgggaggctaggtggggtgtggggagccagcgttcccgcctgagccccgcccctctcagatcagcagtggcatgcggtgctcagaggcgcacacaccctactgagaactgtgcgtgagaggggtctagattctgtgctccttatgggaatctaatgcctgatgatctgaggtggaaccgtttgctcccaaaaccatccccttccccactgctgtcctgtggaaaaatcgtcttccacgaaaccagtccctggtaccacaatggttggggaccctgtgctaaagacctgcttcagcagcctctcgtcagtgttgatatattggcttttctgtgttgagtccagaataattacggatttctgtgatgctttccgccgacctcagacccatgggctatttgtgggcgtgttgcctgctcctgggttgggaagggtgcaggccccatgtaccttcctgttactgccttccaggttggttctcagggttgaatcgtactcgatgtggttttagcccacggccctgccgccagctcctgggggctggggaacatgctgaagcacagagtcaccgtgcgcgtcttttgatgcctcacaagctcgaggcctcctgtgtccgtgttagtgtgtgtcacgtgcctgctcacatcctgtcttggggacgcaggggcttagcaggtcccgtagtaaatgacaagcgtcctgggggagtctgcagaataggaggtgggggtgccggtctctctcccgcgtcttcagactcttctcctgcctgtgctgtggctgcacctgcatccctgcaatccctccagcactgggctggagaggcccgggagctcgagtgccacttgtgccacgtgactgtggatggcagtcggtcacgggggtctgatgtgtggtgactgtggatggcggtcggtcacgggggtctgatgtgtggtgactgtggatggcggtcgtggggtctgatgtgtggtgactgtggatggcgatcggtcacaggggtctgatgtgtggtgactgtggatggtggtcgtggggcctgatgtggtgactgtggatggcggtcgtagggtctgatgtgtggtgactgtggatggcggttgtggggtctgatgtgtggtgactgtggatggcggttgtgggggtctgatgtgtggtgactgtggatggcggtcgtggggtctgatgtggtgactgtggatggcagtcgtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtgtggtgactgtggatggtgatcggtcacaggggtctgatgtgtggtgactgtggatggcggtcgtggggtctgatgtgtggtgactgtggatggtgatcggtcacaggggtctgatgtgtggtgactgtggatggcggtcgtggggtctgatgtgtggtgactgtggatggcggttggtcccgggggtctgatgtgtggtgactgtggatggcgatcggtcacaggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtggtgactgtggatggcggtcgtggggtctgatgtgtggtgactgtggatggcggttggtcccgggggtctgatgtgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtagggtctcatgtggtgactgtggatggcggtcgtggggtctgatgtgtggtgactgtggatggcggtcgtggggtctgatgtggtgactgtggatggcggttgtggggtctgatgtgtggtgactgtggatggcggtcgtggggtctgatgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtggtgactgtggatggcggtcgtggggtctgatgtggtgactgtggatggtgatcggtcacaggggtctgatgtgtggtagctgcaggtggagtcccaggtgtgtctgtagctactttgcgtcctcggccccccggcccccgtttcccaaacagaagcttcccaggcgctctctgggcttcatcccgccatcgggcttggccgcaggtccacacgtcctgatcggaagaaacaagtgcccagctctggccggggcaggccacatttgtggctcatgccctctcctctgccggcaggtctctaccttgacagacctccagccgtacatgcgacagttcgtggctcacctgcaggagaccagcccgctgagggatgccgtcgtcatcgagcaggtctgggcactgccctgcagggttgggcacggactcccagcagtgggtcctcccctgggcaatcactgggctcatgaccggacagactgttggccctggggggcagtggggggaatgagctgtgatgggggcatgatgagctgtgtgccttggcgaaatctgagctgggccatgccaggctgcgacagctgctgcattcaggcacctgctcacgtttgactgcgcggcctctctccagttccgcagtgcctttgttcatgatttgctaaatgtcttctctgccagttttgatcttgaggccaaaggaaaggtgtccccctcctttaggagggcaggccatgtttgagccgtgtcctgcccagctggcccctcagtgctgggtctgaggccaaaggaaacgtgtcccccttcttaggaggacgggccgtgtttgagccacgccccgctgagcgggcctctcagtgctgggtctgtccacgtggccctgtggccctttgcagatgtggtctgtccacgtggccctgtggctctttgcagatgcctgttagcacttgctcggctctaggggacagtcgtgtccaccgcatgaggctcagagacctctgggcgaatttccttggctcccagggtgggggtgggggtggcctgggctgctgggacccagaccctgtgcccggcagctgggcagcaactcctggatcacatatgccatccgggccacggtgggctgtgtgggtgtgagcccagctggacccacaggtggcccagaggagacgttctgtgtcacacactctgcctaagcccatgtgtgtctgcagagactcggcccggccagcccacgatggccctgcattccagcccagccccgcacttcatcacaaacactgaccccaaaagggacggagggtcttggccacgtggtcctgcctgtctcagcacccaccggctcactcccatgtgtctcccgtctgctttcgcagagctcctccctgaatgaggccagcagtggcctcttcgacgtcttcctacgcttcatgtgccaccacgccgtgcgcatcaggggcaagtgagtcaggtggccaggtgccattgccctgcgggtggctgggcgggctggcagggcttctgctcacctctctcctgccccttccccactgcccttctgcccggggccaccagagtctccttttctggcccccgccccctccggctcctgggctgcaggctcccgaggccccggaaacatggctcggcttgcggcagccggagcggagcaggtgccacacgaggcctggaaatggcaagcggggtgtggagttgctcctgcgtggaggacgaggggcggggggtgtgtctgggtcaggtgtgcgccgagcgtttgagcctgcagcttgtcagctccaagttactactgacgctggacacccggctctcacacgcttgtatctctctctcccgatacaaaaggattttatccgattctcattcctgtccctgtcgtgtgacccccgcgagggcgcgggctcttctctctgtgactagatttcccatctggaaagtgcggggttgaccgtgtagtttgctcctctcggggggcctgtggtggccatggggcaggcggcctgggagagctgccgtcacacagccactgggtgagccacactcacggtggtagagccacagtgcctggtgccacatcacgtcctctggattttaagtaaaaccacacacctcccggcaggcatctgcctgcgaccctgtgtgtgcctggggagagtggtagcacggaggaaattcgtgcacactcaaggtcatcagcaaggtcatccgcagtcaggtggaacgtggaggcctctctctgggatcgtctccagcggataaaggactgtgcacagcttcggaagcttttatttaaaaatataactattaattattgcattataagtaatcactaatggtatcagcaattataatatttattaaagtataattagaaatattaagtagtacacacgttctggaaaaacacaaattgcacatggcagcagagtgaattttggccgagggacacgtgtgcacatgtgtgtaagcggcccccaggcccacagaattcgctgacaaagtcacctccccagagaagccaccacgggcctccttcgtggtcgtgaattttattaagatggatcaagtcacgtaccgtccacgtgtggcagggctttggggaatgtgaggtgatgactgcgtcctcatgccctgacagacaggaggtgactgtgtctgtcctgtccctaggacacggacaggcccgaagctctagtccccatcgtggtccagtttggcctctgaataaaaacgtcttcaaaacctgttgccccaaaaactaagaacagagagagtttcccatcccatgtgctcacaggggcgtatctgcttgcgttgactcgctgggctggccggactcctagagttggtgcgtgtgcttctgtgcaaaaagtgcagtcctcttgcccatcactgtgatatctgcaccagcaaggaaagcctcttttcttttctttctttttttttttttgagacggaacgtcactgttgtctgcctgggcttgagtgcagtggcgcgatctcaactcactgcaacctccgcctcccgggttccagcatttctcctgcctcagcctcccgagcagctgagattacaggcacccaccccctgcgcctggctaatttttgtatttttagtagagaggggtttttgccatgttggccaggctggtctcgaactcctgacctcaggtgatccacccacctcggcctcccaaagtgctgggattacaggtgtgagccatcacgcccagccggaaagcctctttttaaggtgaccacctatagcgcttcccgaaaataacaggtcttgtttttgcagtaggctgcaagcgtctcttagcaacaggagtggcgtcctgtgggctctggggatggctgagggtcgcgtggcagccatgccttctgtgtgcacctttaggttccacggggctattctgctctcactgtttgtctgaaaacgcacccttggcatccttgtttggagagtttctgcttctcgttggtcatgctgaaactaggggcaaggttgtatccgttggcgcgcagcggctacatgtagggtcatgagtctttcaccgtggacaaattccttgaaaaaaaaaaaaggagtccggttaagcattcattccgggtcaagtgtctggttctgtgaataaactctaagatttaagaaaccttaatgaaagaaaaccttgatgattcagagcaaggatgtggtcacacctgtggctggatctgtttcagccgccccagtgcatggtgagagtggggagcagggattgtttgttcagaggtctcatctggtatgtttctgaggtgtttgccggctgaatggtagacgtgtcgtttgtgtgtatgaggttctgtgtctgtgtgtggctcggtttgagtgtacgcatgtccagcacatgccctgcccgtctctcacctgtgtcttcccgccccaggtcctacgtccagtgccaggggatcccgcagggctccatcctctccacgctgctctgcagcctgtgctacggcgacatggagaacaagctgtttgcggggattcggcgggacgggtgaggcctcctcttccccaggggggcttgggtgggggttgatttgcttttgatgcattcagtgttaatattcctggtgctctggagaccatgactgctctgtcttgaggaaccagacaaggttgcagccccttcttggtatgaagccgcacgggaggggttgcacagcctgaggactgcgggctccacgcaggctctgtccagcggccatgtccagaggcctcagggctcagcaggcgggagggccgctgccctgcatgatgagcatgtgaattcaacaccgaggaagcacaccagcttctgtcacgtcacccaggttccgttagggtccttggggagatggggctggtgcagcctgaggccccacatctcccagcaggccctcgacaggtggcctggactgggcgcctcttcagcccattgcccatcccacttgcatggggtctacacccaaggacgcacacacctaaatatcgtgccaacctaatgtggttcaactcagctggcttttattgacagcagttacttttttttttttaatactttaagttctagggtacatgtgcacgacgtgcaggttagttacatatgtatacatgtgccatgttggtgtgctgcacccattaactcatcatttacattaggtatatctcctaatgctatccctccccactccccccatcccatgacaggccctggtgtgtgatgttccccaccctgtgtccaagtgttctcattgttcagttcccacctgtgagtgagaacatgtggtgtttggttttctttccttgcaatagtttgctcagagtgatggtttccagcttcgtccatgtccctacaaaggacatgaactcatccttttttatgactgcatagtattccgtggtgtatatgtgccacattttcttaatccagtctatcatcgatggacatttgggttggttgcaagtctttgctactgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacactcccaccaacagtgtaaaagtgttctggtgctggagaggatgtggacagcagttatttttttatgaaaatagtatcactgaacaagcagacagttagtgaaggatgcgtcaggaagcctgcaggccacacagccatttctctcgaagactccgggtttttcctgtgcatcttttgaaactctagctccaattatagcatgtacagtggatcaaggttcttcttcattaaggttcaagttctagattgaaataagtttatgtaacagaaacaaaaatttcttgtacacacaacttgctctgggatttggaggaaagtgtcctcgagctggcggcacactggtcagccctctgggacaggatacctctggcccatggtcatggggcgctgggcttgggcctgagggtcacacagtgcaccatgcccagcttcctgtggataggatctgggtctcggatcatgctgaggaccacagctgccatgctggtaaagggcaccacgtggctcagagggggcgaggttcccagccccagctttcttaccgtcttcagttatttttccctaagagtctgagaagtggggccgcgcctgatggccttcgttcgtcttcagctggcacagaattgcacaagctgatggtaaacactgagtacttataatgaatgaggaattgctgtagcagttaactgtagagagctcgtctgttggaaagaaatttaagtttttcatttaaccgctttggagaatgttactttatttatggctgtgtaaattgtttgacattcagtccctcgtagacagatactacgtaaaaagtgtaaagttaaccttgctgtgtattttcccttattttaggctgctcctgcgtttggtggatgatttcttgttggtgacacctcacctcacccacgcgaaaaccttcctcaggtgaggcccgtgccgtgtgtctgtggggacctccacagcctgtgggctttgcagttgagccccccgtgtcctgcccctggcaccgcagcgttgtctctgccaagtcctctctctctgccggtgctggatccgcaagagcagaggcgcttggccgtgcacccaggcctgggggcgcaggggcaccttcgggagggagtgggtaccgtgcaggccctggtcctgcagagacgcacccaggttacacacgtggtgagtgcaggcggtgacccggctcctgctgctctttggaaagtcaagagtggcggctcctggggccccagtgagacccccaggagctgtgcacagggcctgcagggccgaggcggcagcctcctccccagggtgcacctgagcctgcggagagcaggagctgctgagtgagctggcccacagcgttcgctgcggtcacgttcctgcgtggggttgtttgggatcggtgggagaatttggatttgctgagtgctgctgtcttgaaccacggagatggctaggagtgggtttcagagttgatttttgtgaatcaaactaaaatcaggcacaggggacctggcctcagcacaggggattgtccaatgtggtccccctcaagggcgccccacagagccggtgggcttgttttaaagtgcgatttgacgagggacgagaaaccttgaaagctgtaaagggaaccctcagaaaatgtggccgccaggggtggtttcaggtgctttgctgggctgtgtttgtgaaaacccatttggacccgccctccaagtccaccctccaggtccaccctccagggccgccctgggctgggggtatgcctggcgttccttgtgccgcagcccggagcacagcaggctgtgcacatttaaatccactaagattcactcggggggagcccaggtcccaagcaactgagggctcaggagtcctgaggctgctgaggggacagagcagacggggaacgctgcttctgtgtggcaagttcctgagggtgctggccagggaggtggctcagagtgtatgttggggtcccaccgggggcagaactctgtctctgatgagtcggcagccatgtaacaggaaggggtggccacagggagctgggaatgcaccaggggagctgcgcagctggccgaggtcccagggccaggccacaggaagggcagggggacgcccggggccacagcagaggccgcaggaagggaaggggatgcccaggccagagcagaggctaccgggcacaggggggctccctgagctgggtgagcgaggctcatgactcggcgagggaacctccttgacgtgaagctgacgactggtgttgcccagctcacagcccagccaggtcccgcgcctgagcaggaactcagaaccctcccctttgtctaaagcacagcagatgccttcagggcatctaggagaaaacaggcaaagtcgttgagaaacgtcttaaaagaaggtgggatggtggcaatttcttgtccagattttagtctgccccggaccacagatgagtctataacgggattgtggtgttgccatggggacacatgagatggaccatcacagaggccactggggctgcacctcccatctgagtcctggctgtcccgggtccaggccaggttcttgcatgctcacctacctgtcctgcccgggagacagggaaagcaccccgaagtctggagcagggctgggtccaggctcctcagagctcctgccaggcccagcaccctgctccaaatcaccacttctctggggttttccaaagcatttaacaagggtgtcaggttacctcctgggtgacggccccgcatcctggggctgacattgcccctctgccttaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccaggtgagcgcacctggccggaagtggagcctgtgcccggctggggcaggtgctgctgcagggccgttgcgtccacctctgcttccgtgtggggcaggcgactgccaatcccaaagggtcagaggccacagggtgcccctcgtcccatctggggctgagcagaaatgcatctttctgtgggagtgagggtgctcacaacgggagcagttttctgtgctattttggtaaaaggaaatggtgcaccagacctgggtgcactgaggtgtcttcagaaagcagtctggatccgaacccaagacgcccgggccctgctgggcgtgagtctctccaaacccgaaacacaggggccctgctgggcatgagtccctctgaacccgagaccctggggccctgctgggcgtgagtctctccgaacccagagacttcagggcccttttgggcgtgagtctctccactgtgagccccacactccaaggctcatccacagtctacaggatgccatgagttcatgatcacgtgtgacccatcaggggacagggccatggtgtggggggggtctctacaaaattctggggtcttgtttccccagagcccgagagctcaaggccccgtctcaggctcagacacaaatgaattgaagatggacacagatgcagaaatctgtgctgtttcttttatgaataaaaagtatcaacattccaggcagggcaaggtggctcacacctataatcccagcactttgggaggccgaggtgggtggatcacttgaggccaggagtttgaggccaacctaaccaacatagtgaaattccatttctacttaaaaaatacaaaaattagcctggcctggtggcacacgcctgtagtccccgctatgcgggaggctgaggcaggagaatcatttgaacccaggaggcagaggttgcagtgagccgagatcacaccactgcactccagcctgggcaacagagtgagacttcatcttaaaaaaaaaaaaaaaagtatcagcattccaaaaccatagtggacaggtgtttttttattctgtccttcgataatatttactggtgctgtgctagaggccggaactgggggtgccttcctctgaaaggcacaccttcatgggaagagaaataagtggtggatggttgttaaaccagaggtttaaactggggtcctgtcgttctgagttaacagtccagatctggactttgcctctttccagaatgctccctggggtttgcttcatgggggagcagcaggtgtggacaccctcgtgatgggggagcagcaggtgcagacgccctcatgatgggggagtggcaggtgcagacacccttgtgcatggtgcccagcatgtccctgttgcagctccctccccacaaggatgccggtctcctgtgctccccacagtccctgcttccctctcacagccttacctggtcctggcctccactggctttgtctgcatgatttccacatttcctgggctcccagcacctcttcgcctctcccaggcacctctgcagtgctggccataccagtcagctgtgaactgtccactgcttattttgctccccatgaaatgtattttttaggacaggcacccctggttccagcctctggcacagcatcagtgaatgttattgaaggacaaaggacagacaaacaaatcaggaaaatgggttctctctaaacacattgcaaagccacagaggctagtgcaggatgggtgggcatcaggtcatcagatgtgggtccaatgccagaatattctgtgctcccaaaggccacttggtcagagtgtgtgcttgcagaggtggctctaaaagctcagcagtggaggcagtggttcgccatactcagggtgaactcacatcctctgtgtctgaagtatacagcagaggcttgaagggcatctgggagaagaaaacaggcaaaatgattaagaaaagtgaaaaaggaaaagtggtaagatgggaattttcttgtccagattttagtctcccaaaccacagctcagatggtagaatgtggtcagaactgatggacagaacaatagaacaaaacggaagccctatctctcagaaacgtgtgttaatgtggtatgtggcacagctgatggaaaagagagtgtgtgtgtaatttttttttctgagaaaactgactggaagcaaataagttgtgtctttacagcatataccagagcagattctaggtagaagaggagacacatgcaaacaacaccagcaacagaaataaaacaaaagactcaaagggaagggaggtgaacgttccctggtttggtgttggggaaggacacacagggaggcggatgaaaccagtgaggcaacgggcattgctttcactgcagagaaactcagcttgcctgagccacagtgaaaatggccattccctggagcgtttgtgcacgtgatttatttaaggcgccctgtgaggtcctgcacattcatcctctcactttgttctcctaaccacctgagaggtagaggaggaaaggctccaggggagcagccgcccttggtcacccagctggcaaagggcatgcatgattgcagcctggcctcctgctccggggcccttgctctgcccgaggaccccacacaagtcagacccataggctcagggtgagccggagcccaaggtcgtgttggggatggctgtgaaagaagaaatggacgtctgatgcacacttgggaaggtcctaccagcagcgtcaaagaaatgcatgtgaaactgacagcgagacccatccctcaaagaaacgcacgtgaaactgatggcgagacctgtccccatccctcatgctggctccttttctgggcttgccaagagccagcatcaggttgaggcaagctggaaagacttttctggaaagcagcttgtttgcatggaagtcctcacaatgtcctgtgtcttcccagtaattccacttctgaagtgaccagacattatcacgggtcttatttaccatttccagtgttccaggcagggggacttgccacagcaagtcacgaacctgcccaaatacagggctaaggagatattatgcatcacaaaacttgctctgccattaaacatttttcaaagaatttttgaagaatgtttaatggcacaaaacgtttatttcaatgtagcagtgttcaaagctggatgtaaaagaacacaccccaggagcctgccgtggatgtcatgtgtgttcatctttggacatggacatacatgggcagtgagtggtggtgaggccctggaggacatcggtgggatgcctccatcctgcccctctggagacaccatgtgtgccacgtgcactcactggagccctgtttagctggtgccacctggctcttccatccctgagattcaaacacagtgagattccccacgcccaactcagtgttctcccacaaaaaacctgagtcacacctgtgttcactcgagggacgcctgggagccagggctccacagtttattatgtgtttttggctgagttatgtgcagatctcatcagggcagatgatgagtgcacaaacacggccgtgcgaggtttggatacactcaacatcactagccaggtcctggtggagtttggtcatgcagagtctggatggcatgtagcatttggagtccatggagtgagcacccagccccctcgggctgcagcgcatgccccaggcaggacaaggaagcgggaggaaggcaggaggctctttggagcaagctttgcaggagggggctgggtgtggggcaggcacctgtgtctgacattcccccctgtgtctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgagcaggctgatggtcagcacagagttcagagttcaggaggtgtgtgcgcaagtatgtgtgtgtgtgtgtgcgcgcgtgcctgcaaggctgatggtgactggctgcacgtaagagtgcacatgtacgcatatacacgtgagcacatacatgtgtgcatgtgtgtacatgaaggcatggcagtgtgtgcacaggtgtgcaagggcacaagtgtgtgcacatgcgaatgcacacctgacatgcatgtgtgttcgtgcacagtcgtgtgggcattcacgtgaggtgcatgcgtgtgggtgtgcagtgtgagtagcatgtgtgcacataacatgtattgaggggtcctcgtgttcaccccgctaggtcctcagcaccagtgccactccttacagggtgagacggggtcccaggccttggtgggctgaggctctgaagctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgatggtgactggctgcacgtaagagtgcacatgtacgcatatacacgtgagcacatacatgtgtgcatgtgtgtacatgaaggcatggcagtgtgtgcacaggtgtgcaagggcacaagtgtgtgcacatgcgaatgcacacctgacatgcatgtgtgttcgtgcacagtcgtgtgggcattcacgtgaggtgcatgcgtgtgggtgtgcagtgtgagtagcatgtgtgcacataacatgtattgaggggtcctcgtgttcaccccgctaggtcctcagcaccagtgccactccttacagggtgagacggggtcccaggccttggtgggctgaggctctgaagctgcagccctgagggcattgtcccatctgggcatccgcgtccactccctctcctgtgggcttctgtgtccactccccctctcctgtgggcatttacatccactccactccctctctcctgtgggcatccgcgtccactccccctctctgtgggcatctgcgtccacctcccctctctgtgggcatttgcgtccactccctctcctggttccttcctgtcttggccgagcctcgggggcaggcagatgacacagagtcttgactcgcccagggtggttcgcagctgccgggtgagggccaggccggatttcactgggaagagggatagtttcttgtcaaaatgttcctctttcttgttccatctgaatggatgataaagcaaaaagtaaaaacttaaaatcccagagaggtttctaccgtttctcactctttcttggcgactctaggtgaacagcctccagacggtgtgcaccaacatctacaagatcctcctgctgcaggcgtacaggtgagccgccaccaaggggtgcaggcccagcctccagggaccctccgcgctctgctcacctctgacccggggcttcaccttggaactcctgggttttaggggcaaggaatgtcttacgttttcagtggtgctgctgcctgtgcacagttctgttcgcgtggctctgtgcaaagcacctgttctccatctctgggtagtggtaggagccggtgtggccccaggtgtccccactgtgcctgtgcactggccgtgggacgtcatggaggccatcccagggcagcaggggcatggggtaaagagatgtttatggggagtcttagcagaggaggctgggaaggtgtctgaacagtagatgggagatcagatgcccggaggatttggggtctcagcaaagagggccgaggtgggtgcaggtgagggtcgctggccccacccccgggaaggtgcagcagagctgtggctccccacacagcccggccagcacctgtgctctgggcatggctgtgctcctggaacgttccctgtcctggctggtcagggggtgcccctgccaagaatcgacaactttatcacagagggaagggccaatctgtggaggccacagggccagcttctgcctggagtcagggcaggtggtggcacaagcctcggggctgtaccaaagggcagtcgggcaccacaggcccgggcctccacctcaacaggcctcccgagccactgggagctgaatgccaggaggccgaagccctcgccccatgagggctgagaaggagtgtgagcatttgtgttacccagggccgaggctgcgcgaattaccgtgcacacttgatgtgaaatgaggtcgtcgtctatcgtggaaacccagcaagggctcacgggagagttttccattacaaggtcgtaccatgaaaatggtttttaacccgagtgcttgcgccttcatgctctggcagggagggcagagccacagctgcatgttaccgcctttgcaccagctccagaggcttgggaccaggctgtctcagttccagggtgcgtccggctcagaccgccctcctctctgccttctctctctgcctcaaatcttccctcgtttgcatctccctgacgcgtgcctgggccctcgtgcaagctgcttgactcctttccggaaacccttggggtgtgctggatacaggtgccactgaggactggaggtgtctgacactgtggttgaccccagggtccagctggcgtgcttggggcctccttgggccatgatgaggtcagaggagttttcccaggtgaaaactcctgggaaactcccagggccatgtgacctgccacctgctcctcccatattcagctcagtcttgtcctcatttccccaccagggtctctagctccgaggagctcccgtagagggcctgggctcagggcagggcggctgagtttccccacccatgtggggacccttgggtagtcgcttgattgggtagccctgaggaggccgagatgcgatgggccacgggccgtttccaaacacagagtcaggcacgtggaaggcccaggaatccccttccctcgaggcaggagtgggagaacggagagctgggccccgatttcacggcagccaggctgcagtgggcgaggctgtggtggtccacgtggcgctgggggcggggtctgattcaaatccgctggggctcggccttcctggcccgtgctggccgcgcctccacacgggcttggggtggacgccccgacctctagcaggtggctatttctccctttggaagagagcccctcacccatgctaggtgtttccctcctgggtcaggagcgtggccgtgtggcaaccccgggaccttaggcttatttatttgtttaaaaacattctgggcctggcttccgttgttgctaaatggggaaaagacatcccacctcagcagagttactgagaggctgaaaccggggtgctggcttgactggtgtgatctcaggtcattccagaagtggctcaggaagtcagtgagaccaggtacatggggggctcaggcagtgggtgagatgaggtacacggggggctcaggcagtgggtgaggccaggtacatggggggctcaggcactgggtgagatgaggtacacggggggctcaggcagagggtcagaccaggtacacgggggctctgatcacacgcacatatgagcacatgtgcacatgtgctgtttcatggtagccaggtctgtgcacacctgccccaaagtcccaggaagctgagaggccaaagatggaggctgacagggctggcgcggtggctcacacctgtagtcccagcactttgggaggccgaggcgagaggatcccttgagcccaggagtttaagaccagcctgagcaacatagtagaaccccatctctatgaaaaataaaaacaaaaattagctgagcatggtggtgtgcgcctgtagttccaatacttgggaggctgaagtgggaggatcacttgagcccaggaggtggaagctgcagtgagctgagattgcaccactgtactgcagcctgggtgacagagtgagagcccatctcaacaacaacaaagaagactgacaaatgcagtttcttggaaagaaacatttagtaggaacttaacctacacacagaagccaagtcggtgtctcggtgtcagtgagatgagatgatgggtcctcacaccatcaccccagacccagggtttatgcaccacaggggcgggtggctcagaagggatgcgcaggacgttgatatacgatgacatcaaggttgtctgacgaagggcaggattcatgataagtacctgctggtacacaaggaacaatggataaactggaaaccttagaggccttcccggaacaggggctaatcagaagccagcatggggggctggcatccaggatggagctgcttcagcctccacatgcgtgttcatacagatggtgcacagaaacgcagtgtacctgtgcacacacagacacgcagctactcgcacacacaagcacacacacagacatgcatgcatgcatccgtgtgtgtgcacctgtgcccatgaggaaacccatgcatgtgcattcatgcacgcacacaggcaccggtgggcccatgcccacacccacgagcaccgtctgattaggaggcctttcctctgacgctgtccgccatcctctcaggtttcacgcatgtgtgctgcagctcccatttcatcagcaagtttggaagaaccccacatttttcctgcgcgtcatctctgacacggcctccctctgctactccatcctgaaagccaagaacgcaggtatgtgcaggtgcctggcctcagtggcagcagtgcctgcctgctggtgttagtgtgtcaggagactgagtgaatctgggcttaggaagttcttaccccttttcgcatcaggaagtggtttaacccaaccactgtcaggctcgtctgcccgccctctcgtggggtgagcagagcacctgatggaagggacaggagctgtctgggagctgccatccttcccaccttgctctgcctggggaagcgctggggggcctggtctctcctgtttgccccatggtgggatttggggggcctggcctctcctgtttgccctgtggtgggattgggctgtctcccgtccatggcacttagggcccttgtgcaaacccaggccaagggcttaggaggaggccaggcccaggctaccccacccctctcaggagcagaggccgcgtatcaccacgacagagccccgcgccgtcctctgcttcccagtcaccgtcctctgcccctggacactttgtccagcatcagggaggtttctgatccgtctgaaattcaagccatgtcgaacctgcggtcctgagcttaacagcttctactttctgttctttctgtgttgtggaaatttcacctggagaagccgaagaaaacatttctgtcgtgactcctgcggtgcttgggtcgggacagccagagatggagccaccccgcagaccgtcgggtgtgggcagctttccggtgtctcctgggaggggagctgggctgggcctgtgactcctcagcctctgttttcccccagggatgtcgctgggggccaagggcgccgccggccctctgccctccgaggccgtgcagtggctgtgccaccaagcattcctgctcaagctgactcgacaccgtgtcacctacgtgccactcctggggtcactcaggacaggcaagtgtgggtggaggccagtgcgggccccacctgcccaggggtcatccttgaacgccctgtgtggggcgagcagcctcagatgctgctgaagtgcagacgcccccgggcctgaccctgggggcctggagccacgctggcagccctatgtgattaaacgctggtgtccccaggccacggagcctggcagggtccacaacttcttgaacccctgcttcccatctcaggggcgatggctccccacgcttgggagccttctgacccctgacctgtgtcctctcacagcctcttccctggctgctgccctgagctcctggggtcctgagcaagttctctccccgccccgccgctccagcgtcactgggctgcctgtctgctcgccccggtggaggggtgtctgtcccttcactgaggttcccaccagccagggccacgaggtgcaggccctgcctgcccggccacccacacgtcctaggagggttggaggatgccacctctggcctcttctggaacggagtctgattttggccccgcagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaatctcatgtttgaatcctaatgtgcactgcatagacaccactgtatgcaattacagaagcctgtgagtgaacggggtggtggtcagtgcgggcccatggcctggctgtgcatttacggaagtctatgagtgaatggggttgtggtcagtgcgggcccatggcctggctgggcctgggaggtttctgatgctgtgaggcaggaggggaaggagggtaggggatagacagtgggagcccccaccctggaagacataacagtaagtccaggcccgaagggcagcagggatgctgggggcccagcttgggcggcggggatgatggagggcctggccagggtggcagggatgatgggggccccagctggggtggcaggggtgatggggggggctggtctgggtggcggggaagatggggaagcctggctgggccccctcctcccctgcctcccacctgcagccgtggatccggatgtgcttccctggtgcacatcctctgggccatcagctttcatggaggtggggggcaggggcatgacaccatcctgtataaaatccaggattcctcctcctgaacgccccaactcaggttgaaagtcacattccgcctctggccattctcttaagagtagaccaggattctgatctctgaagggtgggtagggtggggcagtggagggtgtggacacaggaggcttcagggtggggctggtgatgctctctcatcctcttatcatctcccagtctcatctctcatcctcttatcatctcccagtctcatctgtcttcctcttatctcccagtctcatctgtcatcctcttaccatctcccagtctcatctcttatcctcttatctcctagtctcatccagacttacctcccagggcgggtgccaggctcgcagtggagctggacatacgtccttcctcaggcagaaggaactggaaggattgcagagaacaggaggggcggctcagagggacgcagtcttggggtgaagaaacagcccctcctcagaagttggcttgggccacacgaaaccgagggccctgcgtgagtggctccagagccttccagcaggtccctggtggggccttatggtatggccgggtcctactgagtgcaccttggacagggcttctggtttgagtgcagcccggacgtgcctggtgtcggggtgggggcttatggccactggatatggcgtcatttattgctgctgcttcagagaatgtctgagtgaccgagcctaatgtgtttatggtgggcccaagtccacagactgtgtcgtaaatgcactctggtgcctggagcccccgtataggagctgtgaggaaggaggggctcttggcagccggcctgggggcgcctttgccctgcaaactggaagggagcggccccgggcgccgtgggcggacgacctcagtgggaggttggacagaacagggcggggactcccaggagcagaggccgctgctcaggcacacctgggtttgaatcacagaccaacaggtcaggccattgttcagctatccatcttctacaaagctccagattcctgtttctccgggtgttttttgttgaaattttactcaggattacttatattttttgctaaagtattagacccttaaaaaaggtatttgctttgatatggcttaactcactaagcacctactttatttgtctgtttttatttattattattattattattagagatggtgtctactctgtcacccaggttgttagtgcagtggcacagtcatggctcgctgtagccgcaaacccccaggctcaagtgatcctccggcctcagcttcccagagtgctgggattacaggtgtgagccactgcccttgcctggcacttttaaaaaccactatgtaaggtcaggtccagtggcttccacacctgtcatcccagtagtttgggaagccgaggcagaaggattgtctgaggccaggagtttgagaccagcatgggtaacatagggagaccccat

SEQ ID NO: 17584 - DNA, 7571 bp, Human; identical to SEQ ID NO: 12878
  misc_feature (1)...(7571): n = A,T,C or G

SEQ ID NO: 17585 - DNA, 29434 bp, Human
gatagacagcatatctgtggtattaaaatttcacggagagacattgggaaaaatatctaaaaaggctctttaggaccgtgataatgataaaaaaagattgagaaacattactatggagaatatgattttgtatatgaggctcaagataaagaaagatcttaaggagatagattaaaataaacaaggcaatggtttttgagaatgaatacaaagcccagcatccaggtaaaattaaaagtcaattgtacaaacctagaatcaggcacatagtagtagttcatgcaagaaacaacagaggattttgattaagctacgggctgcacactgagtagatttatgctcaaaagacaactagagtggcaaaaagtctgtaaaccatgtcctatgaggcatggtttgaaagaactgaggatatttagcccagaggatgaatgacttggcgtgacatgctagatattttaaagggctgtcatgtgaaagaggaattagaaattgtttgtgtgaagctattttttcctcaacctaaggaagacccttttaacaattaggaaatgatcaaatatggaataagctgttttgcatagggatgagtttctcagactgtcagaaggatatttctgcactgagcaagaggataaacatggcttctaaggttccttccaattcccaggttctgtgattccctgctagatttacaagtatgaaggtggaaaagatggctaaagaatatgagcccagacaaaacatcctccgttgattttaaaaccaaaattccataccagggatatttgcttgaggactatctcactgtctagctgaatggttgccaatatttagaggcctaattgccctggacccctgtttccttgtgccctacctctagctgaatttccatcttggcatagaaggtacagagggagttgtagggaaatgccaagaaggagatctcagagaccagagttatagaaatgctcagaactgttttatgaaaacattggtatgggcccagtgagtggagagagaacatgcttcctgtccttgttgagctctatgttgctcacttgttatccccaaccccccttatctcttacatcttcaactagccagcaggagggttggtgcaggaggaggggtagaaggaagtaatttcaggttcaagggttaacagtacactggtcaggaaagctgaggaatgagatgatgagcatctttacagtttgtgaaaatgaaacaaacaaaacaacttgagaatcatgttcctggaattgtgtccaaatgaatgtctcaggttgaagggaccaggactttgactgtgatgcagtatagtatttatagggatcttgcttggcctttcagagcaaaaacaattattttctctcctctcacctaacacagctgtgcagaatcttcatagcctggttgctagaaattagggttcttatagctgctgtggaataaactccattcactttcctcttaacaatcccttctctctgtctttgaccaaatgttacctgttgtttcacgaagtgaccttttcttcattgcaccccattagctgctctttcactcccagtcacttcctgaagtcctcatcactatcacagatctgcctaccagggccatgtctgaccagggccatgtctgcagcctagcccatattaactttgccaacacttcaccatttttctctgcatgtcctctctctagtaatgtgcatgtctgtgatattaaccctgggacagaaaagtaagaaatctatcagaatcctcgctgaaagtcttatttctccttgaaaccgaaagagctttcaaacgtggcttcctgagtttttcagtttgctggtgggtgggtctggagtgggcatcccgtctgcacatctggtagaggcactttccacattttcctcatgactcaggatcagtttctgactgctgggcggggcaaagcctcctgaagttgctgcgaggcacctccccctgtgagcagagcttggtacagcccaaatagttttcaggttaagaaagccagaatctttgttcagccacactgactgaacagacttttagtggggttacctggctaacagcagcagcggcaacggcagcagcagcagcagcagcagcagcagcagcagcagggctcctgggataactcaggtgagtagagagggaattcgcaaacttaccctggagttttatttcctggataacttagcgtctaagaaagatgaagaaacttcaactttgtagttaaccaaactccacagctatattttatggcttgtctggatcaaatatgtgcccgttaatagcagtttgagaacttcaaaaataatggaatttttggttggttattttgaggggtgtgtggggtgatgattgtggttgtctggcaatgaaacttttctggggatatctggtcagttttttgtgtgtgtgcacacacgcgtgcatgtgtatgtgtttgccttctgctacccaaaatacctggtaagtgaggaaaaatcacaggggatggtgttgagggggagaagcgtggctcctttcagggcctccttctagcttctgctgacccacagctgtgggaaaattattgaaatgcgagcaaaatcttggagccacactgtgtgcaaaaggcctgtgaactctggtaggagggtgagcaggctgtgcagtgttgtacaggaggaagtggtggccaagtctatcttaactccctgtctgcacagccagtggtcttcctgccctggtgacaggttgatcttggctattccattttcagcctctggcctggctttgttcccctctgattccagctttggtttaaactttgatttcaagatggggctccatcctccactcccaggccaagtacactgttctagggtcttcactggaccacttgatcagaactggctttgggtgggggacgggaaaaaggagcggtgcattgtaatggaaacaattggttctgaggatttggaactgtaagtttgctgaaaagcacataggaaaactcagcaaattctgctgtcctaacaattacttctggcttcaggataaaacatcctggtttgtattattggtgtattgaaattcagctaatgcctcatttgctaatctttattgtgaaagtaagaacactttacagtctgaagtaataaacaaaaaaattatttgtggactgctaattaactcttttattcctctggaagtttgtgtgtgtgtgtgagcatgcttatgtgcacgtgtgtgcctgggtgtgtgtgaatactttgtattcaaatagcgttctttatttgtccttagactccctagcagtctagggaaaaagtctaaacacttacatggtcaggaataggttaaaaagcaggctttccatatccttgggagttttcagttcctaaattaaaagcagaaaaagtccctttgtgaccccaaaacagtgtttctttgattagccttgatttgaaatcatctcaccttctgacagcttgcaattcaaaaacaaaacttctaagtgcattcttgtgagaagagtacaatatgaatttttaaaagcaacgtcttgcttgacatattgtgtctgcatgtttgccctcctccccaccttacaacaaattgtggtttaaaaaaaaacgttgggaggtcccagttttagtgtgggctctgtcactaactacataaccctgggcaagtgcctttaccttacaacaaaagaaagaagttgtactaagtgatttctaacagactttccaacataacattctataaaatcagaatttgattcttgaaaggctggaaaagtagacatataggatgggcttattcggccaaaagggcaagtcagccaaaaaaggaggggtgaaatagggaggtgtagagaatggtggaggggcaatttttatattagtcttttaaatgttggtgcatgtcttatttaaagcacatgatcaaatttcattagtttcccctaaagacagaaaagaaatttaacttgttaaaataagtgcttcctaatactactgccctgctttagccttatctttaacaataaagagtatgttcacatacataatttcattacattctcccaataacactctgaagtagacagggaagctaacatattcccattgtgctatgtggaaactgagggactgagatgttatgtatactaaatggtgatattttggatttgtttctggatcttgtaaccacctgtgttccttttatcattttgaattgctttttattttttgatagagttattgagcaaccgaattaaaattgtgtcctcttttttttcctttgaatggctttgaacagactcttctctctgggccagtaggtacatcctatataaggcagtgggctggatcagaggatctctgtggtcctttttagacccagaatatctggttagaagtttgaatctgaacagccatacataagtcctgtggttaaatgcgtgcccatgtatgtaagctatgactctgcctgtgtacctatgaaaagcactattctctgtataccatgtggatgctgaatttgtattactttttcctatccaagtcccttttctctcaccataccaccccccaggtgtggggataagggatgtggattgtgggtaaaagtggtgcctacttcatgccagggcagaattgggtcttctgtattcaatttgtctgcaaacttttattgattttatcttgatttttgctccaagtacagaacagggatgaaactgaggaaaaggagaaactaggcaggaacaatgcctcagccatgccctctctccctctccccattaagttccctcatgttctctcccactcacctaaatccaaagtggcttgtgaaccacagacaggatgtattttatcagatttttttagagcaaaatatgctttttgctctaaggctaacccgcaggttaagaagcaagagattttgctttcacgacttgcctagcttcctcaagctttccagtccagtgagtagaaaaaaaatacctctctctttaaactgcagccttgtattctacgtggcagtctccctcaacttccctggcaattctcaactttctgcactctgggcccgctcctatcctttgccttggcagacacggttgtcctcatattctttctcaaagtggtggatctgaattataataatattgcctaagaccattacctcaatgctaagccccaccacactctgcctcacccaaccgctcattccactagccctcaggccacagggtccctcttctcaaatgtccacattgcctttgttagctagaggctctccttggtttatattcaaatccctgggtttatactcaaagccctaacttttatcttgtctcccgactttcctaatatgtgatctttaacgtaagggctctcccttccccatcgccatcgggtgcaatagaacagaaaggagggagtgttcccttctctgcactcatccgttccaacagagtaagttgtttatgacaaactcaacttacaaatttctgggtttccaaaagtattctgatgtttaaatgatgaacccgccgatgtaaagagttcagattctcccatgaacatcaaaccatgaaaataaagaaccttttcaatgtctaccatggcaataaattctaggcagaatgcctcaaagttgagtatcatgtttgctttggaggatttcctcatttgaactaaaaaatcctttctctaagaaggcagtgaccaaaagaagcagtgtggtgtgatggaaagctgcacactgaatctggcattgcacagaacctggatttgagttaactctgccattttctagctactgcttctctgagctgccatttctgcagatacaaaatgaagggcacagataatctcattaaacatgactgctatgatgagaacccgaactaaaatgtaaaatgcacatttcaaacaagaaattgccatgcaatcactaattctccacataagacatttatctgttcaacaaacattttctgaacaatatttgtgtgcccagctcaatgctaggcaatgagagggcttcagtgtatattttgcatttatggatcactttctacttattcaaaattcctcttacaccaaccatctcattaggtacacccatggtgtaagaggggcagggtagataacctcactttcctgatgaaaaatttgaggcacaaagagaacaaggtcacagagcaaatggatcacagttctgttgcccagtcagaaatgcgggtcacttttttttttttttttttttttttttgagacggagtctcgctctgttgcccaggctggagtgcaatggcacgatctcggctcactgcaacctccacatgaaggtcacttctactctccaagtccgagaggacttgggactacagttgtactgtagtggaagttcaggctcatagtctgctcttctttatttactgtgtgtccccagaacacaggcaccctgacccaaaaggtgttccgtcaagctgtaatctatccatgtgagctgtacattctgcctctgaaagagtctattgggatcacatgggctttaaaaatcaaacctgattttcctttcaattggtgctacttctgtctgtacacaggccctctttataacagggattccttttgcaggatcttgcctgccttgccatttgaccgagtagtaaggaagacctttgaaggcagaacaggaaatactcatttatccagaatgtccagggactaggaggttctggcaaactaaatattctaattgccccaggcttttccacatttacagtccccaggctctggcaattcaccaaaccttctagggaaagcaagaggcgcagtagtgtttgttgtaagtttgagcacacaagaaaattgggatccatttgtaacagcctccagaaaggagtctgggcaaacattcaggttggctctgatgctgcataactaaaaatttttactgataccatccatgctttcaaatacaatgaagtacactttaatatttaaaacacatgagcagacaaatctgatgaaaaaagggacatcagtattttgcagtgtccccacagctctcaattttaaaagcaattgccaataaataaggctatgaaaaaaatgtggttattctcagcttcttattccttggattcagagaaagggtaagtttgttgtacatacattgcaaataacattgtaataacattgcaaacatttaaattaaaaattgttatggttttcaaatggggaaacttctttaccagtgaggcatttcaatgtgatactgaaaggatataaaatgaactagtagagaggtctgatcaatatttcactttttataaaacagcgactgcctcacagatataccacacagatactccttaaagtgctaacgtattctccttattttttagcagacattctgtagcttagtcaggttttttttgtttcaaccctcctgtgattatagaatatagactttagttatttctaaaatacattttgaaatagttgacaccatgtaaatttcacaatctcattcttatttactgttgaatgccaggagaggatcattaaaatcattacaaatctttgtgaatcaagaaaaagcactgaaaaccctattatcaccccaaagctattgaaaatcaaatttgcctttcaaattatcttcctaaaaaccagttgttaagagcacttgagtgtggggcactctgatagacattgcttgaagagccactatatgaattctctgtttagccatgtaaggtttttgtttttcctcctttttttttttttaaagaaaagaaagcaagagtgtattgccatgggataacaatctatagcccaccaaattagtgtaattgaatttcagagtctgccttttatcacaggcaaaggattatacattagacttttaagaagaaagaccatacaatctttctgtctttccttgtctttggaggccatctgctgagctgtttcttgcagtagtcttcctggccaataataaaaaatgcaaagctctttaaatgacaagacggaagaaattgtgtaaaaagacttgctggaatggaaagaggctgcttttcccctcatgcacaaagtgtgcgactctccagggcaccaaattattctgactacagtaaagtgatttttcccttatcttcaagttgttctctgccttgaactactccctgctggtgtaaatggaagacttctctttaaattataatgaatcacatttaattcacaatctttacttttattattgatttttccccaataagattaaggcccatattgccccatttgacagataaagaaactgagacccaaaatggttaggtgccttacccaaggccccatactaattagttgcggagtgtggacacttctttctttgaaaatggtgacatttcctttaaagccaaactagaagtgcctagctctgggaagaagtcactgggatgacggctgtttgtctaatctcaggtaacccttaaaagacctgagaaattcttccttcaaagacaaaaattttcctcattctaggcatagttcaacactatgggtcctcctctgaagctcttcaaaaaccagaaataccaggaactgaagcaggaatgcatcaaagacagcagacttttctgtgatccaacatttctgcctgagaatgattctcttttctacaaccgactgcttcctggaaaggtggtgtggaaacgtccccaggtaactttctattttacacattctgtctccttgacctccttcatcatacttctacgtgatccactgtttcacttacaaagcctactgtgtagaccaatttagaagttaaccttccttccttcctttctttttttttcagctttattgaaatataattaacaaataaaaattgtgtatgttatggtgttcaatgtgatgttttgatatacatatacattgtgaaataattaccacaatcaggtaaattaacgtattcatcacctcacataaagaaaactttataatgaaagttccatggatctgtgctcctggctctagcttggagtcctgaattttagtcaaattttgacagatttacttagaaaaaacaacaaaaaaatacactgtacctttttgagattagctatttaaccttaagcaaattaatctaagatccattcaaggtgttctgtgtatcaatagttgttttgtttttactggtgagtagtaatttatgataaggatatgccaaaatttgttcatctagtcacccactaaagggcattggggttggttttagtattttttactgttacacataaagatgctatgaatatttctgtacaaaaaacagagagatatgccaaccttattttctcttggaagttcatttgagtaaatatggtaacacaaaaagcaactatgctcttgcctctttactgagttacctgtcataacaatttaaatgtaatttcagaccagtgaggagaaaaactccttataaagtgagcataaatgagacaaattttaaagggagaagatgaatttttcatgggggcaagaaggcttctttgctgctctatggacactgtcatctgtatcatcccacaactggacaagtgggcttcaagtagaattgtaggtctttcaccacctattagtagtaactattaatagttgttgtggttctctgtgcatcatctgtatgttgtgtctctaaagcaagtttcagaaccctttcactagtcctacatgagcaggagctcagtgtataaaacaataggatgatggagtctggagaataaattgcaaccttgctatacctaaagggtataactggatagaaggatattgtacctaaactccttctcaatgtaggtgatgaggtatataggccacagaaggatgttgtgaaatgcaagttcttggaacttcataatatcctgaagacattcaggtcctatttaatgaggttcctttctgtgtactattatggaaccatctcaggcatcatctcaatgtttgcctccctcaagtaacccttttaccaactatcacttttagttgcaatttccacagcttaaattcctaaatggagttctgccaagagctacttctgtttatgcacgttgctaccatgtggtgtcaagatacactggttacatcaagacttgtttactatgcaactcaaaggatatctcttagtttttgcctataaagaatgacaaccattgaaagtatgagactgggagaagttcgctctgtctgaaggaaaattacactcctcctgcctttctgtgtctgcagttattgacattccagcggatcacttagctgacctgcaagaaaaatctaggaaatgagcagaattcattaaccaatactttggtatgcagacaggcttttttttttatttgcaaaaatacatggagaaaaatagagatacgttgtctgggagccactcttatgaatggatggtgataaataaggggcatccctcttttctgatgcttggatatgaaggaaaagatgtcaatagggcaaaagtagctaaaaaggaagcaggaaattaagagaggtgtattgggtaggtgtctttctgaaataggacagacttgaacatatttataggctaagaagtagatggtaaagaagaagaggttgaagacacagaagagaaaagggatgattgataggggtgaggtggaggaggtgggaggagatccgatgggcagcaaaattgcaagccaacatgaagccattccccagaagtgcaccaagcagacagtgtttcctgtactggctgtctttagacatatccttccccctctatcttggctcagtccattgtcctttgccttcatcctccaaattctgtggattgaatcctagatggattagcagggaaggaaaaagtcttaacaaccacggcattttgcctctaaggcaaacaatagcccttctaaagtgagagaaaatcagagagagaggctgaacagtggggatgggtaggaaaaagaatcaacagtcatgacatgcgtactatgggccagatactgtgtttgaagttttctatacattattttacttcacccttatttaccatggcttagcaaagtaggcatgttaaaagttactttgatgcaattctgatttcctagtttaaaaaatagcagtagatacatgcccattatatatctttatataaaaagaaactgtgtctttaagagaaggtaagtatttgctcagggtcagactgctaacaagctcggatttgcatccacgtttgactgcaaagcctgcataagttttcactctatcatgctgtcatatcagggagatagatagagttagttgtttgtgtcccctgttttcaccaaaataggtagcttccctccagtcagttctcatattcctcttcactgtgttgatgccacacttccattaattgttccacactctcccgtttgagagcatggtgtttgcttaatcttattaagcccaaagggagggtcactagagaaatatttactgaacacttactctatgccagccttggtgcaagacacagacatggcctgtggtgaggcactcccattctagttggggagatggatattgagctatcaaatagttaaaaaagaaatgaatgttggatgtatgaaatgctattttcagtcatatggacagtaaatcatgtagaatttttgaagaaggggaggttaccatagattggaatggttggagaaggggcctcttgtggggagcaggagaaaaaaacaaggttctggaccaccatctgagcctcctccaaaagctgtggattccttcccagccagagtggaggccaagcctgtggtcaagaaccacgtcaaagttctctggcctcccatcaggaaagctgagagacagagctgggcctctctgaattggctcaggaaggccagatgagccgttggcctcccccacctcattggcaaggttgagatcctggtttgcagcgaaacttacagacatcttgtcccttggcatgccatgtagctgcacacttaactggggctattttctgaagtctccaaaatggaagcaacacgattaacctgatattttctgtctttttcctttctcgtgttgaaggcttttgccttcgtaagcctccatgcctgcaaacaccactgatagtttaacaaactgactccagtcaagctccgcccctcgccgccttggcgcccccccggccccccgccgccccattcttgggcaggattgagttcccctcctcccacttgccacttctttgctgtgttttaaggagcctcttcagatgacaggaattatgaatgtcttgcaattgttcaatgccagatcatctgcccataccctccagaggaaagttcttcttaatttctccagccgtctattggcctcagctgttgtcctagctttctgaatacacaggtatattacctgagaccatgtgctcctggacttttctattctcctggagctcaacatatatagtcttcataaattataaggtctaacttatactgagttacagtgtgatcataagactgccggtaggatttttaggctgaaatctgcctgccaaattcccacagaaaatctcttctccagctccctccagccactctcccctcctacccacctctggcgtttttccttactgactcatatctacctacaatagtgtcttaaaatcagacacatctaatccctgactaaaaaggagtaaagcctcatgggaatttgcactgtcagctgtgaggaaaaaagggcacctgcacaagatctgtcagctctcctgtcaagttttaagttcagccttcgctaccattgccattgcctagtcttcccctctagaatacattcccctggggccattttactacattgtctggttgagagtgggagggtgatgaggctctggattaaaattatggtagtaggaatggaagggaaaggcagataagggaagacattagaagcagaatatacaggcttgggtgacagcatatgagggaaccgtaaggaaagaaacacttttctctctgtgctaatagaaatttccaaccaccagctgaatgcaacacctaggtatagtagttttggcctagtctgctcaagaatttccttttcttcccagagactatatcaccccatgtgagtagtcctaagtgttttccactgtttacacaattgaagagagttgaataggcccatagtcttttctccaactgtcctatttattttaaattatgcattaacaaactttaacagctttatcgaagtgcaatttatatattgtgaaactcacctgttttaagtatacaaagcaatgatttttagtaaatttaaagttgtgcaaacattaccacaacccagttgtagaagagctgcatcacttcaataagatcccttgtgcacatttgaagggagtaatccctccaccctacccccacccctgctgcagccaaccactaatgtacttttggtttctatccagaactgcctattctgtacatttcacttaaaatggaatcataaaagtaactggcttctttttcttagcataatgttctcaagagtcatccatgttgtagcatgtatcaatttattccatcttattgctgaacagtattccgttgcatagatatataaattcttcccaaaaaagcagttcgggatctgtgccttgagtctcctagcagaatcctgaaggttaaagtgagaaaatgattacacagtgatttggtggcccagtttggaagtggaggttgggcctaagatcctattctattctccatattgagctttccttggatgggttaggaaggaagagactattttattgataataaaatcttcatgcagaattgaaactccccagtaggaaaagtggacttcttgagaggctggtgcaacattagtccctgagcctaagtccacctataaatgctccatctgggggatggttcaattttctaagtaagataacgactacttggactagctcacaaaaccctcagttcctgaatagcagttctgtgcaaattagcccctgagctttctgggactatttagaccctggacttattcataatatacctactgcaggcctgacctcacttgtaggtgtccacacccctaccccctcactactgctagattgcacgtagcacttttgaaagtgtttccactattctggctgctggttttctgggcagcttttcattttactgaggttcctgcggtttaccctggacctccatgtttattgtcagtaaatttcacctgtgtaaaaaaaatgctgaatttggatgtggtaggtgcaaagggagtcacatagagtgccttgtgcagggctacaggacttgtaactgtatgccccctcccgctcagaggtctctgggaaggaggatgaagtaaggacaatgagaagtcccttaagactaagctaagagaacacacttcctagagaagctgctttgcttaatggaaggttttggctcagaagtggggtcatgcggggaccatttcagctttactcttggtactcaacttcctagttgtgtgtttcttcctaagaaatcattttgccgtgacaaaatgatcacttcaactgtgccagcacagctgggagccattaggggctcagcatccctccttgctcctaagccacccaaatgttgtgaatatgtgtgctgtgacctctcctccaaccccattcctaccactccagcacagctcaagctgaaatgtcccatctgcactctgcatctcagctttgagttacagaaaaatttctcgtcttacatccttaaccccaacaggaagatatccagtgtgtccaaaattaggggagaagtcaacaaacagtcattttgttgttttcaaatttgtcaccaaatagtctgtttggctgctaggtttgcattggcttattaccctttaccctttctaaatccttggctactttctagtcttttaatgcctcacttccttaaagaggcagaagatagggcttaataaaggatttatttcccgtatttcatatcacgatgcttacatatagtaagagattgattcatatttattgaatttaattgagcagactaacgcctattagtgatattcatcctggaaccaaaagctaagaggtaagtaaatttcccaaaagagtgaagagtgtttaggtaggttttaagcagaggcataaaacactgggatgaatgactgaaagaggtagtagcatctctgtccctgaggagttgcacaatatcatcctttatgtggtggccattgttgagcctaaaggcacagggatggatgactgaggtcttcagcttctttctctagccatatgtggttctgaaaaataaaaaactttaggcctaggtctcctgctgactagctagatgatcagagtagcaagttattgcccctctctgagcttgcttcctcatgtgaaaaataggctttactagatagtctccaaaattcattccagttttgacattctatgactgttaacttgtcatgttttaaatctattgttaaatagccatcacgtatgaaaaggggtaaagtataactggagaatgggccagtttataagaggaaatggaatgttgtgggggggggggtcccaaatttacattctctcatgaatttcacacagcttttaatatatatattatatgtacatacatgtatatacatagacacatataatatataataatcatatccatcttgggtcaagaagagaataattaccccattcctcaatttgaattgtttatatgtctttttgctcacttatgtgaccctttatgtcttcaatagaagttgacatgccaaaagtgttggctaagcctagatacctactgtgaaatgaaaattttatggaaattcaagacaccataatgtatctccaaccactaataactctacataaaattagcaaataatttgccttattaatctaaaagcacactttttcatatatcagtgttcactttattgtttttccatgttaggaaactatgatatgtattatctaggtcaaataaatcattattttttttttggaacgaagtttctctcttgttgcccaggctggagcgcaatggtgtgatctcggctcactgcaacctctgcctcccgggttcaagcgattctcctgcctcagcctcctgagtagctgagattacaggcgcctgccaccacgcctggctaatttttgtatatttagaagagatggggtttcaccatgttgaccaggctggtcttgaacttctgacctcaggtgatccacctgcctcggcctcccaaagtgctgggattacaggcgagagccaccacacctggccagaaattattttatactttgacatcttgctcaaaataaaatgaaaacacctgacctggggaggaaaaactgtgcttagtttcattttagaaaaggccaaaaaaatgagaagaaaaagaacatcagggtttgacttacccaacatacctgctctatgttcaacaagtgaaaacaaaggcagtttgcagcccataaaaaatattttttaagatagaaaattctcctaaaacaaaaagtagttgtgaactaccaggcatgcatctaaaaaaaaagacctgagaatccaaagctgacaacctatctagccatctccttttggcagagggatgcccagttaatctccagcttggacttgtctttgcccagaatgcctgcctatttctttccagagttattttggcttttaaagaatatatggaatgtttcattctgtagaccagacccttcgtcaaggagaattatggccattaaaaaaagaggtttgaggaccagaaaaatatagctgtctctaatactttttaaaaggatatatgtctagattccatttgagacaaggatttatttctgctgcgtaagcagaatgtcaaggtaccggccaatggcctcctcgtgaagctttctccatctagtcaagaatgcattggtatttcctgcctttgaactcttcaaatgctgatactctgagtcacccaattatgtcttcaactatgtagtgtcatgtatgccacaatgcctttgcccatgcctttctctctacctgttatgccaccgtacccctctcttgtccaactgcctaattctagtcaactccagtgttaacaacactatgaatcctattctgactgtgatcaggagaattatggggattcttcctttagacatgaattatgctttgaaaatgactctactgtgccctatcgctttgtgttataattgtatcatttaggtatcattttcctactcccagtgggaaaggcacagttaatatgttggggggaagatacacacatacattccaaacaaatactgcccccactctgcccagatcccctcaggaccttcactgggaagagtgtcggttgaagtgttcctgtgagtggtttattaccacttgctattaatgctgctgtcatctatattcatccacaaatgtagaaaaatctggttgctatggagaccactgttgcttttgctttatgttagaaaagggcttcctataaggtctcctaactggttttcctagagaaggagatgaattaatgttaaccttcattagaccttgtctctttaatacaatctcccttccaagcacaggtgcttcagaaaatctcatcctggcaaaataggatcagaatgtaatgtactaattcctagttattatttttttggaaagttcactgctgtggtgaaaactctcccaaaccccaatgatagctatgtctaagagccctcaccaccgcatggcacccaatctcatgacaccctctcctttcatttctcctgccacttccaaacatggggctagatgatcaactgttttttggttttccttataatcccctcagccttcccttcatcccatctatggaaatcctacttatttttcaaccctaaccttatctcctctatgaaggctgtcctgcctagttcagctcacagtgactcttgagaaactcttcccagactctcatataaccaattattgtattcataggacatctgtgatgacccccatctgattgtgggcaacattagcaaccaccagctgacccaagggagactggggcacaagccaatggtttctgcattttcctgtttggctgttcaggagtctcattggacaaaggtattatccctcctgtgggacctcattcagtttccactttcttgtcttctttaataactttaggaaaaaaatcagcgcataacttccttagattgttgtatttcttgaaagcagagatattaactaggcgacttccctccatttcattataagaagttttgcaaacacagaaaagttgaaataattttatagtgaacactcatatacccacctagattctaccattaacattttactctacttgctttgtcatatatgctcactgatctttggttatcatttgccgtgcattgactcagtatctctgcatattatgttatctgtacctattggggtataaagtcagtagaagccaggaagtcaataatacatattaataacaaaaaaggtgagaaatacagaagtaggacttgaaaagttctaataaattattaatagtacaaaaattcctttagcattcaggtagaggtcaaggcaatgaagtgttaacttgacttgggacaaagttaaaacattttcctcaaaaaataattttagaatattaatgtgtagctgttatacaaaaaaaattcctaaacatgattttattcaaaatgcaaatgaaatccatatttaatataattgatataaaatctctagaatggatatttaaaaagcaaactacaatgggccttgattttgattggttttgctctttagaatgccttgcattttaaacatgcaatcatgaatatgtttatatagtccgcttctcaacatctagtttatagattatttgtggaaagcatttaaccactaactggttgtcccagccacactgtgtactcctgtgtgcatttagacaggcatggtgatatcatcctcagcaaaactgaactgaggaagcagaagttgtgggcaaaatgccatatctaggaatttccaatccagactcaaaccaggtgtatgtggcatgcttcctgttgccctgtagatttgccaggagtaaactgtaatctcagtttctggatgtggtctggtgaataacacttgattaaatgttcttgcatttctagacaattcccaaccataaggaacaggaatgggaccctcaaaaaacagaaaaatacgctgggatatttcactttcgtttctggcattttggagaatggactgaagtggtgattgatgacttgttgcccaccattaacggagatctggtcttctctttctccacttccatgaatgagttttggaatgctctgctggaaaaagcttatgcaaagtaaggaggtgattgactagtctgctatcagggtacatgaggaaaggaaagccacatttatctttgggagctcattctctcccagcccaaccctggagtttaagttgggtaagatgtcagtcagaaccaaggcattgctttgcacttgggcctggctctcagaaatcttagatgagagagaaatcagaggttcttgtttccatttaaactcttacctgctcccaggtaccctttcctcctgctatctgcagatcacatggcactatcacttcattttttctttatctcatatctccccgtagaaagaagtttctgcatagactgtccttgatcaacatagcctaagcctagaaatttctgaatataatttcaaaacatctctcatttcatacctagagaaaagccatctggtaaagtctaggcaggggatgttctgattctttagattatgatgttcttgacctggaaaaacaattttacaaagataaccttgcatacttgccctcaggctgctaggctgttatgaggccctggatggtttgaccatcactgatattattgtggacttcacgggcacattggctgaaactgttgacatgcagaaaggaagatacactgagcttgttgaggagaagtacaagctattcggagaactgtacaaaacatttaccaaaggtggtctgatctgctgttccattgaggtttgtactcatgaaaaacaaccactgtatactcattcctggcagaagagactacaaagtttggtagggaaattcgcccttaacccgaagacccatgaaaaactattaatgggacttggaaagctaaaatacacattttgccctggtgtggaagctgaggtgctttagttttttatccttttgtaccagtcattccacatggaaccaatgcagcatccaggcttgtgtcagtagcctctgctaaattattcctcttgtctctgcttctagatcttgaggttatggctgcttgctcaataaatgaatctgccccatcaaattttatggcagttcatattaatgtcctacagtggatagtttgaatctgacttgtttgagttgttatattacattctttatttattttcctctactgtttttgtttcaagttgggtgtcaggatgaaatttccatctgtgtgagaactagcttcaatcctactgggttaagccaattaatgaagaagaggagtcaggattgggtctcccaattcctgtgcctttatatatctttctttgctctcagtctcccaatcaggaggagcaagaagttgaaactgattggggtctgctgaagggccatacctataccatgactgatattcgcaaaattcgtcttggagagagacttgtggaagtcttcagtgctgagaaggtgtatatggttcgcctgagaaaccccttgggaagacaggaatggagtggcccctggagtgaaatgtgagttgcattccactttcacagctacatctccaaagccctgtagttctcccagacccatccctccagactgctagtgtgctgtcaatgctcagtgacatctgtgggcttttgtcaggcacggggtctgtgacccagccgcagatgaaataaagcaggactgatcctcatgcactctgtttctctggcatcctacttactacaagaagtcaatggcaaacataatgatttatcttttttttttttttctatttactttcagttctgaagagtggcagcaactgactgcatcagatcgcaagaacctggggcttgttatgtctgatgatggagagttttggtgaggaggggtttctgcactaagggaattggggcttctacatggaactacagtgttaagtattaaataccatctttatttttttcctgtgctccttccattcaggatgagcttggaggacttttgccgcaactttcacaaactgaatgtctgccgcaatgtgaacaaccctatttttggccgaaaggagctggaatcggtgttgggatgctggactgtggatgatgatcccctgatgaaccgctcaggaggctgctataacaaccgtgataccttcctgcagaatccccaggtttgagtcaattactttatttgcctcaaagttatccagtcaataggaactcagatcttgctttggtcatctctggagtatttctttagcatcaaatcttccttttgcagctattgtgtaatattcaacaaccaggatccctacggattgtctcaggtgcttgtaaaacacagcagactatgtctttttgcagagacagactttggcagcagtatcaaatctgaatcacctcctctggctgcctctcttctggccatattgtctggtatggctctttgacaatccctgcttccttgtgatggtcccatattggagagagaagatctgctttgagatgctccctcaattcttcctcatttctctttactgcccagctgttctctggggtgcacatttactatattcttcctctttctaatgcagatgactcttttgaaccccattattatgcctccattttatcatctagatccaggtcatttttcccaggatttgaatcattgccctgtcaacgactctgtcccatccatctcccattacagtgctattccaggtgacataacagggtcaagtccacgcacactccagagtaaaaaatccaaacatctaaaggctgaatctataataacctggatggtttcatctcaaaatgtgctgatgagctaactcatagaaaacaagaattctgactatattgctgcctcactgcccatgggtgcgtcttttcttttcatggatctcattggtcaggcatttaggagaatatggagactagtgggctgattcacctaactcatactgctcttccacccttcccatcttaattgttcctaaagaaatatcctatctccccccacacacaccacctcacctccatttacaactctggaaatgtttcaagtattaggcacatatactaagctgggaaaatggcttcactctatatgtatgtacaggattgaacttaggggccttagttcagagtctgtttttaagtcctccctccctccctccctccctccctcccttcttttcttcctaccttccttccttccctccctccttccttccttccttccttccttccttctttccttcattttagagatggggtctcactttgttgcccaggctggagtgcagtggcatgatcacagttcactgcacccttgaattcctgggctcaagggatccttctgccttagcctcctgagtagctgttttatgtttccttctaaagggagagaggaatggagacagagacagagagaaaaatctgatgccttttagttttatctcctaatagcaccgtgattccccagatgatgtttggaaagtctctgacacaggcttgtagcttccttaaagtggaagtagcaaaacatcaattctccaaggagcccttccacaagctgtatgtctggctggcaaaaggaggctagcccagggtgatgctgtagtgtcaggttgagtcaaataaatacctttctgtctttatggattccaaactttttctatatatggcatttaaatacaaagggataataataacaataataataataataatacaataatttaccaagaacttattagaacaaagcatatcctctttggcatcaaaggctaagaataaggttgtccttcaacacatgctgaatgacatagaaagaaacaagtgttaatggtctacgcttagcaagtcagtgaattatccaagaccttgttgtctgataaatatgaaagcccagaaaataactcaaggctctgcttcccaatgacaagctttattccctgaaatttaagctcgttcatatgaaatgggaatgctaactcacctctgtggtggtctctttcccttagtacatcttcactgtgcctgaggatgggcacaaggtcattatgtcactgcagcagaaggacctgcgcacttaccgccgaatgggaagacctgacaattacatcattggctttgagctcttcaaggtaaaaatgggcatttggggcagagagaatgaaggcaaacagagtaaaaattaggataatttaatggtaggggaagaatggaaggcctagggataaaaaagacagagcatacaaaaaccatgatttgagtggaattgaatattttaccctatttcatttccaggtggagatgaaccgcaaattccgcctccaccacctctacatccaggagcgtgctgggacttccacctatattgacacccgcacagtgtttctgagcaagtacctgaagaagggcaactatgtgcttgtcccaaccatgttccagcatggtcgcaccagcgagtttctcctgagaatcttctctgaagtgcctgtccagctcaggttcagtttccttcgcaagccctcaaacccctgttctttgctttacttccaatcctaaaccccttcacccgtctcccctcttcagacattcaatgggacaacttgtttaaatcagacttgattcactgaaatcatggtggtaaaaatatttctcaaagggtggttgggggaaattccccagtgaaggtctgaacttcagagctctgagctacccttaaagaggaacaggcctatagtctaagttcttccacatcaaatttgtcttctgttttctggctgatggcctcttttcttaagtaggtagcactcctccctgctcttctattatgttctgtgtgctggatcaccaaagccacctttttgtcccagccctgcctactttgatctttatctcctggcccttaaagaaaggagaaaggaaagcatgcttaaaatatatataagacatatctgaggaggaatgggctaagtcacacaatgtctcatgcttttcagcaatgatgtctgctttggcgggcttatttcatcaaaggatatttatcatatgatgacaatattttatttttgatgttctagggaactgactctggacatgcccaaaatgtcctgctggaacctggctcgtggctacccgaaagtagttactcagatcactgttcacagtgctgaggacctggagaagaagtatgccaatgaaagtaagaatggcaggaatgtctgggaaagcaaaattcagttgcatttatagcacataagttagaaaacatgatcacaaatgattttctccagcgatattttgtctagagaagttgggaatggatggcaaccatggcagaggatgggatgtcaacttcaagcaaggcctacattagattcattttcatattcctatataaaatatggaaaaggaaagggaagtgggaataaaagtgttgaatctcagtcattctggtgctcgagtgctatgctgaaagtcccagaattggcttagcgagataccttcttgtctatctagaaaaggaactttaattgctgtgttaaaaacatatgtcactttgttccagctgtaaacccatatttggtcatcaaatgtggaaaggaggaagtccgttctcctgtccagaagaatacagttcatgccatttttgacacccaggccattttctacagaaggaccactgacattcctattatagtacaggtaagagtgtgtacaggggtcgccagaaaggctcatactttgtaccagatactagatgatcccaagtaccttatatatgtttaggatgcagagcaagaattatcgtattttttggtttgttttatactcaaaaactcttctcatcaagcatggacactgacttccttattaccatccatcctaaatctcctctcttccatttatttaattgtgggcaaaagcccacatgctcaccagtacacatgttaacacacgtatcataaaatcccatggaggaaagcttatgccagttcagaggaccctcacatggctaggtcaggatgaatcactgcagtttggcagtttttctgacttaatactcctgaccagcagcctttaggtaaccatcccacaggtcaagaacgacccggagattctgttttctggcttttcatgtatattctttgaggtatcctcccctcaactgatgggctatcaggaaaggacagaatagtctcttggttttaaaacaaatcttttgaagctcagcattagatctggatgtcactgggcaaaggctaatctcactgagggctgctcatcttcactcccttcgtttgtctttccaggtctggaacagccgaaaattctgtgatcagttcttggggcaggttactctggatgctgaccccagcgactgccgtgatctgaagtctctgtacctgcgtaagaagggtggtccaactgccaaagtcaagcaaggccacatcagcttcaaggttatttccagcgatgatctcactgagctctaaatctgcaatcccagagaatcctgacaaagcgtgccacccttttattttccgtcaggtgccaggtcttagttaagattcacaatctttagaaagaatgagattcacaataattaactcttcctctcttctgataaattccccatacctcccaatccaagtagcatctgtagctacataacctatatacctccagcagctggacatggggaggcgacagtcctatctagacatcatacacatttgccaagaaaggatctctggggcttccgggggtgagattcaagcaggacaataacaagaggctggacaccctacagatgtctttgatgttttcagttgtttgatatatctcccctgtagggcatgttgaggaaggaggagggctgatcaaggccaagctggtctagcctgacatcctagctcctgactgaacactatagacttcccagcagcatttcacccagcagccagagccggctttaagtccccaacccttacagacaccactgccaccaccaccaaccacgaccaccaccaccaccaccactcaccaccatcatcacctccggaaagtgtagtcctgccctaacccaagtcacccccgacagtaaattttaccttcatgttgagaaagcttcctggtgcttaatcaagagctggagttcaatgagtcctagacagtgagaggggcctgagcttcagctcaatggaagcctgctgtgtgccacaagacggaaaagtggaagaagctgcagtgggagacaaagcctcggtcccccacccatccacacacacctacactcacacacgcgcacatgggcgcgcacgaactaccattcaggcagtcagtgggcaagaggaaagataagtaagtaccatacacacctaaaagatgagagaattcatccagacatattacagccagtttggggcccctgactgcaatgtgaaacctctcgctgctgctaggtttacaaacaagcccattgtcctgtgcctcctaatatcatttgtactgaagaccccatctggggacttgagactttggtcccagcccagactcctcagacttttctctcagttgggatgcttcactcgctgggggtgtttgtttgccctctcatttttcagtacttctacagaattttctctagagtcagtcattatgaaatgtacttccctccatcttaacctatcaactttctgcccctccttcaaggcccagtataaatgccacctcctccatgaagccttccctaattccaccccaaacccccaccttcaacaatatttcaacgcttctgcaatgatgaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcatattcagtacattgatcagtcttgacttgaattgatggcatgggatggatggcaagagtgaccatctgttaagacttgtttcaaagccactggaggtgggggttgaggtacttcatgaaatctgagctcaggtaaaagtgtgatggattcaaaagccctggctacactctgatggtacagttctttgcattctggggtagttggaagaatgaagaggggcctttatttcatatttagggacagctaggtgctattcggggttacttgagtttgaaactcctatttgggattggactcgaggccataggtacagtagccaaatctttcaagggaagatctctcaacaagacaaaataccaactcccctttcccagcatcttccttagagccgaagggatgtgtgaagacttcactcatttgcttatacaacctgccatctaccatcttagggtaggcaaaggggaaaattcttatttttctttctgacatgaaaaagtgcctaaccaggggagggatctccaaaggagtagctcaggagaacagttctcaagtacagccctcactgtctgtccctataacactaacccagaacacactagagatttacatgttgtagatttttgttagacatgaaatatcccatgtggataatgcagtcattccatatggtcaccagatggcactatggtattacaattaagctcaaagatgctactgcttttttttccccccaaggatgacaatttttccccagacaaaaaagggtagaatgccctctttcaccactcatattcaacatagtattggaagttctggccgggacaatcaggcaagagaaagaaataaagggtattcaaacaggaagagaggatgtcaaattgtctctgtttgcagatgacatgattgtatatttagaaaaccccatagtctcagcttaaaatctccttaagctgataagcaacttcagcaaagtctcaggatacaaaatcagtgtgcaaaaatcacaaagcactcctatacaccaataacagacaagcaaagagccaaataataagtgaactcccattcacaattgctacaaagagaataaaatacccaggaatataacttacaagagacgtgaaggacctctttaaggagaactacaaaccactgctcaaggaaataagagaggacacaaacaaatgcaaaataaagccatgctcatggataggaagaatcaatattgtgaaaatggccataccgcctgaagtaatttatagactgaatgctattcccatcaagctaccatgaactttcttcacataattagaaaaaaaacacttcaaatttcatatggaaccaaaaaagagcccacatagccaagacaatcctaagcaaaaagaacaaacctggaggcatcatgctacctgacttcaaactatactacaatgctacagcaacaaaaacatcatggtactggtaccaaaacagatatatagacaaatggaacagaacagaggcctcagaaataacaccacacatctacaaccatctgatctttgacaaacctgacaaaaagaagcaatggggaatgggttccctatttaataaatggtgctgggaaaactggctaaccatatgcagaaagctgaaactggatcccttccttacacctcatacaaaaattaactcaagatggattaaagacttaaatataaaacctaaaaccatgaaaaccctagaagaaaacctaggcaataccattcagggcataggcatgggcaaagatttcatgactaaaacaccaaaagcaatggcaacaaaagccaaaattgacaaacgggatctaattaaactaaacagcgtcttcacagcaaaagaaactatcatcagcatgaacaggcaacctacagaattggagaaattttttgcaatctatctatctgacaaaggtgtaatatacagaatctagaaggaacttaaacaaatttacaataaaaaacaatcgcatcaaaaagtaggcgaaggatat

SEQ ID NO: 17586 - DNA, 7065 bp, Human
agagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaag

SEQ ID NO: 17587 - DNA, 7100 bp, Human
cgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaaggatgaactggaccgtgggctggctgaccagtg

SEQ ID NO: 17588 - DNA, 34078 bp, Human
  misc_feature (1)...(34078): n = A,T,C or G
gaatgagaggacattataagcaggtgtgggtgtgtgtgtgtgtgtgtgtgtgtgcacttgagtgtggagacttttgtgttcctcctacctgacctgaactgttgaatgatgaagttacaatgattggactcaggggtgcagctagctaacttgggaattggggttttgaagtactggagacagctttgtatgccatgttaatgaatttgaattttatcctgaaaaacgtggctgtcgttgaagaattttaagcaggcaggtggcttgatcagagcactgcttcccagatttcactcaatggtacctgtataacacattcatgatttttgctgtatctccgtatcatcaagttacttaacgtttttacaccaacttttattattttataaatgtacttaaagaggaaattcactactagcattgcttgccataatcaaaataaatatattattaaaatggaacagtgctaaataaggtgtacacatggacatagagtgtggaatgacagacactggagactccgaaaggtggaggggtgggagagaggtgaacgatgagaaagtacttaatgggtaccatgtacattattcgggtgatgggtacactaaaagcccagacttcaccattactgcaatatatccatataacataactgtacttgcgccccttaaatttatacaaatttttaaaaggaaaaaatggaagtgttcatctatgtaccaacttaaaatcatctcacgcaccactagtgttaaatctaccacatgtggggaaactgtgtggtatgaattgggttgagggcgtccccagcaggcacagaaattgggttggtgccaggttcttaatgcccagatcttaattagagagcccaagtccgttgtaggcctggagcaattcagacacaaggcaaaaagaaagtacatttgcctatgccttgtaacgtctacaccaccagcctttctgaaactattgtgcatacgaagtcatcccaggatcttgtaaaaacaccgattcggatccaatatgggacctggagttcatacatttctaatcaactcctaaatgatattgatgctgatactgtcggtttcccaaccaagcaacgtagcaaggtacgaaactctaaagtccctaaagggcagggaccacgcctctcgcgttggcatagtgcctagctcaaggcactttctgggttaacactcgctgaggaccggagtgaacgcccccgccccaagtcgtcacgtgactgactttctccaactgccggtttcggctcacataacacacctactatccaaaacatttctattttcctaacacaaaaactatagctaagtttttatattctatgtagccccagcctaggacgtaaattccacgagaccaaaagccttgtgatgattccccgaggttgctgaccctcccggtgtgtcccgggcctgctctgggggacacagcggcgaatacgttgaacgaggcccctgtttcacggagctaaagatccagtaaggacttcacccagcgagaggcaactacgccgggcttcgatacccaatacctctgcagaaaggtggagtggcaggaatctcctgaagcctccaacgtccaggaacgcggaaacccagggcctccagtgcaggtgtcatcccggagggcgcatgcggagtcccaagagaggcgcgtcccattggacaatgctgagcggaagagcccaagatagcggggggagttgtgacaggctgctgcagacgtacttagaaaaggggtgcatactggatattcaggctaggagaagaacgcaaaaagcagtgacgtacattattctctgcatatatttacttgggaaattgtgcgtctccctattctgagtcttggaggaattggactggtccaaccttataaagagagcagtagagcgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcggtgagctcaggtggcgggtttgggaaagggctggggagcagtgtgtcgacaaggtgatacgaggcggaggtgtctggtctggggtctgggccttgggattcggtctgcccttcagctgaaccctgcgggccaagtgggctgcagactgggtcaggctttggaggcccagctcatgctgtgagcacaagagacctaacaccgggaaacctgaagagaggggcaggacgtgagagcggagttgaagcgagtccttggagagacttctgaaggtcactccggtactcaagtgctggagaaagagaccgtgaaacccagggggagcgggaggacggcgcacttagccccccaccttcactttatccgctgcagcctctgctccttggtttatcacggagcgtcagtttccccagcgaataaaagtataagaaaggagctaatgcagatagaacacttattacagtacctggaacttcattgttaaatactatggtgtcttagtagtctaacgttgcttttcttgatcgtatgttagacggttcctccaagacgtctctgtttgtcctcaaaagctccttaattaagtttccccttcaagcctaaattaaacatagctgtcacttggggaaaactcacacatcagggttatatcactgtgggacagtggttattaagaggggtaagggggaacacttaaaaaatcatagcgagggacagaatgcccccagggaaccggtggcgatgtttggagacatatttagttgcaacaacttgtaaggagggtgctattggcatggagaggccagggatgctgctaaacttcgccttacagcaaagaattatctagccccaagtgccagtagtagtacctgtgttgagaaacccccctagatggagatgcagaagaccagacctgggcatggaatgttcttatgctttatgtttacataaatgtgctgtgggctatatcgatttaggctgtaattgcattaaccttccaggtatacctagacacaccagtgattacccttggagggaagcacggttagattggcaaaagaccccaacatttccttctccattctattttgcaacagaaaaagctcagagaaaacagttggagaggcccaaagtaaacaaattgcagtaaacttgaaagcaattatttatgtgtctaattttagcactttatataggagaataaacttagatatatcttgttattagaacaaaataatttagaagattgcatgacagttactaggataatttgctgatttgaatgggacgattaagaagcacattaccggcggagcgcgatggctcacacctgtaatcctagcactttgggagtcagaggcaggcggatcacttgagatgaggagttcgaaaccagtctggccatcatggtgaaaccccgtctctactaaaaatacaaaaaaaaaaaaaatagccgggcgtggtggtggtgggcgcctctaatcccagctactcaggaggctgaggcaggagaatctcttgaacccaggaggcggaggttgcagtgagccgagatcgcaccgctgcactccagcctagacgacagagcgggactccgtctcaaaaaaaaaaaaaaaaaaaaattaccaacaaagagttactatttgggcacatttggttggaaaacacctaaaatctcacttggtaacggaattatagattattcatatttgaattgctatgcccatatatcttaaaagtttactttttggaaaattataggccaaaattacaaagaaggttaactataccatacccagcaaactaaattgatgacgataaagtaaagctaattgtaattcataactgaaaagcagtactaaaagcaagtgataaccagcagccaacctagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataacatttgccaaaacaaactgaataaaatgaatgcattttgggtccattatctaatatttaatgggaccctttcaccctaccagtaactgcattttatatattgagaatctgatgtggatgaagccattattaatctcaggatgacatacatgtcataaatgttttatttagtcaaaaaaactaagacctttggttgtgtggtcttaatacagcacacaagagtgaagatacaatggaaaatattgagggcttggaggaagttggtatatactttgtctttttctttttttttttcttgagacggagttttgctcttgttgcccaggctagactgcaatggcacaatctcggctcactgcaacctccgcctcccggattcaagtgattctcctgcctcagcctccccagtagctgggattacaggcatgcatcaccacgccccgcttattttgtgtttttattagagatggggtttctccatgtttgtcaggctagtctcgagctcctgacctcaggtgatccgcccaccttggcctcccaaagtgctgggattacaggcgtgagccacccggcacccggctagtttgtcttttttaaaggttactaagatgattaaggagatgaaaccatttcaattggaaattagactgaacggatgacattcattgggcagataaaagaagcaagaagctgaaacctataaaaggttgtggacacaggccaggtgtggtggctcccacctgtaattctagcactttgtgaggccgaggcgggtggattgcctgagctcaggagtttgagaccagcctgagctatggggtgaaacgccatctctactaaaatacaaaaaattagccaggcgtggcagcatgtacctgtaatcccagctacttgggaggctgagacaggagaatcgcttgaatccaggaggcagacattgcaatgacccgagatcgcactgttgcactccagcgtgggacacagagcacgactccaactcaacaaaaaaggttgtggatggggtgatctgacactttttcaaaaaatgccaaagctttagaactacacagaaccatgaaacttttataaggtaactgaaagataagaaaatacagtgattctttacatcatttaaaaaataagcatcaagaactctataaatcactaataaatagaggtttaagaatggcttgggtaaactggtgggttagtaagtccataataagttatgcagctaggcggggtgcagtggctcacgcctgtaattccaacactttgggagaccaaggtgggcagatcacttaagatcaggagttcaagaccagcttggccaacacagtgaaaccccatctctactaaaaaatacaaaacaaaaactagctggacatggtggcacgcacctgtaattccagctatttgggaggctaaggcaggagaatggcttgaacccaggaggtagaggttgcagtgagctgagattgcgccactgcactccagcctgagcgacagagagacactctgtctcaaaaaaaaaaaaaaaatgttatgcaggtaaatcctcccatggaggtggttattgctccttccacccccgaacaccctctgtcgcttgggtaccctaagataccatgcttttatataaagcactgttcttgtgagaaatacgtgtaacctgtgttttttatgtttagagattttattccctcaaagttgcccccaaagttaaagccacagctgcgcctgcaggagcaccgccacaacctcaggaccttgaggttagtcccactaacttgctcgctggaagctatacatgccttactctccttggtaatacgaagacattcattatatctctactttattttaaatacagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctggtgagtatcttcacttcctcaagtgtttggaaatgctgtggtatcttggtcctgtgaaaaagaaaaactaagatcaatgtctttatattttgattccttgacctgccataacaaattaccacggactgggtagcttaaaccaaataagtttatcctgttacagttctagaggctagaagtccaagtcaaggtgtctaagccaagccaagatatcagcagggctgtgatccctctaaaggttctaggaaggcacaaatcctcccctgcctgttcctagcttccagcagttgcccacaacccttcatgttccttgacctgcaactgcatcactgcagtctctgcctttgttgtcacatggccttccttctgtctgtgtccacatttcctcctgataaggataccagttacattagatttagtgcccactataattcaatatgatgtcatcttaagtacttaaatctgcagagaccttattaccaaataaagtaacatgcaaatattctggctggacataaatttgggggggaacactgttaaacccagtactgtcccctaatgtaaaatgagaaaccacaagatatttgccacagagaagcactaaattagtatccatatgaatgttgatgttagagcataagaaatcagtaaacaaatttttaacaggaagtgccgcaaattgaaagaaaattaactctttttttcccatatacaagtctctttcagaatagactaatgaatccagtaagcttgtatttgacagtggaaattttacatgaatgtacttaatgtaaaaatgtatacttaagctttttgttgagccttgttttataattcttaactaaaaaggatgcaggaatttagtaaaattctttttaaatctgctcacaacagattttgatatagtgtgatgtttggcaaacttggcattgaaaagctacaaagataatcattctttctttttcaagacgacaaaaggagcttcatctttcaagataacccgtggaattgaagcagttggtggcaaattaaggtttgttaaataagtaatagaaaatagtgaaaatgccagaaaatattcaattttaagggaacttttctctgttatcaaggaggttgaggatttcttaagcaacataagaaggaaaagactgatgaatttgagtatatcaaactgtaaaacatctttatgtcttaaagtaaaaatttaagtaactgtctgggagtagatatctgcaatatataggcatacctcagagatgttgcaggttctgttccagaccaccacaatgaagggaatattgcagcaaagcaagtcataggaattttgtggtttcccagtgcatataaaagttatgtttacactatactgtggtctactaagtgtacaatgacattttgtcttggaaaaaaagtacataaccttaattttaaaatattttattgctttaaaaatgttaacagttatctgaatcttcagcaagtcataatctttgctggtggagggtcttgcctccacgttaatggctgatgactgatcaaggtggtggttgctgaaggtggtggtgactgataatttcttaaaatcagacaacagtgaagtttgctgcattgattgactcttccttttgtgaaagacttctctgtagcatgagatgctgtttttagccgtttacccacagaacttctttcaaaattagtcagtcatctcaaaccttaccacttttttatcaaccaagattatgtaatattcttttttatcatttcgacagtgttcacagcatcttcaaccaggagcagattctatctcaagaaaccactttgtttgctcatccataagaagcatctcctcatctgttcaagctttatcataagattgcagccattcagtcacatcttcaggccccacttctagttctcttgctactcccaccatagttgcagtttcttccccctctgaagtcttgcctctcagagtcatccataagggttggaattggcttcttccaaactcacgttaatgttgatactttgacatcctcccatgagtcacaaatgttcttaatggtgtctagaatggtgaattctttccagaaagttttttaatttactttgcccagatccatcagcgtcttcactatctgtggtagctgtagccttacaaaatgtatttcttaaataataagacttgaaaataaaaattactccttgatccatggggtgcagaagggatgttctattagcaggcatgaaaacagtgtcaatctccttgtacatctgcatcagagctcttggcattgttgcagtaataatttgaaaggaatcttttttctgagcaatgggcttaaaatattcagtcaaccatgctataaacagatgtactatcatccaggcttttttgttcatttacagagcataggcagagtagatttagcataattcctaagggctctaggattttgagaatggtaaatgacctcatcctaaagtcaccagctgcattagtccccaacaagagtcagcttgtcgtttgaagctttgacgccaggcattgacttctctagctacgaatgtcctggacggcatcttccaatgtaaggctgttttgtcagcattgaaaatctgtggtttagtgtagccaccttcatcgatgatcttatgtagatcttctggataacgtgctgcagcttctatattagcatttgctgcttcactgtgtactattatattaagaagatggcttctttccttaaagctcatgaactaaccacggctagcttcagacttttcttctgcatctcacctctctcagccttcatataattgaagagagttagggcattgctctggattaagctttgacttaagggaatacagtttgatctaatccagaccagtaaaactctgtattatcagcaataagtctgtcttgctttcatatcatttatgtgttcagtggagtagcactattagttttcttcaagaactgcactggtgcaagaggcctagcttttgacctgtatccgtttttaacatgccttcctgacttccttagaagcttaatcctttctagcttctgatttaaagtgagagacatgagactcttcctttcacttgtatacttaggggccattgtcgggttattcattagcttaatttcaatattgttgtgtctcaggagtaggaatatccaaagagagggagaaagacttggggagcagctggtcagtggaacactcaggacagaaacagcgtttctttttttttaattaatttatattaaagacagggtcttgctctgtttcccaggctggagtggagtggtgcagacataccttattgcagccttgaactcctgggcccaagcgattcttctccctccgcttcccaagtagctaggactataggcacatgactccatgcctggctaattttttattttttgtacaaatggaggtctcactatgttgcccagactggtcttgaactcctggcctcaggtgatcctctcacctcagcccagcatgctgggattgcagatgtgagccactgcacccagcccagattttttatatattgtgttgtcagtggtaaagatgatagagaatgtctcattctgctgataggagtataaattgatacaaccacttaggaaagaatcaaggaatatctggtaatattgaaaaaccccacagtttttaatcacattcacaaaggtattctttataaagactggaaacgatctaagtgtccatctttagggaaatgggtaaagtatgacagagtcatgatgagaccactatacagccattacggaatgaactagatccatacgtcaacatagcacaactgaagggcaaaaagggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagggaattggtcttggaagggtacaaaaagatcttcaactttatttgccattttaaaaaattgtggtcaaatgtatataacataaaatttatatatatatatatatatatacatatatatttatatatatatattttagacagtcctcgctgtgtcgcccaggctggagtgcagtggcatgatcttggctcactgtaacctccgcctcttgggttcaagcgattctcctgcctcagcctccgtggtagctgggattacaggcgtgcgccaccatgcttggctaatttttgtattttcagtagagaccatggtttcaccctgttggccaggctggtctcaaactcctgacctcaagtgatccgcccacctcggcctcccaaagtgctgggattacaggtgtgagccactgcgcccggcccaaatttatcattttcttaagtgtgcagttaagtggcattcagcaaccatcaccaacattcagctccggaacttttctatcttctcccacctgaaattctgtacctgttaaacaatggctgctcattctcccctcccctcagcctttggcaactgccattctcttttcagtctctacaaatttgactactccaggtacctcataagtagaatcatacaatatttgtccctttgtgactggcttattatccttagcataatgtcctcagggttcatctgtgttgtaacatgtgaccagatttcactccttttaaggttgaattatttgctggtttttaaaaaaattttgaattttagttggttaatatgtggagttttgttatattattgttcgcaccttttatacttcagaaattttctttccaaaggaattggttgatagaagattataagggaaagcttactatcctgattcagatgatttactctagtttattttccgattcagtgtgaccgcaacaagggaaaacatggcttatactgtggaatgcctgcggggtgatgtgtaagtacctgtgtgtgtttaggacttctgctttgaaagaaatactaagctgctcacttctggtctttgtaatgcgtcattatgacctctgacttccattttggattattgttcataaactgctcaaaaacactgcttaccacaagacctaaagtttcacattgagagcattacagctatgtagaatctcaaatgttggctttacatttttgactcataattcttatctcgatgtcttctgtagtgatattctaatggagttcctgctcaatgtcaccacagcaccagaatttcgtcgttgggaagtagctgaccttcagcctcagctaaagattgacaaagctgtggcctttcagaatccgcagactcgtaagtacatttccagatcacatttgattctaagatactgggttttttagaagatcaatttatagaagaaaaaaaattgctgtcaaaatttttatttttatttttatttatttattgttttgagacagagtctcactctgtcacccaggctggagtgcagtggcacgatcttggctcactgcaacctccagctcccgggttcaagcaattctcctgcctcagcctcctgagcagctggaattataggtgtgcaccaccacacctggctaattttttgtatttttagtagaaacagggttttgccatgttggtcagactggagttcagtcttgaattcctggcctcaagtgatccacccacctcagcctcccaaagtgctggtgttacaggtgtgagccaccatgcctggccaaatgttttactccttgaatttgaaaatatctttttcaaaaatttgttatttagatttattattcttttgtttctaaacatttataatcatttttcatgtttgatggtaagtaaattgtttgtaagatcctagaagtttttcctgtttccttcccaatgttttgtttttgtttgtttgtttgtttgtttttgagacagggtgttgcttgttgcccaggctggagtgcagtggcacaatctcactgcagcctgaaccttctggactcaggtgatcctcctacctcagcctcctgagtagctgggactacaggcacacaccaccgcaccctgctaatttttatttttatttttttatagagatgaggtctcactctattgcccaggctggtctcgaactcctgggctgaagtgatcctcccacctcagcttcccaaagtgctgggattacaggcgtgagccactgtgcctgacccctagtgatttttaagagttgttttgcttaccccaaatcctacaccagtttattgctgctgctattattgcttactattgtattgctattattgtttagccatctcctctttattgagtctttccaaagtaagtaacttaatttttttaataggaatcttttttgcattcatattttatgtttatataatgtctaattatataatcttgacaagtacaactggtaatacaagtctgtaagcaagcgccgctgactcttgggagtcatacaacttctggtgggagcagaaatgtgcaggaagagcagaaatagctcaactcagtggctcagcatgggacaggctcccctccacatgcaggcctggggactgatgttatttcatgatgatgcttggtgtcacagaggagcattatctttgttgctcaggatttctactgaagaaatagatagaatagtacaattttagaaaagatgacctatgtgtccagagtggcttcttccccactggcggcagtgaggcaccagcctgcatctattctgcctgaacagttactgtgtagtctcctggctggtgtcagcctccaggtttacgtcttgagtccatctcccacacggccattacagtgatccttctgacctgaaagtaagccttcttattatctatgggataaagtccaaacagcatatacgtatatggccttgcgtgatcttaccccagcccacttctcttactttatgctctaccctcttctccttccagctgcaattcccatttgaatcaaattattgttatactttatgcctttgttttgtctgcttcctgtgcctaaaatgctgttcccaaatgatttcccctgggaaacaccagctcattctgtaagatggatcccacatattacttgtattaattgttttccaattcccactgcccttgccttgtacctctactgcacttttgacacactgccgacattgcacccataatactttatttcacagtttttcctcttaaaatttgagggcaggcattgtatgttccacatctctgtatttctagcacctagcacagtgcctcgcataggcaagttgccaggtaatgagcaactgaaggaaatactgcaggcaaaaaggcattgaagcaagaaagcagggaaagcaccaagcaccacagaggagtaagtcccagtggaagctcccattggtcccctgaaagctacctgacaatctccttattacctagagaggaaacctaggagtaagtaaaattcagattaaatgacttgtccaaggtcacatggcacgatggcgcagaaccataactagatggggacttcccaaaacccaggccagtataccttccaagtgataccagctaggttaaagttagaaaagtggtttaggtggactccagtatatagaagctgctgccatgtaatcttttttatttttttctcagcacattctactggcagaaactggcagttactagaggttaaataataataaattttaagtcctcttaacatatgaatgccagaagatgaccaaatttgtataggcttgttgctttctaggttttaaaaatgttgtctttactgaaagtgcatttccctaaatgcttcttcacttatctcacagatgtcattgaaaatttgcatgcagcagcttaccggaatgccttggctaatcccttgtattgtcctgactataggattggaaaagtgacatcagaggaggtaccaataaaacatattttgaaatgtgcttgtttttcacattaaattgaacatctcccatttcaggtttgtttgttaatttttccttttatcttctaactttaagaaattcagcgtgctagctttttcatccacctgctttttaactaaaattttatctgaacaatttttgtgtctcctttaagaaatgttttcatgactaaagggacatgatcattacagaaaaattaaaaagtaaaatcaaacaaaatgaagggaaagaaaacatctcacatacctaaaggcactcagtgttaatacctggtatattttcttctaaaccgttttctgtgtgtatgtatcttttttgtttgtttgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagtggctcatgcgtgtaatctcagcactttgggaggccaagacagagggatcacttgaggccaggagttcaagaccagcctgggcaacatagcaagaccctgtctctacaaaaaaaaaaaatatatatatgtgtgtgtgtatacatatatataaaataggtcctttgactaaaactctttggtctctctgaatttgtaaataagacttgagcccacttccttagctcctgttccatcctcgctcactcattcacgttcttcagcacaccagcctccgtttgctggctataggggtttgtcacatgccacagccatatgtgcatcttagaactttgtttccaaaacatgaaacattgaatgctaaatctacaagtgtagatatgtgcgtataatcttaatttcctattcctaccacccagacccaaaaacaaattttatcaaaagacattaagagaaaaatttgtaattatcaacaccttcaaagtatatctgactcaaaaattcaaggtttttattctcgttttattcttagttagctgttacagaaaactaaactgtatcccttgctctttttgacttatcaattaacagtttgatgcctttcattcatatggcacttttatttagaaattttaacttacatcatccaacttgaacaggcagccgttttcataagactggactctaatgagttttgaaatttttcagaaatcaaattcaccctcatgaagatgtgtcattaagttagctaaaacttagcaaaagtttatctacaaggatggctattgtaatactagtttataattgtgaaaaattagaaacaagttaatatccagcattagggaactagttaaataacttatagaatggaacagtattcaaccattcaaaaatattagttgatacataaaactccacagcatgttgtcacataaagcaatttatggattaggacataccaaaaggtcccttttttttaataaaaggtatgtatgtatgcattatagacaaatatcaagatgttaactgtgataacttggttatctcaaagttaatagtattttttaaatgtgtccctaggctaaaggaaactctaaagaaattggcgctagaatacttggagcaatggcagcatcaatagaaaaacatcaatagaaaaagagtatgactttccaaggttactccataggtacagacaccattcattttagggcacggattatgataaattgattaaaagttcagtttcattactttagcccagtgattctcaaaacgttatcactttccttcctgaggagcctttctagccatttttttctaaacctcttacttttaataccacagatagagtttatgtgctgtatatttgtactttttacatagaagtcgtaagttttttttttttcttagttaccccaaaccaattttcacccatctggaaaggatagcatttctgttgaaagtacatgttttagccctacttttgtatattaagcctaaggtggtaatataaaccagtgataaccaagtctcaccaatcttcagatcgcctgagtggttgattggatggatgggtagttggtcggttttaaataaggattctaggattccacatttaatattttatatcagtctgtagggtaagtcccaagaatgggggacagtgaccgtttttgtttttcaagctgagtaattgtgatcttacagtttcgacaccctggtatagacaatgacttcatggtcagaaaagctttatagagattggcttcaaagatggacgagaagggtgttgtggtaaaactctgttagccctgttatagaatgttaatagtgcttcattactacttatataaacacaaaagaaacctgacatactacgtaagctacattataataaaaatcatagtccacgttttcaagtttaggccagtgtatgctctaatttctttttattcctttttttttttttttttttgagacagagtcttgctgtgtcgcccaggccagagtgcaatgacacgatctcagctcactgcaacctctgcctcctggattcaaacaattctcgtgcctcagccacccatgtagctgggattacaggcgtgcaccaccatgcctggctaatttttgcatttttagtagagtcaggatttcgctgtgttgcccaggctggtctcaaactcgtggcctcaaatgatccgccagccttggcctcccagagtgctgggattacagacatgagctactgcacccagcctctttttattccttttataaataacagctttgttgagatgtaattcaccatactatacaacctatttaaagtgtacacaattcagtggttttcattatattcacagagttgtgcaaccatgaccacaattaggttctagttcttttaagcaatagtttttataataaaatcccagggtaattcacctcagttagtaccttgtagttcattacagcaacttataaggccttataagtatttattttcttccaaactgtacttttatgtttttacagctttttatatttatgctaatataacctaataagtgtttttaacttcctcagttacattacttcgttcagaaccatttcacaagtgcaagaatggctttgattggacttggtaagtttagagtattgcctgcctgtcagtttgcttccttaagagcagttccttaaactgtaattacgtgaacataggattgaacaaaatttgaaaacttcggccttctatttatgtcagacaggcaatatatcataggattttaattgctagtcatttgttttggaaagcagaatccaacatttaaatttgtaaaccactggctttaaattctttacagtatttgtaaaacctgtgacaaaggtgaatttctcaaagcaaagagcttttacaaacttttttaaaaggaagtacagcttactagaaaaacaggcaaagggcatgaacagacagttcatgggagaaatatgtttgtatatgtgtagccaactatctttgttttaaatgatcagcctcactaataattaagaaaattttaatctgtgatgttggcaaaattaaaagatggactctgcccagaattaaccagggtatggagaaataggcactctcacaaattgttagtaggaatataaactagtacaacattttgggagatctttttgaacatatctgttaaaattctaggctgggcatggtggctcatgcctgtaatcctagcactttgggaggctgaggcgggcggatcacctgaggtcaggagttcaagaccagcctagccaacatggcgaaaccccgtctctactaaaaatacaaaaattagtcgggcatggtgacacatgcctgtaatcccagctatcggggggctgaggaggagaatcgcttgaacccaggaggcagtgattgcagtgagctgagatcgtgccactgcactccagcaagggcgacagagtgagactctgtctcaaaaaaatacaattccaaatgtttacactcatagacccagtgacttttaagaatttgtcttacagaaacattaggtcaagtttacaaagtagttgcatgagaatatcatttgtaatattttttgttttgttttgcaaattacagcttaagatataatttacatgctataaaattcacccttttgaagtgaatagttctgtggtttttaacagattcaactattaccactacctaatttcagggtgtgttcatcatccccccaaaagccccatacccattagcagtcactccccattctcatcttccccctgcctgtggcatccactaatctactttgtttttgtttttttttttaaagagatggaggtctcattctgttgcccaagctggagcacagtggcacaatcatagctcactgccttgaactcctaggctcaggtgatcctcccacctcagcctcctaagtagcaataatctactttgtctctatagatttgactattctggacatttcctataaatggagtcatacgatatgtggccttttgtaactggcttttcttacttagcataatgttttcaaggtccgtccatattgtagcatgtgtcaattcaatgtcttattcccttttatggctcaagaatactccattaccacattttgtttattcattgattggcatttgggttgtttctaccttttggctgtcgtaaatataaacattcacgtgtacatttttcttaggaaacctgtttttagttcttttggttatgtctaagaacagaattgccaggacatatggtaactctgtttaaccatttggggaactgccagactgttttccaaagtagctgcaccattttacattcccaccagcaatgcacaaaggttttgatttctccacatcctcaccaacacttatcgtctgtctttctgattatgaacaacctactgggtgggaagtggtcattgtagttttgatttgtatttccctaatgacaaatgacattgaacatattttcatgtgctttttgtccatttgtataactttttttgtttgtttgtttttttgagacagaggcttgctctgttgcccaggctggagtgcagtggcgcaatctcagctcactgcaacctccacttcccaggttcaagcaattctccggcctcagcctcccgagtagctgggattacaggtgcatgccaccattcctggctaatttttgtaattttaatagagatggggtttcaccatgttggctggactggtctcgaactcctgagctcaggtgatccacttgcctcggcctcccaaactgttgggattacagatgtgagccaccgtgcccagtcaactttggagaaatgtctattcaagtctttgcccatttttaagtttttttttttaattgttgagttgtaaaggttctttatatattttggttactcaagctgttagcagatatattatctgcaaatattttcctgcatttcatgggtcctctttttactttcttgatacagtgttctttgatggacaatgcaatgttgttttaagagctaactattagaaacatgctagcgtccattaggaggggattgatcaaataaatggtggtagagccatagaaagggattctttataaccattaaatatttgatgtagactactcacttagaaatttgtaaattatgaaagataagttagaaacaatatcaatagaatgataccattttagaaataaattgaagataatattaactacacagaaaattctagatgaatagtaatactaagtatatagtaaatagtttagtaatagtaaactgtaattgggtatctctgggagagtggcattatggcaggaagactcttatttattttgtagtgttaggattttacaatcgtatttttaaaacaaggaaaaaatattttacgattgtgttttagtaattgtggttctagctttgtttttgcttctgttgaaacaggtgtgagtcatcctgttctaaagcaagttgctgaacagtttctcaacatgaggggtgggcttggtttatctggtgcaaaggccaactaccgtggaggtaagcatttcattctattagggttaatttatcagaagggcgtttccccactagaatagcatattgaggtggaataggcctgaatatttactactgaacagtctcggcatagaattggatggcttgggtgttgtattttgagcatatgttttgtgtgtgtttggggacaggatggcatggggaaagcaccgagccgcagaaaagactcgtgggttaatactgtgttgtaggaaatactggagaatgaaaccaatggtgaacaagccattttcttcttccctctatccttaatctggccccaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtgagtctgaacagttggtatctctctttttgctttcaaaggctcagtatttaagatataattctgataatctactcttaaaatgtaagacaaacacacagaaaatctttgtacaattgaagagatagccaggcttgattttagtatctttgaaggcctatcaaaaactcactggcttttccactttgtctattacttgtcattagtaatataaaaagaggaattgaatgcttagaaataaagggaatccacacatccgttccctttagaataaagttgtagatattaaactttcccctagattctaactagtctttttttctagattttcttctgtccgcttctgttcttttggttacttcctgaatctcactatttgttttccaaccaagtggacaagatgaacaccaagaaattgtttacagactcactcattcagcttgagattaaatttgaaaagaaaaatgagaggctgggcacagtggctcacaactaaaatcccagcactctgagaggccgaggtgggcggatcactggaggtcaggagttcgagaccagcctggccaacgtggtgaaacccccatctctcctaatccaatgaagtaatttaatagaaattcctagttcagaactcagccagaaatttagagtataaataggatggcctcagaattataattaaagaaattgaagtccaggccaggcacagtggctcacgcctgtaatcccagcactttgggaggccaagttgggcggatcacaaggtcaggagatcaagaccatcctggctaacacagtgaaaccctgtctctactaaaaatacaaaaattgtctgggcgtggtggcgcacgcctgtagtcccagctacttgggaggctgaggcagaagaatcacttgaacccaggaggcggaggattcagtaagctgagatcgtgccactgcactccagcctgggtgacagagcaagactctgtctcaaaaatatatataaataaataaataaaagaaattgaagtgccttcttatgctttacatggactgagccaatggttctccaagtttattgtacataagaattacctggaacacttgttaaaaatctgggcttccaggctgcatccacagggacctgagtcagtaggtccattttgggaatctgaaagtttgtatttttaataagaacttagataatttttatgtaaatggtccacataaacactgcaaatcgggttcaccctagagagctaaaagctctgctcaaactagataacaatatccctgttattcagaggttaaactcttgatagcttggacatctggataatgaccactaagcagaaatttttctctaactttctgacatgagtgtataagagaaatgaaagtaaattggtgaaaaagtccctaccaacagcagagagaagaaacctggtctgcctaatgccaaagcctatctatattataataataatgtttgcagattagtgtttgcataaacctttaatcatctaaagcaggttagaaaatacccagcataaaggaaagggagcagtcattttagaaatatttaaatgaaaaaacaaagccgtgatagttctgaaagaggtaacctatttacagaatacttcagttcgtgacagaactggctaagtaaaatattaatctattttgtttataccgtgaaggtccaagttttttctaggcaaacttaaagaaatcgtgccctgttttacttggtagaatatcatacagtaaagtctcattatctttcaggtttctgcatttaatgccagttactcagattctggactctttgggatttatactatctcccaggccacagctgctggagatgtaagttgcaaactcaccaaacttctttcatgaacaagttatttctcccccccgccataaacatgttttcggttaaaatatggaatgtttgaatgcagtgcaatgacttatcagagctctgtatagtatgatgtcattgaagcattatctgctatagggaaatttacacatgtatactaatgcttccaggaaagaggagagaattgcctccttcatgttttggttctggttggacaagttgcattgagttggctctgagacatctaaattgagaacccaggagaggggaagaccaggaggtttatttgcaagtcttcagtgtagagattgtgttgaaatcagggatatgtgtgaatgattgtaggaaaagaaaactaaagctcaatttctgggaaacaacaccatttaaggagcaagtggctaagaaaaatggcccaggtaaacagaaagaaaaagagaagctgatatatttgaaggataggaaagagagtatgtttaacaccattttgacccacagtgaaataacattcattaccactgagaagtctggtagtttcagcaagctaggacatcatgggtgatcttaacagttttgactagagtagtggaaattgggtaaaatgtgtagtgattaaggaatgaatgacaagtaagaaatgagaggttggtgtgggctagtggagcttagacattcaaggagcaagttgttttaggagagtttacactgagagattaggttgaaagagacatactgagcaaaaagatcggagcagatatcggagatagaaaattataaatggctcaagtctgagaaaggaatacttgggatccagcacacaagtggaccttttagccttacagacaggctaatattggaagatattgggaagatggggaagtacctcctcagtgagacaggaggctaagtcatgttttgacagacgtgagaggaaagtttaaagaaagtagtgaagtttgggacagacaaatagtgaggtacacaaaaagtgggtattcgctgtagtgtagatgtatccttgaaatcagcgaccacaaattcatagtacagtcagtcagcactgtcatgtaatttttcttcagttgcattcagaagcctaatagagaaatggaggaggtaggtattagggttaatcccaggttggaatcctgcaaagtgggcaggtgagaagtatgaggagatagcaagggagttgggagcattggcaagagtgattaaaaggatgattcagggatctaggctcaatagagaagtgaagccagagggggcctgataaattgaaagactggacaagtcaaggaactagagatcttgataaagtggaagaataaggatagtgagattaaagactgaggtcggggtcttagaattgagggcttcagaggtatgcaaatttaggctatgatcaggtctggggtgtggctctgaaaatgggcagctaaaatgaaggggaaacagaggtcctagaatttaggtgatcagagggaaaaataagtagcagacccagccagcactgggatggagaaaatcatggtcagatttatttatttattcaacaaatatttaccaagtacccacatccccggaactttattctttctttctttttttaaataccatacaaggattcagattccttcttgaccctggcttacaaagtatggacaagccttacaaattggctgtgtatggattactactctcttcttagtgaatagtaagagatagcagtattaatggcatgacactgcaagagtctggggaagttttaaaggtgcttattctttatgggtgattagaaatccatgtgtttggccgggtgtggtggctcacacctataatcccaacactttgggaggttaaggtgggaggatcacttgagcccacacatctctacaaaaaaagctaaaaaattagccaggcctggtagcatgcacctgtagtcccagcttcttgggaggctggggcaggaggattgtgtataaacagctgctttatgaacataggaagaataaggaacccatagtgatgacagcattccgcatggacactgtgctgtttgtctggaactaaccttccatctgtgtttttgcctcagtaaagaagtgtgtcagtgctgcaggagactctggtactgaccacagatgaccaacttttcttatctgtcctaggttatcaaggctgcctataatcaagtaaaaacaatagctcaaggaaacctttccaacacagatgtccaagctgccaagtaagtctcagtattaactgtgttttatgtttttgttatttgaaagttgtattcttttcagattataacaatattacaatctatgctcataaggactgagaagtacagaaaagcgtaaaaagggaaacatacccatatcctaccacctaaagatataattgttaacattttggccaggcacagtggctcactaatcccagcactttgggaggccaaggcaggtggttcatttgagaccaggagtttgagaccagcttgggcaacatagcaagacctcgtctccaccaaaattagagaataattgttaacatttttcttagtttattgatcatgcatttttaaacataattgttaatattgtatatatagatgctgcttgacttacactggggttacgtcctgagaaatgcgcatatcgaaaatgcatttaataccctaataacccagtcatccagccaaacaaacataagtcaaaccatcataagttaagttagggaccatctgtatacttttttatcttatttaaatagcatccttattatagaagtttgaaaattacaaataaaagacaaaaatgatctctgatttccctagcaatgattctgtttccattgattcaaattactaaaaatttaaacaatattcattggtgtgtcaaaatacacttgtgcattttctgcagttataaagatatctttgggcttaaaatatttttgtgtttcgtattactttcttggtgtagattcccaactaagttaagagttataaacataacgaaagactccatgttagagtgtgtgtatgtgtgtatgtttaaataatacatttgactaggcgcagttgctcatacctgtaatcccaggactttgggaggctggggcaggaggatcacttgaggccaggagttcaaccagcctgggtaatgtggcaagacactgtctttacaaaaagatatttaaaactagccaggtgtggtagtgtgtgcctgtagcctcagctactcaggaggctgaagaggggggattgcttgagcccacgagtttgaggctgcagtgaactaagatcacgccattgcacactagcctgggcaacagagcaagaccctgtctcttaaaaaaaaaaaatgtatttctaagtcacaaatctaaagagattgtaccagtttataatcataccaccagtatataagagtacctattctacaatagtttctttcttcataactaatttatacccaaaaaagatctgattttgttttgttttataagaaagactaaaatacttgtctgctatttggcaatttataaatccccactgtccagattgaaagtgctatcaacactcctaattcattagtagttcgagggtttctctaaaagagacagacttgggacaaagttggaaatcaacctgcattttcatacagccgcttaagacatttaagtttgactccatctacttagaacaattcaaaatgtgaatcttgcaactccagtggtcgttatgatcatttagtattgcccacaggggaagcagaattacaacccaggatggaacaaccttttggtcatttctgttcccattagtattgttagttttgttatgctgagcacactacaaagttgcatctcttgtataagtacaacacaatttattaaatattgtatacatagaaccaagaatcgataggatgcagggctgcttgattgtaccagaaacaaaacatgatgagaatacattgaaacactggatttacttaagaaaaacctaagtttttcaaatctaatttatttaagaaaacgtattttcttaataagtgtaacacagttcttacaaggtatggtaataagcagaaagtagaattttgaatattaatgtcaaagtatgttttctgccattttgatggagttgatactttttcttgtaagttcttcctgtagtgaaagagagaaagtgaggtgtcattgccgaaaggacacactaataacctcttggtagtttattgcaggtaaaatcattttttaattaagctgacaacgtggtaaaactgcagcattaaattgtaattatgtttaaatggaagtctttctgtagagtgttaaaggatgataaacgtttgaggttcaaataactcgactgtcttatcaaacaccatgtctataagtaataagtttctgggagaattgtgaattggattttgttttatttcaagtggatgcttttgtgcccatatttaagctgccgttgcttacaagacctgtactgcccttccccacctgccttttccatcataccctatgctcacagacaaatatcagcaagaggcaggagttgcttcactaatcaaaaccttacattaaaatagttttacctagatctaagttctagtcccaaatcaaaaagcaatctgtggagttttcagtataatttcgtactgacagctttccaaatagtaacgtaaacggttcacgtacttggtgaactgaagaaatagaatggaggccattagcactgtaagttgttagtttgcctgtttaccaaaaatatgttgagtttcggggcacataccttaaaattgccctgtttcactgtgtaagaggaactggcttgactacttcacccttggtgaaaacaaacaggccctaaaagaggcagcaacagctgaagtggatatcacagaaataaacagacagcagaagctcttcagacacccccgaaacctgccaaaactcacaggtaatacaagtgaaacgatagcataagaagaaaataaacatgagaatcttcaaactacaagcattgaacggtatcctccatccaagaagagaacccacttcatacaaggaaaaggcaaaaggaaaaggtcaagactgtgacctttataacactgtgaccccagctgtgggccaggtggagttgtctgtggtgacaccaagtacaggcctgacaccctggtttgacagaaggctcttcaagatccctggtcttcacactgtagcagccaaaaggtaggtttacaatatacactgtccccaacttgccatggatcaattataatttttcaacttgactatggaggaaaaccatcgcaatttcagcttccagtcatgggtcacataacgatggggatacattctgagaaatgtggtgttaggtggtttcatcactgtgtgaacctcagtgttcagacaaatctagatggtatagcctactacacacatgggctctatggtatagtctattgctcttaggctacaaacctgtatagcatgtactatagtactgaatactgtaggcagttataacacaaaggtaagtatttgtgcatctaaacataggaaaggtacagtaaaaatacagcacaaaagataaaaaaatggtatgccatttttatggcatagctcctgctttcgagtgagtcagtgagtgagtggtgagtaaatgggaagggctgggacattactgtgcactgctgtagatacttaaacactgtaaacataggctacgctaaatttatttttttaaaattgcactacaacattatgttgtcagtaagtaataggaatctttcagctccctaataatcttaacgggaccaccatcatatatgtggtccatcattgaccaaaaacatcattatgtagtacatgactataccttgaatttcgatcttttcctaggctagtgatatgcagtacatgagataatcaatgcttccttacaaaatgggcttatgttagaagacttttgcccagctgcaggctattgtaagtgttctgagcacatatgagataacctgggccaagctatgatgttcgatacgttaggtgtattaaatgcacttttgactgccatctcagtggatgacagccttctcactgacagcagagagatcttcctcactgtgccagtgggcaggagaaagagcatgctgcgactggccagtgacatgcagaggatccagattgcacaaccggatccagaggccttgggaagcattagggagctctccagctgtctcactcaaatctgtagcagcatatggacccacaaatggaggccaaagtgggccctcaattggacactttggcaaccctgaagagacttcttcccttcagacttactgttttagtatgttccagagaagggagtggcattcttcttggggaattcaggaagagggagacacgctgttactctatccattaaataaagctttgatgttcacagccccccgccaccactcagaaaaaaaaaataattgccttgctctctaaaactgacttctgccttttattggacaggaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgtaagtaaatgaaaacttaacgatttaacaacagagaacttaaccttaatgatccaatttcagaaggatgcataagcgtccttgggcagtgtattattctcatgtttggtgctcatctacttaatgtggaggcaggagggctcattcccataagatccgcaacaagcttccctgtcagctcgagtatatgtatcttcctccttcaaataaactaccattaggttaaactgtgatgtcagtaagagggctgccatccactgagatggcagtcaaaagtgcatttaatacacctaacgtatcaaacgttaggttaaactaatggtagtttataaaatgggcttatgttagatgactagaagtaaagaagagtcaaatattagcagtttcatatgatccaacctaaatagtgaagtttgctatttttcctcttcagtcctagcaatatttcaccatctagcatcttaagattttctttactcttctcagcctaggacattctcttgttcttgctaatttttttttcacatatattattgttccctacaatattgagctgttttgagggcaaggactatgtcatgtacttctttgtgttccctgctgtgcctaacaagcacatgacctacagaattaatccaaagtaagtgggttttccccattttctacattaaacttgccaacttgctttctactgtagatgtctcggccatcttctcaccaacaggtctaccttgtatagggacagtggggataagaaaaaataaaaaactaagctgggtgcagtggctcattcctgtaatcccagcactttggaaggctgaggtgggcagattgcttgagcccaggagttcaataccagactgggcaatgtagcaaaaccccatctctacaaaaaagtacaaaaattagctaggcttggtggcatgcgcctgtagtcccagctactcaggagctcatggggctgaggtgggaaggtggcttgagcctgggaggcagaggttgcagcgagccgagatcatgccactgtactccaggctgggcaacagagtgagaccctgtctcaaataaaaaagagacaaggctattttaagatagtaaccctgacttgatttcacttcgccccaatcgtcatttcatactcttcttttttttttttttgagacggagtcttgctctgttgcccaggctggagtgcagtggcgcgatctcggctcgctgcaacctccgcctcccgggttcacgccattttcctgcctcagccttcctagtaactgggactacaggtgcccaccaccacggccggctaattttttgtatttttagtagagacggggttttaccatgttagccaggatggtctcgatctcctgacctcgtgatccacccgcctcagccttccaaagtgctgggattacaggtgtgaatcaacgcgcccagcccatttggtactcttttaaatggctgtcttcatcttatatcctatcattatgtgcgtcccaacccgactgcttccaccaccacctctccttcatagtaataagataagctggcctgacagaatatgggggctgctgctccacctacacctgactcatgatactacacttaaccagcctttgaacttggaagtagtggcataaagaatcctctagggtatcaagttttacttttaagttaacaatcaatgtatttttattgacccagactatttgccattgtaataccgaaacaggaaagtatatccctgcctgaagccacactactctatttgacagtgtcagtgttgttttccttatctctctttgaacagctaccctcttaccagtgttgctcttgcttggttcattacacatacaatgggactttcagagaaacagctaagcttttcctcccacactgtcccaaattaaagcaccagccatctcctagttaattttcacaacagctattatagtaattgctggcttagaatgtcctatcgaaggccaggttggtggctcacgcctgtaatcccagcactttgggaggttaaggtgagtggatcacttgaggctaggagtttgagaccagcctggccaacatggcgaaatcccgtctctactaaaaatacaaaaattagctgggcatagtgatacatgcctgtaatcccagctccttgggagggtgaggcagagaattgcttgaacctgggaggcggaggctgcagtgagccaagatcgcagcactgcactccacactgggtgacagagcgagactccacctcaaaaaaaaaaaaaaaaaaaagaatgtcctatccataaattcttgaaatgacaaaataagttcgcctgcttgatgatatatatttttatttttgttaattttgtcttttgtttgtttctttaaaggcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacatacatttcctatcaatcatatcctatattcccattcattcatttttttatgtctgatttatcttcattgacagagttttgtttttctctcatctcctgtctctcccttatctgttactatcctgtctcttccaaataattaactctcaattcaacatttacagtaaaagaagggctaaaaaggggaaaaaaaaagaattctaatgtgaataactagccaaagaattatgtctcttagttattttaattatagtacttgaagtttaccaaaaaaaagagagaaactaaatatttaaagaaaaatgtagtgtttacataaagtgacattctctactatgttcagacattctgatattggatttctctacggcattttctaaaagaaagaaattcttctcaaaaaggagggtcttattctgaaaataagatttgtgaggcctgcaagaacccaaggaagtctttagataatcctgttgaagaacatctctaaaggctttataacgcagtcataagagaagagaattggtgagtctacagacagtccttgataagtacagcaaacttgtgcctggtgaggcacaaaacttgggtgtctgcaagataaatgctcatatgaccacagatttgctaaccaacctttgataccagttgggctttaccctcttcaacttgggcacaatcttccagccaaaatgcatctgaggtagaggaggtagaggaggaagagctttcattgtcttgcttcaccattatccagtatggagaaggggccctcacttctttcttgtcgtctctgtgaatcatcacgtcacaattaatgtcttttcctacactaatagtatggttcttcttcttatatccatgccagtctctggagatggatattggtctccttgcagggtgatgcacagttgaccacggatatctataatattgaagtcttttatctaaatctacattttcattatcatcactgcttgtgaaagattcatcttttgccagctcaattttctttggtgtgctgaaatgaaaagaatagtgaataaaatagattcttcatgtctaaacatttatggtcccctaacaagatgccttataacttgctttgactcataaaagatacaatttagctttagcattacctttctgtgtcattgaaatgtttctcttttttaaatcgtcttgaaatctttttccatttctaaatggaaatcaaattctgccttaaattacttcaccataccttaaaaagttttgcacagacttatactagactactgaccagaatattaggaggtgttaaagggtaggttaatttcactgcagctaaagtgacggattcaacctggccatctcctgagaactctattcttgtggctcacgtggcattaacacaacattactgatttccagaggagtcaggaagtcaggaaatagtgggccttaaggatcttcaacatcctagtcattagtaagtcttagagtcttttttttagagagggtcttgctctgtcacccttgctggagtgcagtggtacaatcatagctcactgcaaccttgaattcctgggctcaagtgaccctctggcctctgcttccaaagtagttgagactacaggtgtgtatgctgtatgccaccgcacctggctaatttttatttatttttatttatttatttatttttaaaacaggatctccctatgttg

SEQ ID NO: 17589 - DNA, 43117 bp, Human
tcaaggatctctatcgaacatattgcagcttgtgtctagaagaatgagagtggggatcgagaaagatgaggaaaaaataatataaacactataaaataatgtaaacaaggaccctgtagggactgatatgacaatgtgctgaaaattgaggagcaaagttaactctctgtacctgagataaaataactagctaataggaatccagctgaaaaccttaaggtgcagggcctctatggggcccaggaaggatgtgtagagacatgaacggatgaaagtgcatcacaggttcagggaacaacacaggttgagtgtggcttgtagtaaaaatggttgtgaagagttgacatatttttaagccctgggtaaattgaacaacagcttacacttggaggggtataatcattctaatcaatgtgtccccttttactataatacattggagttgcagctaatgctctgctcccattcagcctatgatgagattctctttcagccctattgggttcttggcctcatgtgactactccaaagaccctagtccaaaaggtctttcctgtttgctatggccttgaggaatgtggccctagatccaccgctttaaagctggagttccaccagcagcaacatcctctcattctggggcacctgcctggggcaggtcatcctgcctctgccaactcagtgctattagttaactctcacctgccatattccagctggaatcatctccccttctccaccccagactaggtcatgttccgccatcatggaagcgcctattcttcataccccttatcacagctgcaactactcatttacttgtctgacaatttgatttatgtccacctactttgctaggtactaagttcaatgctggcagtcgtttcttctttttttttcttttctgttttgctcaccgatttctcgttagcacttagcacagtgtctggcacacgatagatgctccgtcaacttctcagttggataccagcatcccgaagggaacatggattaaggcagctataagcacggtgtaaaaacaggaataagaaaaagttgaggtttgtttcacagtggaatgtaaagggttgcaaggaggtgcatcggcccctgtggacaggacgcatgactgctacacacgtgttcaccccaccctctggcacagggtgcacatacagtaggggcagaaatgaacctcaagtgcttaacacaatttttaaaaaatatatagtcaagtgaaagtatgaaaatgagttgaggaaaggcgagtacgtgggtcaaagctgggtctgaggaaaggctcacattttgagatcccgactcaatccatgtcccttaaagggcacagggtgtctccacagggccgcccaaaatctggtgagagagggcgtagacgcctcaccttctgcctctacgggtcacaaaagcctgggtcaccctggttgccactgttcctagttcaaagtcttcttctgtctaatccttcacccctattctcgccttccactccacctcccgctcagtcagactgcgctactttgaaccggaccaaaccaaaccaaaccaaaccaaaccaaaccagaccagacaccccctcccgcggaatcccagagaggccgaactgggataaccggatgcatttgatttcccacgccactgagtgcacctctgcagaaatgggcgttctggccctcgcgaggcagtgcgacctgtcaccgcccttcagccttcccgccctccaccaagcccgcgcacgcccggcccgcgcgtctgtctttcgacccggcaccccggccggttcccagcagcgcgcatgcgcgcgctcccaggccacttgaagagagagggcggggccgaggggctgagcccgcggggggagggaacagcgttgatcacgtgacgtggtttcagtgtttacacccgcagcgggccgggggttcggcctcagtcaggcgctcagctccgtttcggtttcacttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggtacttggctctagggcaggccccatcttcgcccttccttccctcccttttcttcttggtgtcggcgggaggcaggcccggggccctcttcccgagcaccgcgcctgggtgccagggcacgctcggcgggatgttgttgggagggaaggactggacttggggcctgttggaagcccctctccgactccgagaggccctagcgcctatcgaaatgagagaccagcgaggagagggttctctttcggcgccgagccccgccggggtgagctggggatgggcgagggccggcggcaggtactagagccgggcgggaagggccgaaatcggcgctaagtgacggcgatggcttattccccctttcctaaacatcatctcccagcgggatccgggcctgtcgtgtgggtagttgtggaggagcggggggcgcttcagccgggccgcctcctgcagcgccaagagggcttcaggtctcctttggcttctcttttccggtctagcattgggacttcggagagctccactgttctgggcgagggctgtgaagaaagagtagtaagaagcggtagtcggcaccaaatcacaatggcaactgatttttagtggcttctctttgtggatttcggaggagattttagatccaaaagtttcaggaagaccctaacatggcccagcagtgcattgaagaagttgatcatcgtgaatattcgcgtccccctttttgttaaacggggtaaattcaggaatgcacatgcttcagcgtctaaaaccattagcagcgctgctacttaaaaattgtgtgtgtgtgtttaagtttccaaagacctaaatatatgccatgaaacttcaggtaattaactgagagtatattattactagggcattttttttttaactgagcgaaaatatttttgtgcccctaagaacttgaccacatttcctttgaatttgtggtgttgcagtggactgaattgttgaggctttatataggcattcatgggtttactgtgctttttaaagttacaccattgcagatcaactaacacctttcagttttaaaaggaagatttacaaatttgatgtagcagtagtgcgtttgttggtatgtaggtgctgtataaattcatctataaattctcatttccttttgaatgtctataacctctttcaataatatcccaccttactacagtattttggcaatagaaggtgcgtgtggaaggaaggctggaaaatagctattagcagtgtccaacacaattcttaaatgtattgtagaatggcttgaatgtttcagacaggacacgtttggctataggaaaataaacaattgactttattctgtgtttaccaattttatgaagacatttggagatcagtatatttcataaatgagtaaagtatgtaaactgttccatactttgagcacaaagataaagccttttgctgtaaaaggaggcaaaaggtaaccccgcgtttatgttcttaacagtctcatgaatatgaaattgtttcagttgactctgcagtcaaaattttaatttcattgattttattgatccataatttcttctggtgagtttgcgtagaatcgttcacggtcctagattagtggttttggtcactagatttctggcactaataactataatacatatacatatatatgtgtgagtaacggctaatggttaggcaagattttgattgacctgtgatataaacttagattggatgccactaaagtttgcttatcacagagggcaagtagcacattatggccttgaagtacttattgttctcttccagcaacttatgatttgctccagtgattttgcttgcacactgactggaatataagaaatgccttctatttttgctattaattccctccttttttgttttgttttgtaacgaagttgtttaacttgaaggtgaatgaagaataggttggttgccccttagttccctgaggagaaatgttaatacttgaacaagtgtgtgtcagacaaattgctgttatgtttatttaattaagtttgatttctaagaaaatctcaaatggtctgcactgatggaagaacagtttctgtaacaaaaaagcttgaaatttttatatgacttataatactgctgtgagttttaaaagtaaagcaaaagtaaactgagttgcttgtccagtgggatggacaggaaagatgtgaaataaaaaccaatgaaaaatgaactgctgtggagaagtgttacatttatggaaaaagaaataggaaccttgttcatcaaattgatagaaaagcttttaaaactaaacaaatcaaacaacttgagtataatggaattcagactttgatttgcctaacataaccaccatatttgcaaggacagctctctatcttctggtgtttattcttaaaaacttaaaagttagatttagcgatcaccagagccactacttttatgcttaggtatttgtttgacttagaaaaaattggtcacgtgtaccactttatagtgccctgcaggtgttaagatatgaaggcactttgacttacacctcataaaatctttacaaagtattttctaaatgaataatgatgaaataaagtctttattctaggtgcatctgccccacataatttgttttctttggactagaagttttgatgtgttgagaatggtaatgaattaactccattttaaatgtagaatgcgtatcactccaatatgaatgccctaatgaatcctaagatttgtaggttttgtgtactagtatgaaaattactaaagatggaaaaatcacatgttggagacataagatacaaacctttttgttttctgaaaatacaacctctgatttctgattccttgttgtaatatggtgtaattatactagattgtaattttgttgttagattatacttttttaagttcagtgtttgaggacagactttcatttggttagtagtattatggcagctagcagctaaatatgataaagtgtacaatcaaaaggatatttttaatgaagatattagtggtctaacatgtcatttcagatacatagctgaaatgtagtaaaatcagttttactacaaataaacttgcataaggtttataaatttataagtttataaatcaacttgggtaaagtgtaaataaacttgcactcgtggtttctctgaagtctcctgagctaactttgcataaaggtgttattctgtacttcgaggaagtgaattattggggtcaaccacattttttttccttcctacagtctgattgccctttttagtttttaggatctttgtggctgcatcatttttccccttttgaactgtgcattttctaaccccatacttaaatattctcataacctccaaattattaattagatgcaacattcagtggtatattactggagtttctgatttctgcccactataggaatgtgcttcctgagaagattgggatcgtgattataataatagttaacaggggatgagtactttctaggtgccaggcactgttctctctgatactttatttgatgtattgttgttattcccattctttaaatgatgcacagagaggttaggtaagtgacttactaccaagtgtcagggccattaagggtcaggattctgaattcctgaaatgatgaaatttagcttgaagaaattggtttgatttcctgcttagttttcaatttcatggtggtctttgattgtattttgtgctataacactgccttagcatcctataactatagttacagtgttatattaccattttttattgttaatacaaagccatcatgaaataattcagtttatgtgccagctttttttgttactaattcttgaaccttggcgctgtacttcttcatgtggatgcctgttaaggaaagataaagttagaaatctttgaccctgctaggaaatttgtctttgttatattgggagctcataaaactgaagtattcaaaagttagaatacatacacacaagaaaaattagtaactaatttaataatgttttctttgcacatgtctctgttgtcttttggtcagagtgaagctaaatgtgtttttcacataatttgtagcctatatgaagtcctggacatgtggtatggttggaaggactgttgatgaggtttattgtctctctttattcttttatgttgttagtgtccccatacaacggggcggggggagtggggacaaaatgataacttgctttatatatgaagccttgggtttgaatcatactgttatcacatttcctatgtccctatcctgtctcctgcaggttttctttcttggttttcttttttggttttctttcttcctttcttcctttcttttcctttctttcctttcttccttttttctttccttttcttttttcctttctttccttcatttctctcctttgctcctttagtttgtttctttgtttctttggtttgtttctttgtttctttggtttgtttctttgtttctttagtttgtttctttgtttctttgtttctttcaacaggtctcactgtcgcccaggttggagtgcagtggtgggatctcagctcactgcaacctccacctctcgggttcaagccagtctcatgcttcagccttccgggtagctgagattacaggcatgtgccaccattcctggctattttttgcatttttagtagagatgaggtttcgccatgttggccaggctgatctcaagttatctgcctgcctcagccctccaaagtgctggaattacaggcatgagacaccgggtccagcttccagcaggttttctttaggagggatattttacaatgctgtaagtttttcctaacgagaattatcatagcactacatgttctgtcttcagtaagtgatacaagcttactgatgatgttgtagttatgttcattggtggtcgggtgtacattgaaactttaacacataatagcctctcctgtgagcagtggttcctgttggtaagatactttactaagggaaggaatgtgaggtgtcgctggggagagtttacccaaataaggatggactttctgtctttgtttcatcagtcctggtaatagaatgtttgaatagatagctctaggcattacatactttcataaatatgattattgtaattacctctttggcccagttgctagtaaattagggaccccttaatgatttatttcctgtttattcaccctgatgaagaacttgtatctcttttaaactgtactttatcgcctttctcaaattccaagattctcatcacattttttttcttcccaaactctaaataaccttttaatattaagtatctttgtggaaacattgttttctttttctatcccaatttttaaagcttttttaaaaaaaagagtgcttttgttgggatgtacattttccaaatgcaaaaacatttatgattctgtgtctcttataaaatatgacactctctacttttctctcatttatttagtgccacctatgtgtgtaatttcattacccacagcagtcttaggaggctggtcgagttccttatttgcagatgaggaatctgaggtccagagatcacttcttggtgagagtctcacagctattaagtattagagccaagattttgaacgtaggtctgattcacagcaaaaccgttaaccactaagtacactgactccagtaagagccctagtcctcacccaatacactttaattcccctgtgcattcattcaaattcattgaatttgctgcctttggaaacctctcaggaacctcctcaacctctcttctctacagacatcagctttgcctgataggtagggatcatagcaaaacacagttttccaaggtggtgataggtggagtgatagtgctctggagatggccaaagaaggaaggtatgagtgtatctgtgggtgggtgagtggtggataaggggaaggacagagccaaaagcgacggctattggaaaaactatgatgagaaacaggaagatggaaccttgttggaattagtgaaagaccttagaattcacaggaggtatttgtccttcacgcgagtgtagaccaaacgtaacctatgagtttcttttattccacttattaaagcagcaaccaaaggtattatataccttctgtattcacttaaaatgactgattttgaaaaagtcatgcaaacatccatttacagataagcctcattaactcaaaggcagtggccctgttgggctctgatgattactcaaaccatttctgacactctgacactacatccggaaatcatccggaaatgcattcagagcctgcaaaagctttttttttttttttttttttttttttgaatagctacagcacttgcagatcttcctcctttgagagaatatttgattttaggaaataagcaaatgtagataagtatgattcaactgggcaataacttttaggcaaagagaaaaaaacaaaatatagcaatgtagtaataaggctgatattatagtgcttttatgatgagtctgaaaacagtctccaacatttgtaaatgttttaaatcgggtctgtctactacagtagcccttaagccatatgtagctattgagcacttgacatgttgcaagagtgaattggagactgattttaattttatttaattttaatgtaagtagtcgcacatgacccgtggctactatggtagatggcatagttttagacaagggcagtagtcttgggtagatacttgatttacttagaacatttctttacctagctgtaacaaggttctaatagctgattaaaggacaacatttttagcatgtaatatacagtaaggaactaatgttaattactgccaagatgtataaacattatgaaaccttaaacaaggatgaacacagaagcagtggcccttctttgtaaataaggggtcagttacttcctaataggtgtcttagttttagttaataatctaatagcacccccaaaaagcaaactgttaatttgttattagccatcctgtaaagacaagggagaaatcggggccaggagagtcctctttcccattctccataatttttacgacctatagaaataagagcctaagagtgaccagttcctgcaacctaactcaaaattaggcctctctgttgaagtaatagtgaggcaaacaatcccttgaagcactggggcatgcacccttatgaaatctaataattctaaaatatcattggcagtattaagctagagttctcaaaatatgctgtagaaaatattggtcatttaaatatagctgagtaaaaataagcaagatcaaaatgataagaaaatgttgatttctccccttttgaaccagtaactaactataagggtatatacccatgcttaacttaaaaataattatttagccaccttgggtatagcacaacatatggatgccattatagtccaccttgatcttacaaggaagctttcttttagcgtagctttacttttatttaagcattattgaagaagcttggtatctctgtttaagttgcttctgtatcagtgttttccagggccctgtctcagcttccatagtttttcttaagagcagctaattaatgcttcactccatatgctttaatttgatattttgggaagtttcattttttaaaataatctttttatatcataggcctttgaagacatatttgtttacaaagacatctgcattgaaccatttgtttttaaaaacatgtatcgggcatgttctatataccagaaactatgccatttactgaggacaccgaagttagagaatggtcttaatccgaactagttattgtctcactatccaatatggatatcaaacattcagcgtcatgaggatttactactgtgttttctcccaagagttttataattttagctcttatatttaggtctttgatgcatattcattgatttttttttgtatgcagtatgaggtaaaggttgaaacgtattctttttgcatgtgggtgtccacttgtcccagcttcattttttgaaaacactatactttccccattgaattgtcttggcttctttgttgacaaaggatttattatttctgccacaacccagctgtttctcactgtctaaacctttatgcctgctgccccgtaggcttagtggaatgcctctccatcctccactctcttttgtttagctagtacttccttatcctttaaggggtcagtaggaacctcaccttcttcagtatgttttcctttgtcttatcaacctaccaccatcacccacacacataccttttccctaaggctgggataggaacctcttaggcaatgatctatttgataagtactcactgagttcatactagacactctgcagtatatccgtaaatgaagtaaaacctgacaccaccctcagaaaacttactgttagtgagaaaatgggctataataatagagtggggtaagtttattgtagggataagcataggatgctatgagaatgcagaggacaggaatttaacctagacttctcagttctcccgttgaagttgacatctgaactgaaatctggaagaccagtaagagatagctatgtaaaaagaggggaaggacaataggaaagaaggaatggagagaggcccagaaactacagagtatggcacaagtagtttagcattgttgggtcacaaattctaaggatatgaaagataaagttgaagaagtggtggggctggggaggacagctcctgtagagccttttacagcgggagaaggagtttggctatggtcctgcaggcagggagaaaccactgaaggggagaaacatacagaataaatttgagtaagaagcttaaatctccccaagcccttttaaaataaattaagatataaagcctttgggtttctttatgctttgtcctattcttctaattgtccaaaacaaaacaaaaaccttccttttctgtacctattaaaaggttaattttataaagttacagacagcatgctgattaaagaattcttgataattagctattttgttctgtctttgtgtagattactaacaattgtgtcatcagatttaaaagatctaaacctctggactttatatattttttctacaagtactgtgagattgagaacttaattcaactctagtaactggactttttagtgttgtttgcagcatatgattgttaaagaaagtttagtatatttgtgtgtgcgtatatatatatatatagatagatagatagatttgaggttatatttaatcattgactattggtattctaagattttaaggagagaaaggtaggttacaatatatggctgatatatggttctggaacaattttcttagttttcagtaattctacctaaaatgtacgtccagctttgcactcactaccacattgtaatttccagtatacttgtctatttttcgagatgttgaaatctgtggagaattttttctcatgtttagtgttttagctatgtttatctctagggtatagcacatacaaggtggcaatatagatgtgcttaatgaataaaatgatcttcaaaaactgaccttcatttgaagttctattttattcataaacacataaaacgtttggtatcactgtaaaatttaactaaaaacaaaaactatctttaagctcacaagttaatttaacgttttttcttacacaggcatttgtaaaggatgttcatgaagattcaataacagttgcatttgaaaacaagtaagtgtctcgttatataattttaatgatgaggttctttaatattttatgctaattctactcttcattttttaaaaattcaagtccagtttgagtgcttttcaggaatggatcttcatgttactgactgagaagtttctgaacaactcagtattaaactaatggaatgactgtttctgctaatgtcctggaggtcccttattgtatggtattgatccttacgtcttaattcccttgaatgtgaagaaagaaaccagagagtcttgtgtattagtaactggaagttcgcataggagtatttgtaaattttaaaaagatagtaatgaaaagattcatgggtattgctaaaaagttgtatgtgagttctttaacattaaatctaaaactgatggttttagttgtctagtatattttatggaaacagtcatgtttacctattatctgattttttttaatgtttcatatgttcagcaatagcagtagctgatcttttctgttctcttttgctagatgaagaaataaaaacagtcataggcctaggaatattaactgtatgaaagcatcaatagtatagatgttaacattttattggagaacacaagtctcttgactaaatgttttgaatgctaataaaggctattttcagggtagctgttggtaagattgtaaagtacatataaactccttagtcaaagtgtagatgtggctatgatcttaggattttactaaactctgatggatggttaacagttatcatttttttggctcttatataccaagaaaattaataatatatcaaaagcaggctgcaaatctatagagacagaaagtagattagtgattgcttgtgctggggctggtggggagaacatagctaaagagtacaggatttttgtgtgtgtggcaatgaaaatgttgtaaaattgactggtaattattgcacataactgtaaaccttctataaaccattgaattgtacatttaaattgatgaattataatgatatgtggattatgtctgctaaaatgtagtatgtgacccaggcatactgagcaataaatacacacatcttgcttctaaagtttaaaaccaggcctgtgtttcagtgtctagaaaatatatttcataattgaacttagcagattcttttggctagcaacaggacaaagtagtatccttagatgcctgaaacacgtgtagggggacagagataaaaggattaaaagcatctaaccctatttctggctctggactaataatcgcagaccaaaatacaagtttgaatagtagaatacctttccctgaatacataaagccaaaagttttagtatttgtctcttcgctgtttcatatatccatggctatgcaatagacaacagcatcacaccaacagaggaatctttgataacttggagggtatttttttcttacaattatacactttatctacttacttacatcactaggtaaatgctgtttcccataaagggagagttgtctttatttgctactcttttagtttttcctgtagtctataatctaaagtgttaagcaaacactcatttcctctatgcatttaagaatttgtctagtttatacattgatttattagatcacttctttttaattttcaatcagatttctaccataaacttaaaattatttcatctttggaccttccaattatttatctcctgtaccatatctgcatgaaagtttctcttcaagctctttgtcatcctgggagtttgaaatagatcattgatttttccttgtgttcatggagtatgtttgcaatacaacactgggtttgagcacatcaataggatttaataggtctccaccaaagtaatctctttgcccttccttgtgtgtttcctttttggttttctgttagaaacaaaacgaaaacagtgttttgtaaaacaccagattgtatttaccctttctttcctttcaatcaggaagaagctcctgttactgatagcagattgttttaggtgctttgtttttaggtgcttcctaaaccttccataaagcataaaggtgttttcatatttcacattttttaataaggaatttgaatttttatctgtatacacttaaaatcattattttttccttggaaccattgagttatatattattatatgctttaaaatcaaatttagcaatgaatgtataacatctattaggtgtgtataataactcagaggagggttcagttaatttaggccctaatcagatttccacaaattctgacttaatatttgcccgcttatataacagctcttctttaacaaaaacaagtacttttctcaatagaattttactaagaaagctctttagtaaaacatcgacattatacatacaacatatctcagtatctgctgatgaagaacaccaaaaagaacccagatgtgactgctccggaagttgaatcctcagtatttttgcaaagtttgtctttcagtattttatttgtgtgtgtgtgtgtgtgtgtgtgtgtgtgtgtctatatatatatatattttttttttttttaaagacaggatctcactctgtcacctaggctggagtgcagtggcatgatcatggctcactgtaaccttgaactcctgagcttgagctatcctcccacctcagcctcccgagtagctgggactataggcacataccactgcacctaatttttttttttttttaataatttgttgtaaagatcaggtcttaccttgttgcccaggctgctcttgaagtcctggcctgaagcagtgctcccacctcagcctcccaaagctctgggattataggcttgagccaccgcatcctaatattttatatttttatggatataaaaaataatttggtatctttcagagttgtttaatatcattttaaatttaaaaacataggcaacttaaactcctataggctgtctccatcgggtttctgtggtttaggagaccccaccatcccagtgcatgctgataacgtcatactgatcagcatccagctacccacagcaagaattgaccacctcgtgggatctaaaatttaaagggggaaaagtgagttgtgaattgctaatgtgctgatagccccattttgcttgggaattagagggcagtttttgtggtccttggaatgtggttaaaattcttctgcaagtggaagcatatttatattactaacaattactggtactaatattcaaatattgaaggaaatttctgttgtggacttatgtttaaagctcttagaagttgaaattattggaaagaagacttgttttgaaaatcataatgttgctgtattgtgtttagagaaatattccaaacgggagtaggctgctgtgctgcatgcagactttgctgaaatgttactatattgccgttatgtcccactcagcaaaaactgatgattttaaagcttttgcttcttgaaactagaaaaagaggggtcagccttaaccaaaagttgatggcagagtggtcattatttcagttaaacatgaaaagcatgttaaataattgtatgtttgcttatttacagctggcagcctgataggcagattccatttcatgatgtcagattcccacctcctgtaggttataataaagatataaatgaaagtgatgaagttgaggtgagttttccctgccataaagtcatttagcactgaaagagtggggttaatttatctgtgtttttttttaatactttgtctttaacactgtttaaattactttgagaattacagctggaatggacacgtgcttttgactaactcatcttattaataattcaaaatgatacatgatgcttacatttggctatttgagcagtactcagagcatgtatttgaaagtcactgccgcaagttcctttgcccactagtaattcttttctccttctctcaatttctgaatctttgaatagtatgttgtttgtttacaactgtgtccccattgtaagcaaaatggattatgaaaattaattttacacaggaaagaaatcatgctttattacaaaatagtatactagaatttctttaagtagcagtgaatcttcttggtatatttttaaaaacctacaagctttagtttatacatattggtaaaatctctttttcacaggttataccgtgaactacctgcttatctcccgttgagctctttgaccaaaatgtgctatggagatctaacatgtgaacagaaatgttgtgtttgtgatttctttctccattagaaattggttttgtatttaaggcgcttacagtgcctcatatagtttgtgtggtatcttctctcctttgtatcctttcacatactccattttgagctgcttctcttctttttctacaataataagcataatgccttactattagttaataatagttgccgttccatgaatatttgtagtatgaaggatgtcgctaagtagacatttgtgcaggtgaggcagagtggttctaggtcctgtccttcagttctttatttatttatttatttattttttgagatggagtctcactcttgtcatccaggagtgcaatggcgcgatcttggctccctgcaacctccgcctcccgggttctagcgattcttctgcctcagcctcctgagtagctgggattacagtcgcccaccaccacgcccagataatttttatatttttagtagagacggggtttcaccatgttggtcaggctagtctcgaactcctgacctcaggtgatccactcgcctcggcctcccaaagtgctgggattacagatgtgagccaccatgcccagctggtccttgaattcttatttgctgcactaggtagtaaaggtgtagcaaaaacaggacagaatcttctgcctttgatgaaatcacattccagtaaggatagctaatatgacagatgtgagtcttaaagaaaaaaaaagggagaggatgaaaggtgatttagggacaggattgctgtttcagagagtagtcagggaagatctctcaatgtccaggcctgtgtttttctctctacagttttaaagtggacataggatatagtgttatttattttccaaaaatgtaaccaatctctactaggtgtaagcagctgggcttggttttgcaagggatcttaatagggaacagaaacactgtgtatgcttagctgtccacttccccagaagactgtaagctctctgaaggcaagacccaggtctttggtctgtattaggagtacccagaatagtgtttgatggagggatgaaagggactttttctccccagcttggtcacttgacagatcgggaccaatgagataccattgctaggatgacctcactgtcttacacaccgattcgttgaggtaatttctctggctagagtagttgagaaagatggaagcaagagggaaaggtatgttaagttgtattcagtcactgtattgtgtgatcattaactttggttgtaaaagggagacaagttcgagcttttactctacttgtcagccctagactttgtacctctcttggcctcatgtctttatcccccttgtctttcttatttctcttttctgcttctgagtatccctgtctctctgtccatatatactctgttgtctcttttcctattaaccttgatttgctagggtcttcatgaaaggttccatgctgtacatcttaagtgaactttgaagtggtcatcaaagagatcagttagaagaactgatctgcagtgtgtgacagaccaggaaagtgatatccagaggattgccaccatgaagttgtcatttttagtggagaggaagcaggagaccagaaagtgaccaaggatctgtccatttagttccaggagatatgactgccagagtggtatccttagtgggctgaatgttcagtggtcttactttagtgaccaagcaacaagacagtagggcatggtcagtaactttcagtcaatttttgcttactaggataaagcaaaaataagcttatacatttttagatacattttttgtaacttgctgagtacccaaggaaagtgtgcttgtatttatgggcgtctattttcagagcactaattattgctgaattagaacagaaatataggaaaactgatttttacaaggagcttcaaagcaatctcaggtagtttctgattatgtatctctgcctacctcggggtacatagacagggttacaatttggttgaggatatatgacatgtggtttttaaagacacctaggggcattttaagaaaatttcctcgatatctgaaaatctgtagatttcaaaattatgttaatcatgaaatattctgtgttgtaatttttgtgtaggtgtattccagagcaaatgaaaaagagccttgctgttggtggttagctaaagtgaggatgataaagggtgaggtaggaaaatgcctatttaaatttttttcttatattgtttcctttttttaaacccaggttgtacattcccgtgtggatttctattttgaagtaatatctaattttgagtaatttaattaaaatgttttcactatgtgttcagtatgtttctgttggtcataaattttttcacatagattatttattttaaaataactgaatagggagaacttcttattcttactttaaaaattgtgattagaagtgacttttatttatttctcagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtaagttgatacacaagaaatgctgagaacttggaagtgatatgcaattagtttagaagaatttctagtagtttaaaattttttaaactactagaaattgattttaaatttggtggactttggcaaaaatggtttggtttgcaagagcaatggagaaaaaacttatttaacttttcctacttatagaatcaaggcagccttgcgcttgtttaaacttacttggctatacacgtgtctgatgtacataatgtacatttgttttctaaactaactttgttcattctaagatttaaaaactgatcaaacaaatgtgataattctgtcataagtcacaaactataaacgatttctccgtttttttctcttttacctaaaatgttttcagataaatgtgtaataagtagagccaaagaagctttaaaaagtcatctcatcttacaatccttgatctggaataatgcttaaagactatagaagagacgcatttttattttttacagattttattaagtgaatacagtacgtttgatttggacatgttgttgaacattaaattgcagttcagaatacatagaaatcctcccttttctagagattgtgtatgtgtgtaaatttttgtgccttctggttcatgtacgtttccttctctccctcaaatcgtttagcagtttcttaccccattctccgtgatgtgcttatttcatattgcatgcctgtatcaaaacatctcatatgccccataaatatatatacctactatgtacccacaaaactaaaaattaaaaaaaaaggaaaaaaaaaggcctgcaacaagagaagaagaaagaaatcagataccctgtaggtagctatctccaaaagttttcaatagttgacttaagaaaactactgacttgtatgtaactgaaatcaggaaacctgtagtgtagagtggttcccctgaatatgtctcttttggtaatctaagctgtatttcagaaatgtacagaaaaggagctaagcttctaaatggatatagcatattttgcataaatcaaatttaatatgaatccatgattcttgtatgtgtaaatctgcctgcatttatttatgtcagtagttggtaattattcatcttaatttttttttttaaatttctaggtgtgccaaagaggcggcacataaggattttaaaaaggcagttggtgccttttctgtaacttatgatccagaaaattatcagcttgtcattttggtgagcatttttgagttgtttatttttagtttaattcatctggggcaattgccttgataataatgttgttaatttaaatcatttagtccatcaatgaagtcacctcaaagcgagcacatatgctgattgacatgcactttcggagtctgcgcactaagttgtctctgataatgagaaatgaagaagctagtaagcagctggaggtatgtcactttccctagcactgcttgtaagggtacctaggaacgattaactgtatcattccacaacttgaatatggggagcttgtcatttatttactgcttcttaacaattccttaggttctatagttggaaaattgtacaaagcataatcatactaaagtttccatgcctgaggtttcaaaattaaacagcagcttatgtatattaagggacttctggtactttcacttttactagaagtttatcaaagttgctaataaaatgcggcaatgcttcttccatataacatgttgtcattaaaaatactagagaatatttaaatatctaatcatattcctctcattatgtatgtttatctttgtttaaaagggtatagaacttcttcattctaattggttgtcattctttaaaactcctgtcttcagattcccgccagaggctatttccctaacttactattttgtctcttaaggtgcattttatctacttttattaatcctccaataattttcatcaccatatatttgttttcattgataactatcaagtacgtccatccattactatagaaactaagtggatcttagatgaatgtgccagctctactatattcctgtcaaattccagagttcgtcatcattattcattagaaggaaaacaccacacatttgaaatagtaaagaaaaaaaggagttccaaactgcattttaggagaaaaggtagtcaagactgtgttcttataaaaaccctgtgaaatttgccacctgtcaacttgatgtatgatgctgaactcttagcagaaggggaaaagtttaatctccttttgccactttgttttttcttaaggccatggaggtctgtttaattggtctttgctctcattctttcttgatgtccctgtgttcatgattttgtggttccttcagtgattctctcataacttttagcccagagctgcctccttactttgattgtgagtattatgaaaatatactcatatgcctcttaaacatcgaattattcttaaatgatctatcatacttttggctaaccatttatcagtgaattatcaatgaaaaagaacgaaccagattaatgaaccaggactcaaaaaacatgacttcttgaaaagtcctagaattattttatagattttattactctagtctaaaaaaaatgggtattgcacttttaaattatttatgctagttgtattcattcattcaaattatcaggtctgttgaacaatgagaaactagtatgcatgcctatctttcttcactactaatattaaagagatttacatgttcctataagaaattcccatttttcaacatgagccactaatacgtttggttttcattaatggcatgctagaactgaacactaaattttgataatggtatttaaagacagtggttatccacaagtttgggatgtcagtgtaacttagtttcgtcatcactggatatttacaagtgctcatcataattgtggatccagatcacaaggtcttacggactctggtctcatgttagctttcagatgcttactaagtttttaatttttgacattttttgattattcagtttaactactgtaccaacaatttttgattccttaggttttgagggaggtgtcattttaatgtcatttcaacagaggaatgtttagaccacagtacctaatgatgttataaaaaatggcactgtttccagaaaatatatactgataccttttaataaaaatgaagcgaataaaattttctataaagatgatatttaaacatttttttacctaaataagtaacattgagtttgtcagaccgagtgagctggtttttactggggaacatttgacctgcttcttagttattatattgctgatgtcattggttaactaaggcagccttgtgataagttttcagcagttaccttggaaaatgtcaacaagttctttcctattaacaaaaacatataaaatgtcatagacctttagtaacctaaaaagtacttaggctgtgagaggtattttctaaaacctgttagttttaacctaaaactattaataatttatggacccctcatatacagggtcaagataatttacatggctggcctaaatacagttgtcgtaatagttgataaagtgtattcatcagacgtccatttctcttcagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggtaaatattttactgcatagtttttttttccccaaacaagtatttcagctggctaatcttttgtcttaaaatgtttccccttttattaggatcaggatgcagtgaaaaaagctagaagctttctcgaatttgctgaagatgtaatacaagttccaaggaacttagtaggtaagtcagaagtatctgttgacatatagtacaacaactaagtttaggtaaacagtttatttatagtgatagaattccattttttcttactggagggtatcatttaattgaaacatagtctttgaaatatgatctgttctttttttttattatttaagttttagggtacatgtgcacaatgtgcaggttagttacatatgtatacacgtgacatgctggtgcgctgcacccactaacttgtcatctagcattaggtatatctcccaacgctatccctcccccctccccccaccccacaacagtccccagagtgtgatgttccccttcctgtgtccatgtgttctcattgttcaatcgatctgttcttacagcatacaaaaaaatatttgttaagtatgatgctcaaaggttacattttcagaaggtattcaaaagagattgcttttctagttcaaacctactaatacctgaaaggataaatcttgcccagccctcctgactgtataccttttatatcttaaaattaaataatttttcaaaatgaatgatatttggggactttatgatttgaaatagatttgtatttgatctttcttatgggactataaaatgatagcattcattttaattatctcagggttgaagatctgaacataggttacttaaatctaaaaagttccaaagctagaagaaacttcagatgtctctgggactttctgcaaagtcaatagtaattcttcattttgacttgagtagtgttttatcaccatcaccatcgtgagtatcagcaaatatttaggagctcttcaccaatactcctaaatgctgcagatatctttagtagaacatatcaaaaccaggtgcagttttatcaagaaagctacatatgtttttaatttgtaaataaaattgggacatactgcctatatgttttttatcttttaaacttgagatcatggccattttatataaagtaatacatgttctttggaaactttaaagaagaaagcaaggacttctcatacattctgtttacgtagtttcaatgctaatttagcctgcttttttgtcagcatagactcataaacatcttccttgtcattaacaaacactagaaatgataaatgtatctcccaaagaaaattagcttgaagataaagtgcaaatagtaggaaaataatgcagaagtgttagctcaactgtgtactacagacaactggagaaatgtgtttgtaatgttactaaggtaacttgcataccaattgtatgtgtacagaatgtatgcatagcgcaagataaagtgctaatctcaagacagttgggtgatgaataatatttattttcttctttacagcttgtcaagcaattgcataccttttgtagttagaaaggttattgtaaatttaggaattcttatggaaaaagagctggtagttgttttgttttttttttttaatagcaaatgagtagagaattatgtgtcagattcattaaagttggttttgaagatggcatgatggtagtggggaaagtgcttgggcattggagttggatctggatttcagtcctactttattctttggtggcaatgtgagcgtgggtcactgtcttagcccccctgagaattatttttcttacctatcaaatgtgataataggatccacctcatagagttgatgtgataattaaattggaagatatagtaggggacaattctggacacagtaggggactctgttcttcaccttattcaaaacaactccatttcagtagaacagaatcacagtaaattgctctttgggatttggaaataagtgtaatgtagaattggattatttgctattaaatattaaaagtagattctacctgtggttacctggaaagaagaggatctcagaaataaccagaaagactgctaaaagtaaatcagccttgtttttgttttgttgtttctagttagtaaaatgagataattctgttttagagatggtccactgcaacactgggaacgttggaacttttcagaaagcatttttgtgtaagattctgcaaggcagatctttagagaggtgtcataatcagttttgcatgtgttttgtttgagtcaaccaacgttatttgtgatctctatttttcacaaactctctttggtatgtgcactaatttatcttttcattaaaattggattcttcactcactaagaatgaattggtatgactattcagtcagctatagttaacacacagtacttaggataattaagatattatcttaataaaaacatccccaaatctcatttttcattttgttaactcacttagatctttattaaagtcaacattaattcatgaaaatgtaagtgttgcagtttaaaatcaaactgtgtgaagactccaagtagcttctctcacctcacctttccccttttcgttatagaagaacagaaataattgacagaaggacctagaccaagaatcctgatttaatggtgtcagatctgttctatgaccagtcaaagagtttctaggggtgaatgaggcagccacacacagcaagaatgtcaaagctatgctctgattacaagagccacaagaattttttgtgagaaggcttttcactgagttcttatctagcattggctcaaagcaaatttttgcttccatcttttcccccaactttgccttgagctttgcctttaaaggcgaaaaggaaaaaatggaagatgagatggtgagggcaagcacatggtggatgtggccaatgtaagggtacttaggtaccttgggtgagccctcagaatcagatgtagttcacatgtacatttccagaattagtaattcttaagtttgtaatgtcttgctttaccactcgtgtcatgatgcaaatgaaagcagtcattttccagtaatgtatatgattgtaaaataaataaggaaatgatcaagtacctattttttactggtacttgaaatcccaagttttaatagatgttactgaaaaatacttaaactggtttaaagctttttcattgtggttttgagttatcttaaagtgggttttcttaatcttttactctgtgactaatcccttcactttttaatacattgctaaagtttgtaagtaatgcacaggagtgatactctgttaacacattgaccttgaagaatttgtattccttttggatgtatgtatagctgcttaagccactttcagacttagattatcttttataaatgtgccttccatacagaattctgaaaatatttaccatggacaaagaagcagatttaaatcaggtacagacaagaattgaaagtgttgaataagtgaatatatttcccattctctctacttttttcttaattcttatagaactttgcagaaagaatgatacataccacagtaccagcaagtttaaagcgtacccttttgtgcaaaaataagaggttatctttgaactgccttaaaaatccaaaattaccctatcagtttgcaagtattaatcaactctggtacctgaccaaaggagtttaaacaatgatgtcctaattaaacagaaaaccagattaaccatcttgttgaaaagagtctctactttggttttgaaatcttacaattcaatacatacacatacacataaaaatatctatctatatgaatgtaatagtttacagtagggctgtgcttactgctttgaggtatgtgtttttaaaaccaaacttgatttatttatttcttaggcaaagtaataggaaaaaatggaaagctgattcaggagattgtggacaagtcaggagttgtgagggtgaggattgaggctgaaaatgagaaaaatgttccacaagaagaggtatgttacagtgcgaatattttgtggcacatataataaaagtaaaagttttttatgtgatatgttgaggacctctaatatgtgcataaagtgaatgcaaatattctgattatcaagcatgcctgctgtaattaatgttataattgtagataatggcccttctctgtcctctaatgcagtgagtttggattagtcactttattgaattcttttttcctgatctttaaaatgggtagttataaatttttaaatatgagacatacatcactgggtcgagtgttaatggcaatttaataaaataatatatatgtaaatgcttcgtaaagcactttgtaaatgttaatgttgctgacaaaagcaaaattggaacacaggttttctggctttcatcttttcacttttttagtttggggattgtgtagtatgtgtgtttattctgtgtgctttaaatttatttctgtgcttaatatctcttccccatcctccttacctttaaattctgtaacccttttatcttcataaatatatgctttttgtagcagcttttaaagtatttgcatggggtagagaggtgaggatgcacctttctgtgcaatagtactcttaagatactgtctcatcaaagagccgtaattttcacatattgtctagctttctttttgaaagattcttttagctaaagttaaatcttttttttctgcgtacaatttgtattcggtaattttataaaccaaaactgtttataataacttacattttttaaaaatatgatgattgataacactaatagagctaaataaagtcttaaattggtcctttttttctcttttgtgttttctgttttttaccaaggaaattatgccaccaaattcccttccttccaataattcaagggttggacctaatgccccagaagaaaaaaaacatttagatataaaggaaaacagcacccatttttctcaacctaacagtacaaaagtccagagggtaagaattacttgtcactttgaattacaatacaagtaatttgtctcagatgtcacaattggtattttggatgttttctctggttagacttgtaggctacttatgttctattttttttccaaatgtaattgccagcttatgagatactacaaattagtgtgatacatacttttcaatttattcacagtaacaactcttatgccataaacacaaaataatggggttgcatttagtggtcacatttttcttttgacagtggactctcttttttccatgccttctctctttaaattttgcaggtatcgtagctcaaaatacaccttctgttagttgcattagttactacttgaaccatattttagaaactaattttctctgtttgaactaatctgtttagaaatgggtttaaaagtcctgcagtgaaagtcctgcgttcaggcttctgtgtatcgtttgttatagttaatgacatcccttgcattccttatactgctttaggtgttagtggcttcatcagttgtagcaggggaatcccagaaacctgaactcaaggcttggcaggtaggaaaacattccttgagaaatacactttcagtttatattttaatgtttattccccttgttaacaaagattacaaatgatcctcaggattagggactggagggaggagtgtttgtgggtatgtggatccattgccctggagttaaagcttaaacaccttcatgccgcttgtaaggcttttcctaattacttgtctagttatcatctttaaattatcttctcccttgcactctagagaaccttaagccatactgaagtactttgagttctctgaacattctcgtgcttattttgcttctagacatatgtacaggtttactctgcctggaatgctttttctcctccacatgtcacctcattttgaccttattccttacaaagctttccttgtgtacttgccgaagatccccacccccttgactggttcaagagccttccccttctgttttgcaatgtgctcacccctagcatagcacttaaacatagatgtttatttgttgatctcctcaaccacattgtaagttctttgagggcagggagagctggtgagaactgtttatggaaaaaaatgttgtggactcatggattaaaagcaaaggtgccattttacaaagaggactataacggcaagtggattggatatgtctcattgccgggcagcccattattccagaacacagagtaacttttttctggggtccgtactaaaggccatcattccattcttgcctttcttcattttaatttactattcaggtctactcgtgaagtgcttaaattagagtggcccttggggtactccagcagtttagacatgttgcaagaaaagatattcgtaaataatttgctccgaagtcaatctaactaaatctgttacataggattttaaagctattttggtgatatttgacccagagggaagggtgtagcattcattccatcacatggtattttgggaaataatacagttaaaggcttttgtaacaaataaagcttgttggagaaaaacccaacatgcagaaatgaattgccagttattaatttgcacaattgtttctaggtttccctataacttgtgacaagaagtagttgttttttttttccctcttaatatatatatatatgggctaggagtacagacatttagcatatgccttttaaaaatctgttcttatgttaagtagtgtccatagagagaagttcaaactttccttgtgattcagccttttaaaattttcagagtacattattgaaatgtgtatgggcttgataaaacttaatgcttgtcaatgtacctatttttttgtctcacagattattcagtgcatttttatcctgatgtttttgtttgtattttgtgtgtactctatttacttggttagcagaaatgatttactttttacttttgtacccttggtatttcattttgattttttttttaagaatttgatcggccaggcgcgatggctcatgcctgtagtcccgacactttgggaggccaaggcaggcagatcgcctgagcccaggaattcgagaccagcctgggcaatgtggcgaaaccccgtctctacagaaagtacaaaaattagctgggtatgatggcatgcacgtgtagtcccagctatccaggaggctgaggtgggaggaacacctagggcctggggaggtcgaggctacagcgagccattatcatgccactgcactccagcctggataacagaataaaaagaccctgtctcaaaaaaaaaaaaaaaaaaagaggcggaggcgggcggatcacgaggtcaggagatcgagaccatcccagctaaaacagtgaaaccctgtctctactaaaaaaacaaaacattagccgggcgtagtggcgggtgcctgtagtcccagctacttgggaggctgaggcaggagaatggcgtgaacccgggaggtggagcttgcagtgagccgagatcccgccactgcactccagcctgggcgacagagcgagactccgtctcaaaaaaaaaaaaaaaaaaacaaaaaagaaaaaaaaaaaagaaaaaattttgatcaggataaagcctttcataaatgaattagagcatcttatactactcattttgtttatacatctcatggtaaagcttgtataattttgaattatacattttgtgattttgctgatactgaatactagtctttataataatctgatacgtttaaaaggttgctattgatctattcgtattcacagtagatgtgtaaagtagtatatcaactacttttgttttcatatattgatttatatttacagcaaacatttgtatacctgctgttcaccagatcctgtgctagggaattagtcgttatttgcatttttcagattaatctatcattacttttataggatcattgttgcaatttctttttcagggtatggtaccatttgtttttgtgggaacaaaggacagcatcgctaatgccactgttcttttggattatcacctgaactatttaaaggtgagaacagaaagaactttaacttctaatccttttgtactaaaatatacaaactttatagtagatctttcagcagttaggactcattctagcctgtgcaaaacactgtatgacttgtcaaaggtaatagagaaaatacgttgtttggcttataatttttttaaaaatggaagtctttataaatttaagtaccaatataccagttttcaataaaattttatacttccctttattcttctcttaaacccttacactcagtttaggcaatcctgtacatagcctgttaatccatttgatcctttctagcattttggttttttccagacaaaaatctgtgtctataactcttgcctttattgttccttttatgtcatttatcaaggaaatctaagcatttcatgaagttctttgtttaaatgtttaccctatttttctctttactgttattcaaaatacaaactatttgtgtcttctcataaatgttcagtttagttagtgtgatgcggttatgcctccttaaaatttcaaactggaagataggaacgaggaggctacaaggtgtagtggagcaagcactggatgggcaatgcagcaatttacttataagacttcagcaaatgaactagctgtgtgactttaggcaagtcacttccctacactagatgcttcttgaaattccttttggccaaaatgttctatactttaatgaaatggaaactgatctacttcattttcataatgttttatttgtatccatacatatcaaaattataatgtagctggtattaaatgtttttaaaaagcatttcaactctatttatggcattaagaatttttttgctgatttcttgaaagaaataaaaagtacatgatttctgcttgtgtgtaaataagaatgaaaggaagaaaaagtgtaatactgggcatgccattcattcttatggtggccagttaattaaaagtggaaaggtttcatccagcaaggtttacatgggtaggatacctctttgatttttttttaagtatgtttatgtgtaatcttttgtgtgtgtttcttcgtaattagcttaaatcatcatgaaggcctggagagttaggattgcattgtatcaaatcccttgttcttttgactaatgttctttcttagatcctttgatttattctcaagaatatcttctttggttatcagcagctgccctgttgccattctttccatcaccagaacttccctcgtttgggcctggcatctctcaccaaaaggtgactgctttgccccagtgggataacctggactactcttctgttttgcaagatattcctattccatgagctattactatacctttggaggaagtcactcactcagctgcagtctctcctttgctcaaattctatgtaaaacagattctggtgtaactatgtaaattgctaatgatggcagagcacagatgaaacggaccaaatccttacctgacctttcttttccagaagctgccacaaccaagattttagaaacttagctttacaggagcttctccaatgactgttcatgtagacagtctctatgataacctctgcttcactgagacgcctactactactatagttatgaatctgattccccgtagccagtaaatgagatgtttatgagtggattggaaggacagtggttagaaatgaggtttcatctggttttaacagaacccaacatactggaagtgctttttgtaagggtctgtcattggaccccaggtgtatatttctatcaactaaatgtatactgtttctcgtacttgttgtagcagagttgtagtctttaggaagttttcaaggcatgatgtaagacctagctgtctggtcagctattaaatagttttgttttcccctcatgaggaatagtcagcattttcagttgatgaaaaaatcattgttccttaaccatagtatatgttcttttaaaacaaaagatggcccaaactcaatgctttgtaaattaagatattaactggcaaatctattttaatcaagattatttacaatgtgtgattttttaaggttagctggttataccttgaatgtcatttatctatattcatacattttagcatgttttatttaatatcctatcatgaagaagtccccaaaatagcatatctgtgccttagcagtagaataattggataatagtgccaaattagacaactttaaattttattcagtataattttactgctgagtgtttttgttatatctctaattcttgacatcaataatctgttatctgtagtaattttctttttaaggagatcattcaatttcctgataattctgtgtaacagtgtttactgtaaatttagaactgaaattgaaatattccagtatatttttatctgatgaaaaggagaaaggttttattaagtaaaatgtcaaattatttttactgttatcttgtatattttaaataggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggtacaaactaagcattttactcagtaactttatctgttcctagacttatagctgctaatctctaatattcattagaaccccattataacaatttgccgctacatggtttccaattcacagtgggttaaattgtgttacaggagacatagagtaaaaacctgatgataaacacgtagagttcacagggccggtgcaagttctgttcatgctctgattgggggtaaatctgcaaagcccttgtgtgttgatgattttcttaaggcctctcctgattttataactgtatagtcaaaacttttttcatttgtgtactgtggctcatttttattttgtcaggtatgtgctggtcatacttgctggatggactgtgtaaatcaggggtctgcctcttgtggctcataaggtgattttgagtgacatggccaaagtcagccctaggcacagtcaagaagtaggcgaagtttctctttgccttcccagcttttctgtccgtgcttctttcttctctcccagtacctttcagtgaacctgatccccacctgccagtgcctactgtctttcttgctcaacagtgtatctcctttgtaacttgctaatgatggtataaggtataatccatttcacgcatatttgcatttcaaaaaggaactctttaagatggaaaagccttcaagatccacaggaatgaagctataatggtgaagctataattggtcattagctccaacagaggaagagagaggtagtagagctgatattctggagttggggagagttacctactcctaaggccaaccttgaacctaacccctaacccctctcccaacagtctgttctttttactcatgaatttctgcctcaccgtggagctctttttctccgctcctgtcctctaagtcgttaaccccttcaggcataatgaatttattatagtaattctttattaatgatcaattattgtaatgggagtgggagggcaggttgtggaccaaacatcaggcaagcatgtatctgccttcagctagatccaatccatgacccacaagagacccttccctgaagcagttgccatggtggcctcctttgccaccctctcagaaatgaccaaaatatatacattcccctctgtcctgggccaaatcttgctaaaaggagctctctttttagaggttttgtttatcagggtatcacacttaactgtcgtggataatcttttcctccagagagtatagatgtttaaaggaacacagctatttaatgatatggcacatcaaggtttgaacttaggtggctaataacatacctttttaaaaatgagaatgaaacatgtttataaccaaaattaacctcaaatattgcaaagcccttcattttgagtttaaaattttgttttatgaaatggaaagtgataatactctttgtgggcttataaattgggaagagttttggattacccctgaaacgtctctggaagcttctgttaacctcttttttttttttttaaagtcagacaatggtatataacttttaactctcgataggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggtatggagatcttcattaagaaatcaaagtgaattgtaacagctgtcttgaagttccatgagaaatcctattgatgcaatgaactgttaccaagatcccatctctcccgttttgtgctgataccataggaaaggatcagccttccacttgtgtagaaagaaagaatattaggcagccttccttatggttcatacagatatatgaataaatgctgataactaattcagcatcttggtgggtctaaacagcatcccttcattaactcacattgacctgtagatgcagaattataataactgtgaaatattttctgttacttagcagcaggctagattattagccattgtgtaactggaatcactggggtattgattacatttcagattctgtggttggtttaaatagagggtgtgggaataaagaacttccagtaagcatttcagaatcagtaactgttgaaccttttgaaaatattctcataggaaacgacgatcactcccgaacagataatcgtccacgtaatccaagagaggctaaaggaagaacaacagatggatcccttcaggtaaaacctgtctgcctcttttcatcttaattgtttgaatatggtagtttgagatttatgagtttattttactttattaaaaacatgttcaaagattacaaatccagtttatgtgaaatattttaccttcaacattacaattgtagtcaatcttagttctttgtgacaagtatacaaataagaggatttctctagagaatatgcagtctgagtatttgtgaagaccttgacagccacactatgattttattatttattatttatttttatttttttgagacgggagtttcgcttttgttgcccaggctggagtgcaatggcgcaatctcggctcagagcaacctctgcctcccgggttcaagtgattctcctgcctcagcctcctgagtagctggaattacaggcatccactaccatgcccagctaatttttgtatttttagtagagacggggtttcaccatgttggtcaggctggtcttgaactcccaacctcaggtgatctgcccaccttggcctcccagtgtgctgggattacaggcgtgagccactgtgcccagccacactatgattttaataccacattggtagacctgcaatcccccagagaaggaacatcctgggatgtacttagagacctcagtaaaccttatgtgtctttgctcccccaaattaacagggatagggtattctctttgaatagaaaataaggaaaagaaggtgtctgtcttacaactaataatcatgatagacagagctgatgatattcagctagtctccatgcttggtcagtcatctgcttatttacagccaggacctagtccgaggatctcttctcaattggctgtcaccagtgctaaaccaattgttaaataattttaaaattatctcctgagcacatccaggcacctttgctaagtgctttgtgtatgttttatctcatttaatcttacagcaacccactgaggtagttttattattccactttataggtgagtgcactgtagcttcagtcctttgcccacagtcacatagctagcatatgtccaaatgatagtcaaaccttagtgtctgattctctgaatctatgttgtcgtctactttttctgtaacttttaattattaagtagttagggttccttcctgactatggattcatttgggaccatcacccaagattagtgagagatactttttaagacaaagtttatgatggaatatttcttggaattcatagcagctcaaagtaagtgttaactattggtgggttcttaaggaccagcatgtccaagggatagatagattggtaaattactgtatgtacctgtcttttacaaagctataagatatttaagtacccgttttgtaattttccacttaaactgatatgtttgatgaacttggcagtctaactgcattggttaaaaggatgcacatttatatttctaaatgaaatggaatactgaatttaaaaggtgatgttttctctattaagtatgaaaatagatacaaatctggccaggcgcggtggctcacgcctgtagtcccagcgctttgggaggccaaggtggtcagatcacctgaggtcaggagttcgagaccagcctggctaacatggtgaaaccccatttctactaaaaatacaaaaaattagccagacgtgttggcgggcacctgtaatctcagctactcgggaggctgaggcaggagaatcgcttgaacccaggtggcagaggttgcagtgagccaagatcttgccattgcactccagcctgagcaacaagagcaaaacaccatctcaaaaaaaaaaaaaaagggccaggcacggtggcgcacgcctgtaatcccagcactttgggaggccaaggcgggtggatcacaaggtcaggagatcgagaccatcctggctaacatggtgaaaccccatctctactaaaaatacaaaaaattagccgggcatggtggcgggcacctatagtcccagctactcaggaggctgaggcaggaggatggcgtgaacctgggaggcggagcttgcagtgagccaagatcgcgccactgcactccagcctgggcgacagagcgagactgtctgggaaaaaaaaaaaaaaagatacaaatcaaagtactgaatccttggtaacgagacatttaaaacacatgcacatacccactacttaaacatactttgaaattacaaccatttggggatgtttttagcatttgtgcttgaagtagatcaatatttgtagttgttttagttccatttgtcactgttaactttcatttgtacctctggaattagcagtgctgtattcagcattggcacttaaaatattttatagctcttagaacactattttttaaattacattgatctttatactctcctaggattccagtccttccacaaattattatatgcagttttctttatactgttccattcttcagacagagttcaggttgtaggatcatctgaattttcttagtgaaatacaagccagtagaaaccaaagctcgtgtttttctactgtatgactatgggagctctcagtatagagaaacttgatcatacctgtgatagatataaagatgtaaattaaagtctagttagtgagttatttgagggtaaagccagaataggaaaacattttgtttctcttttcctgggcttcacaatctttggagaataactaattttattttaactctagtgttagaggcatgtatgtcttctggtaatcagtaatagtaattcattttacctgtttgtttctcactgttttattctacttagaagaagacatgataggattgtgagtttttctctaactttggatgcagtgagatgaccagtgtgttccagttaaagaagaagagtgttttaaaatcataaaccaaataaagaatcctaccttacattaatttcttgcacttcttctgttctcatctccatttctctttttaacatgtggaatttacacttcaggtttaaatttcttgtcaggccaattacagattacagtaggatatggtctgtgtatataacaactataacttgttttagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaattagtctgacagatgtttgctcctggttttaaatttctacatttgacaaaaactaatgatatgtggggggaaagttgtgcaaagtaaatgtatgttgcaaataatcttttatgagcccttaaaaggcaaaaacgaagacacttgaaaataattctccatattcccagacataaaatttcaacacatttattacatagggtgccactaaaccatattaaacatatactcctatttgtgcacacatgaacataccctgccctttggaaaaaagtatgtctatgaagtaaaaaaaaaaaattgatttaaacgtctcagtaataaaataaatgagaggtttgtaggtagaatgtgcctgggaattgactactgtaatcacttcaaggaactctggcacagcctacccgcctaaaaggtacaaatggagaggtgacagtgtcagtgttctacccagggttagaatccaaaatgatgctagacagcctcctctgcattgatgagtttttttccccagaaaaataactattttctgcttttcttgtttttcattctgatgcttttgtggttctttgctacccattctgtctaactgggcatcattagtggtgggtaggctgaaaccatactcaagtaacttgtttggattttccttgtttcacagtagttttcagcactacacatgaacagcctgttggaggcagccagcttaacactcaacttggctctctcagagccatctctctcatctgatgatggtcttagaattcctggtggctcggaatatacgtcttttagaggcagcaaaatgattctgacccttttgagccagtttcagtttcatggccataaacagccttgtgaacctctatgcctctgataaccagttattctgaaatagtcattaccatgtgctagtcttgattgttcataaggcttaatgtaccagaatttaaatcttgagcatcttgttttctctgtttatctgaggtcatttaaaaagttttatttcaatttctctctatgtaccataatgaaactgggaaaatccattttattttaattttttttagtatactaaggggttttctgttagtgagagaggcttgctctgtgttaaactcacagggaagaattatccttcccctggaatacagacccagggtgcagctagcagtgctctggcctttgcatgagagaataatatccatgtgtctcttcctgaccttttgctgacaagtttccctcattaaaaccactttcttctgtgtggctttgtgcagtttgccataacccattacctcaaaaatggtgcccaacatgaggtaaaatccgcttatttcacctctggctttttggaaactgcaaaagggatcaactaagctatactagggatggacagcatccctgctggggctggtgatgggaaacccagccaagctaacatctgcaaagcatgctagtgtggtgcttattggtgttcatgtgccacagaggtcctgggaagtttgtgtaagggagattgagacaattaaatcctttggcactccaagtctggcagcctctgtgagacctaaggaaaaagaagttgggagaaaaccctcagcacctaagtgccattagaatagttgatgcagtctaaacgtttttttgtttgttttggtttttttttttttttgagacagggtctctgtcacccaggctggagtgcagtggcatgatctcagctcactgtggcctccgcctcccaggttcaagcgattcctgtgcctcagcctccctagtagctgggactacaggcacctgtcaccatgcccaactaatttttgtatttttttgtagagatgcagtttcgccatgttggccaggctggtcttaaactcctaacctcaggtgatctgtctgccttggcctcccaaagtgctgggattacaggcctgagccactgcacacagccacaacttttagattt

SEQ ID NO: 17590 - DNA, 247299 bp, Human
cttgtgtacttgccccatcttctgtataagaatgcaaattctggctgggcgcggtggctcacacttgtaatcccagcactttgggaggccgaggcgggcggatcacgaggtcaggagatagagaccacggtgaaaccccgtctctactaaaaataaaaaaattagctgggcgtggtggcgggcgcctgtagtcccagctacttggacaggctgaggcaggagaatggcatgaacccgggaggcggagcttgcagcgagaggagatcgcgccacggcactccagcctgggcgacagagcaagactcctctgtctcaaaaaaaaaaaaaaaaaaaaaaagaatgcaaattccttgagagcagagatcacatcataatttacctttgaatcctcagctgtactgtacacttaatatcagataaatgtttgatgaatgaatgactgcagagcttttaactagttactatgggaagacataaattaaagaaacataagatcttacattctagttacagagcacatcaccaaaacacccccaagattttcagaataagtattgaagggatacaaaatggagggtgaacaaagttatatcataacacaaagtcatcctggacgaatcaagtttatataataaagggaatgttcaaaggcttcagtgtcaggctgacctaattttgaattcctacttatctgcttgttaagtatgtgattttgaatgttgtttctctaaactgcatctgtaaaatgggtgtattgcaacctcctttataggactgttgcaaggatgaaatgagataatatggccaatgtgcatgtcacaatcttcaataaatgtttaaagtctaaaaagcaagccagactttaaatatagtaaggatattaggttgtcccagtggtgttagtcagtcagtttaggttgccatgagaattaagatcctgagcactggccagcttgtatcagatcataggggcctccaggaacctccaaatgctgatggtaattctaaaaccgcctcagatagtcttaaactggaccctcacaccaaacctaaaatatttccctaatctatgtttagctgcagaaacaagaggaggtaggaggagaagagctgcagtttccaaacaccactgcttgcaaccttcctaccacatgaatgttcaaggagttacatttgacatcattgcttgatcggaatctaccaagcaatttccactgcaccagccagtctcttgggaaagtactatcagatttgccagagtaaattattgagattgttaactctcatgtggacatggatagttaatgatgaaaagaaatgaactataaaattgcatcacagaatttactgtgtaaacttttcaaaccatttgtgccattaaatagcgcccccaccaaaaaaaaaaaaaaaaaaaaaaaaagcctatccttaggataggcagctgatgtagctggatggtgggggctctaggtggccacgttctatctgtgtttatatggttaaatggatgaaatggatgtgtttgcagattgaaacaattcataaagagttgaggctacttttttttttttttttttttggtcttagcgctgaaactaaaaatcgcggttattttagtgtttagccccggctcttccgttgctcaaacctccggaaactacatctcccagcatgctgtgaaactggtctgacttcatctcaaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggtaagggaagtcgggatgaaagaccatgggctttgggggtgggggtgggggcggtggacgaaagagcgttaggaagcggagaggacactgggctgggggaaatcttcagaaatttcgagtagctgtatcagatacctaaagctgtatcagaaggaagtgttctcatatcgtttctgagagcgcagcatgtctcttcgggacgtccaatggacaggtaggagtgggggagggggtacggaggaggggagaggacgcagtttccactcataggggaccgctgaagtcgtgggaaaacaagctgcagggggaaggtgttccatcacctgcctaaggcccggtagctttcaccttagtgattttgatactttgtatctgtattgtctaaagtgtattgtaactgttaacagaagggaagccagttgaaacaaaattaatccgttcctttgttcaggatggtgagattgacggggattttgctgaattaaactttaaagagactatttctgcttttctttttttttttttacgctgatgtttttaggccagtatggtgcattctttgattgaagcatatgcactgcataagcagatgaggtaagttgtctttcttgaacatagccctgaagctaggtgttcgtagccttaatatcctgcttcacagtggggcaaggaaaagaatggtcttttgaaaaaattattttagctttctgtgaaagtattcacagtgtttgtaatctgcctgtaatcccaagaaagctcttgaagaattaagaaaacttggggggccgagagcatggctcacgcctgtaatcccagcactttgggaggcctaggtgggtggatcgcctgaggtcagtaatttgagaccagcctgcccaacatggcaaaaccccgtctctactaaaaatacaaaaaaattagccggacgtggtagcgggcgcctgtaatcccagctactcgggaggctgaggcaggagaatcgcttgaaccccggaggtgaaggttgcagtgagccgagattgcaccattgcactgcagcctgggcaacaagagtgaaactccgtctcaaaaaaaaaaaaaaaaaaaaaaaaaaaaaagaaagaaagaaagaaaaagaaaagaaaacttgggacaggggagtggaaagtgcaggaagcagttaaggttcattagaaatacagctcgattgcttggttaagtatcccaggggtaggtgcagtgcattgtggagattttgagtacatttgggtattaaaacctgtctcatacaaaaaggtgttcagctaggaggtgttccatttttcttttgatttcgtttcattctaagccagatttgagggtgtgagttcaacctaagacttttagacaacccaccaccagcaccaaactttaatgggtgaggctggagacagatcaagaccaaagaaggccgggcgtggtggctcacgcctgtaatcctagtactttgggaggctgaggcaggcggatcatgagctcaggagatcaagaccatcctggctaacacggtgaaaccccgtctctactaaaaatacaaaaaattagccgggcgtggtggcaggcgcctgtagtcccagctactcgggaggctgaggcaggagaatggtgtgaacccgagaggcggagcttgcagtgagccgagattgcgccactgcaccccagcctgggtgacagagtgagactccgtctcaaaaaacaaacaaacaaaaaagaccaaagaaaactgccaagactgcgccagaactcaagagagagctaactgtttcttccaaaaacatgaacttgctgtttattgccatttctgtatttgatgtcgttataagagcaaatataaccctgccacatataggattacttatgacaatttctggccaaataggtgagtgctcataccaactagtgtgctatgcttcatttatctcccagaaggtagtgtaataataggctttcagattttatccttattattaacaaaatcattttgtaccttttaaagggaatttttaagccttttttttttttttttgatggagtcttgctttgtcgcgcaggctggagtgcagtggcgcgatctcggctcattgcaacctccgcctcccaggttcaagcgattctcctgcctcagcctcccgagtagctgggactacaggcacgtgtcaccacacccattttaagccattttttaacccatatggtttggttaacatagtaactatatgccttccattaaagttatttaacatttcaaaaaattattttatgacaaacaagatatcaaagcaaagcaaaactgtccagtttgcttactgttaaatagggaggttttcagtaagtgttttttaacatttaccaaaataaatggaagggtactagaagagggagcttttaggactgggaaatacggtccgagatattacaaaatttttattttaatgggtagatttttcacctctggtggtatagatttgtcttctttaagaagaagcaagaattcttgggtcttggctatgtatttcacttttgaggccaaaccacaggatttcttccagctaccttggtgatagtagtagcctgtatagtcgtattcattcatcgtaaactcatggctgtgttcccattcagcagacatttaaaaccactgctgcctccctgtggcccaggtcagggctccttcaacttgaatgtgtatatgaatcaccttaaaatgtgtcatcttgtttaaaaatcatcatgttaaaatacaaattctgactcaggtctgaggcaagtctgaagttctgcatttctaacaagcacccagggaatgctgatgctcctggtctatggaccaccctttaagtggcaagggctagagaacagtagtggcagctgtggggtcaagaagaggaaatggggaataggcagctagaggttagatgtggtaaggcctcttattgggttagctccctttattccctcactcgcttctatttgtcatttttcgtgaggagtaggttgagaggttctgagtgaagtccggttccaaccattttgccccttctcgcctcgctctcagaggcagataggagggtccaagtctagaaacattacattttgggttgcccattttttatctgttaatagaatgatagttatccaccaagcatttttgtatgtgttatccttttatcttcacataagtcccataaagttccccattttacaaataagaaaactgaactacagaacagttgacttatctgaggttatagagctagtaagtacagaattaggacaggaacccaattctctgactccaaatctgactccaaattcaaaatgcatgataacatagctgcctattaaaataaagatatagctgaaaggattagatagcccaattcgcaactggttcaaatgaaaatatccctgcctactagtttgtcctgaaagttgtaactcacagggtaaagtctgtctgatacctgattatttgtttaacttgaatataattacttttgtttacttacctataaactcaagggaaaatctatcttcttgccccttattaatagagtcactactgtagatgtgaggcagtgaagaccgcacagtgcagtggaagaacagaatatgtttattactccagcctattggaaccagaagttgagacgtattttcttctcagactgctggcttctgtttctagcttctggcatacgctgggtctgactcactgacctctctttgttctctctgttattattaggatagttaagcctaaagtggcctccatggaggagatggccaccttccacactgatgcttatctgcagcatctccagaaggtcagccaagagggcgatgatgatcatccggactccatagaatatgggctaggtaaagtcattaccaggcagtgatgggagatggacagactaattttttttataacttgtatgatttttttaatatttttcgttaagaaatcatgtgttaactgtcaatcttaatcttttggtttagccacatataactcactaaacaagcaaaccatatgagttgagcaaaaccacatgaagggttagatgaaagaaaacctttcagttgcttatgccctactggcagtgctcagatctggtctggctgtgtatatgctgatttagctgtcctgtgaccttatattttaactggagtacagatttatgttctggctaagtttttgtacctcacccctcattaaacagctgcattttttaaaactgtaagtgacctgcaggatagtctagaaaaacagcatggtttagcagaggaacattgaactggggggtcaacagagctgggtcccaagcctggctctgtgtgaccactgacaagacacatcacctctcaggcttggtttctctatctgtagcctgtgactagttcatcaggagggtttatcctttctagctctaaccttttaaaatattatatccccaacattggagttgtttctgtctcagttggagctgatattagcacagtggctttttagtaggttaggttgttgtcacacctcaacctattcctcctctttttccagttcaccttttaaccagctcttctgatttttgccctaaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtaagaaaatgacctttctgttttctgactctttccttgagtcagtttctcagttatgtaaactcttatgcttattgtattgacatttacagagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaactagacagtctctaaattccttttcggctttctagaaattcccctgtcttcgagggacttacagtctagaaacattaacaaaattagaatagagaacaacattagttatggtaccaatggaatatatgtatgagctgaagagacttatcagtagaaagaaattaatcatggaagtcttggcagaagtgaattttagagctagttcttaaaagaagtggcaaacagatttttaaaaaggtggaaaattgacgctaataggtttaaaacaaaaggctgaagaatcaagaagagggctcatgctcctctaatgaaagtagcaacccagaggtagatgtctctcaaagacaaagggcttgtgaaaaggctcttcctaggtgcttcttggagttagaggagaagtcctttggagtgtttgtttgtttatttgtttgtttgtttttgagacagagtctcgccctgtcgttcaggctagagtgcagttgcgcgatctcagcttactgcaacctcctccttcccagttcaagtgattctcctgcctcagcctcctgagtagctggaattacaggcacccgccatcatgcccagctaatttttgtatttttgtagagacagggtttcaccacgttggccaggctggtcttaaactcctgacctcaggtgatctgcctgccttggcctcccaaagtgctgggattacaggggtgagccaccgcgcctggccaccttctagagttttatgttaacatgtcaaactgcagtagtctgtctgagaaggattgctgggccctccttcagcatttgggactttgtttgatatttctgtagtacttaatccacattgaagaagaaggattttttaaactctgaatttatcgatcctctgtctgagagaaatgaagccactgtggtagtaactgccaatgcctcactcaggaatcaattgttcatgcaatcaaccgtgaccttaggtgctcttaggtcaagagaaaacaacactttgtttttcagaataaaacacagcacaacttcagcatatgcaggttaagataataacagaattttttccatcaaattgacagattttgtggccaaggaagtccttgaaaaagtttactgctagaatttactagttgggcaacacagcaaaggaaaccaatgttttagtaatgagtcttacatggttttaaaaacagagacaagctgccttttgttagcttttgcttgcttgcctgcttgcttttttcttgctttgtttgtttgtttgtttgttttttgttttttgttttttaataaagacaatgtctccctatgttgcccaggctgatcttgaactcctgggctcaagggatcctccatcctcagcctcccaaggtgctggcattacaggtatgtgccaccacacctggcctctttctttctttcttgttttgtttttttcgagacagagtctctctctgtcaccaaggctggagtgcagtggtgcaatcatagctcactgcagtctcgaactcctgggttcaagggatctgcccacctcagccttctaggtagctaggactacaggcacgtgccaccatgcttggataatttttgtattttttgtagagatgaggtcttgctatgttgcccaggctggtctcaaattcctggcctcaagtgatcctcccaccttggcctcccaaagtgctggcattacacatgacagccactgcacaccgcctgccttttttttaaattcaaaataaagacaatgactgctaggagaaaaaaaatgaccctctcccctcccaggtgcagagtgaaaggagaaagctaagcttctctgaacgaaagacttctaggtcctcttgggcttggcaagttgagaagaaaagtagtgtggcttcatagaaaaggcttgcttctatgaatgacatccagtttattatgcaattaaattaactgcagaaggcctactagggcctgggtcattttccagtggagtactctgcttcttattactgttttgctgccaaaggaagtacactctgtcttgacccaatcacgactgcttctgggctgcacacagacatggggatacccacatatatcgccttaactgttgtagacatctttcagctgatcctgcatggaaacggacatgcctgtgataaatataaattacagagtctctagagattgccccagtttaggtctgaattccaaggtgttcttggcataactagaacctctctgtagatggactacaggcatttaggccacaaacttacatctagccaacatttacctattataatcacaatatttgcttaaacttcccatctgcaaatatatgtacagattcatacatgccatttattcattgaacaagcattgattaggcacctactacatgtcaaatgtatgtttatcatcaccagtaagcagagatatagaaattgaagcaagatatattgtttcccctaccaagtttgaaaaagattctttatttcaaaatatccaggtggtagaaggattacagtgaaattaatacaaccccttttgaaaaccttggaagtgttaagaatgggaaaaaatgttcataccagttgggccagtaacaatattcttggcaatctattctaaggaaataaaccaattctacctgcaagaaatttatatcttaggagtaagacagcaaataattgcatttgaaagctaaaaaaggatgattttcaaagaatattctacaaaagaagagtaacgaaggactaatactattagatattaagcatccaaaactacagtaatgaaaacactggtacaaaaattagacagataggttatagtacaccccccaccccaacaaagagaccaattatatagaatttaatctattacaaaggatgcattgcaagtgaatgggagttgaaaggtctgttgagtaaatgaatggtattgtgacagcttgtaccattataccctcatctactgtaataaactaaaatgagtgacagctagattgaaaagttaaatatttaaaaaagcaaattttaaacactagagtgaatggatatttatcaagcttctaaaggggaagaattttctaagcttagaaagtaattttttaaaatcacaaaggaaaagatcaaacccgactgtacaaaattttaaaaccaaaataacttttaaaaggttttttggctattttcaaaatctaaacacagactgaaaaagcctatgtatcataaatatgacaaagtgtaataggcttgtattatctaacccactcctacaatataatgtataagaagaaatctgcacaaagaacacgaatagacaatttacaaaggagtttaaggacaactggaaaacattggaaaatgttcatcactactaatcaaagaaatgtaaattaaaaccattaggtaagcctcttttttttgagacagaatctcggctctgtcatccaggctggagtgcaatggtgtgatctcggctcactgcatcctctgcctcccgggttcaagcgattctcctgcctcagcctcttgagtagctgggattacaggcgcgtgccaccatgcccggctaatttttttatttttagtagagacggggtttcaccgtgttggtcaggctggtctcgaactcctgacctcatgatctgcctgcctcggcctcccaaggtgctgggattacaggcatgagccaccactttttaagcctaaatttaacagaattgaaaaagatggtactcagtttcctagtgagtgtggtttggaagaaagcattttggtagccaatgtgtattaatgccctttgatcaggtaatcttacttctgggaatgtggcctaattttttttttaaatatgggaaacaaactattttcatgaaggtatttatcagtgttatttataaaattttaaaaactaaaataacatgaatgcctagcaataaaggaatggtgaatctactccttagaatattatcctattgttttactgtttttcttctgtgcaaaagctttttgtttttatttatttatttattatttacttatgagacagggtcttgctctgtcgcccaggctggagtgcagttgcacggtcttggctcactgcaacctctgctccccaaaggtcaagcaatcctcccacatcagcctcctgagtagctgggactacaggcacataccaccacacctggctttttttgtagagatggggtcttgccatgttgtccaggctggtctctaactcctgggctcaagcaatcagcccactttgccctcccaaagtgctgggattacagttgtgtgccaccatgcccagccttatgctattattttaaataatgattataaggattatagggaacttcagataaatactttatgtgtgtcaataaaaaagcaggtcttggctgggtgcagtggctcatgcctgtaatccaagcactttaggaggccgaggcaggtggatcacctgaggtcaggagttcaagaccagcctggccaacatggtgaaaccttgcctctactaaaaatacaaaaattagccgggtatggtggcgggcacctgtaatcccagctactcgggaggctgaggcaggagaatcgcttgaacccaggaggcagaggttgcggagagccgagatcgtgccactgcacaccagcctgggtgacagagtgagactgtgtctcagaaaaaaaaaaaaaaagaaaaaaaataggtcttaaaaatgtatgcacattgtaatcacagctttgtaaaacatatgaagaaaaaaagactggtgggaatgataacagtggttatcttagaataacaataatatagtggcagaattattttttctcccaaatattattttttattttttaatttaattttctttttacaactttatatatatatttttttatttcaataggcttttggagaacaggtggcgtttggttacatgagtaagttatttagtagtgatttctgagcttttggtgcacccatcacccaagcagtgtacactgtacccattgtgtagtcttttatcccttatcacccctcatcctttcccccgagtccccaaagtctaatgtgttgttcttatgcctttgtgtccttatagctcatcttccacatgaatgagaacatacgacgtttggttttccattcctgagttacttcacttagaataatagtctccaattccatccatgttgctatgaatgccattatctcattcctttttatggctgagtagtattccatggtgtatatataaaacattttctttatccacttgttgattgatgggcatttgggctggttccatatttttgcatttgcaaattgtgctgctataaacatgcgtgtgcaagtatctttttcgtataatgacttctttttttctgggtggatacctagtagtgggattgctaaatcaaatggtagatctacttttagttctttaaggagtctccacactgttttccatagtgattgtactagtttacattcccaccagcagtgtaaaagtgttcccttttcaccacatccataacaacatctattattttttgatttttttattatggccattcttgcaggagtgagatagtatcacattgtggttttgatttgcattttcctgatcgctagtgatgttgagcattttttcatatgtttgttggccatttgtatatcttcttttgagaattgtctattcatgtccttagctcactttttagtgggattatttgcttttttcttgctgatttgtttgagttctttgtaattctggatattggtcctctgtcagatgtatagattgtgaagattttctcccactctgtgggttgttaactctgctgattatttcttttgctgtgcagaagcattttagcttaattatgtttcatctatttatctttatttttgttgtatttgtttttgggtctttggtcatgaattctttgcctaagccaatgtctagaagggtttttccaatgttatcttctagaatttttatagtttcaggtcttagatttaagtctttgatccatctcgagttgattttttgataaggtgagagatggggatccagttacattcttctacatgtggcttgccaattatcccagcaccatttgttgaatagggtgtcctttccccactttatgtttttgtttgctttgtcaaagatgagttggctataagcatttggctttatttccagcttctctattctgttccattggtctatgtgctatttttataccagtatcgtgctgttttggtgactatggccttatagtttgtagttgggtaatgtgatgcctccagatttgttctttttgcttagtcttagttttggcttagcttttggttccatataaattttaggattgtcttttctatttctgtgaagaatgatggtggtattttgatgggaattgcactgaatttgtagattgctttcggcagtatggtcattttcacaatattgattctacccatccatgagcatggaatgtgttttcatttgtgttgtctctgatttctttcagcagtgttttgtagttttccttgtaaaagtctttcatgtccttgattaggtatattcttttttttttatttttattagtaaactacattcaatcatattttaatcatatttttaaaagataatacatcatgaaaaagtagaatttataccaggaatataagtatactgtaacattcaaaaatcaataaatgcaattcaccacataagtgtattaaaaaacaaaccatatggttgtcccaatagacacagaaaaggcatttgaaaaagttcaccttcgggccatgataaatatagtcagcaaactaggaatagaagggaacttcctcaaattgatgagggccatctacaaagaacctatagataacatcattcataatggcgaaatactgaatactttcccactaagattggaaacaaggtaaaggtgtccattgttaccatttctttttttttttttttttttttttttagtatttattgatcattctttggtgtttctcggagagggggatttggcagggtcataggacaatagtggagggaaggtcagcagataaacaagtgaacaagggtctctggttttcctaggcagaggaccctgcggccttccacagtgtttgtgtccctgggtacttgagattagggagtggtgatgactcttaatgagcatgctgccttcaagcatctgtttaacaaagcacatcttgcaacgcccttaatccatttaaccctgagtggacacagcacatgtttcagagagcacggggttgggggtaaggttatagattaacagcatcccaaggcagaagaatttttcttagtacagaacaaaatggagtctcctacgtctacttccctctacacggacacagcaacaatctgatttctctatcttttccccacatttcccccttttctagtcgacaaaaccgccatcgtcatcatggcccgttctcaatgagctgttgggtacacctcccagacggggtggtggccaggcagaggggctcctcacttcccagacggggcggccgggcagaggcgccccccacctcccagacggggcagcggccgggcgggggctgccctccacctccctcctggacggggcggctggcggggtgggggctgccctccacctccctcccggacggggtggctgccaggcggagacgctcctcacttcccagacggggcagctgctgggcggaggggctcctcacttcacagacgggcggctgctgggcggaggggctcttcacttctcagacggggcggccgggcagagatgctcctcacctcccagatggggtcccggctgggcagaggcgctcctcacatcccagacggggtggcggggcagaggtgctccccacatctcagacgatgggcggccgggcagagacgctcctcacttcctagatgggatggcggccgggaagaggcactcctcacttcccagactgggcggcggggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagcagagatcacgccactgcactccagcctgggcaacattgagcactgagtgagtgagactccatctgcaatcccggcacctcgggaggccgaggctggcagatcactcgcggttaggagctggagaccagcctggccaacacagcgaaaccccgtctccaccaaaaaagtacgaaaaccagtcaggcgtggcagcacgcctgcaatcccaggcactcggcaggctgaggcaggagaatcaggcagggaggttgcagtgagccgagatggtggcagtacagtccagcttcggctcggcatcagagggagaccgtggagagagagggagagggagagggagaccgtggggagggggagggggggagggggagggggagggggagaagctaggtatattcttaagtattttattttttctgcagctattgtgaaaggggttgagttcttgatttgattatcagctttgttgctgtggtgcatagcacagctattgatttatgtatattaattttgtatcctaaaactttgctgaattcatttaccagttctaggagctatttggatgagtcttcagggttttctaggtatatgatcatatcatcaacaaagagcaacagtttgacttcctctttaccgatttgggtgccctttatttctttctcttgtctgattgctctgactaggacttccagtactatgttgaatagaagtggtgaaagtgggcatccttttcttcttccagttcttggggggaatgctttcaacttttgcccgttcagtataatgttggccgtgggtttgttgtagattattaccttttattaccttaaggtacgtccctcctatgccaattttgctcggggttttaatcataaagcgatgctgaattttgtcaaatgctttttctgcatctattgagatgatcatgcgatttttgtttttaattctgtttatgtggtatatcacacttattgacttgtgtatgttaaactatccctgcatctctaatatcgaacccagttgatcatggtgaattatcttttgatatcctgttggatttggttcactattatcttgttgaagatttttgcatcttcatcagggactttggtctgtagttttctttttttgttatgtccttccctagttttggtattagggtgatattggcttcatagaatgatttagggaggattccctcttcctctaacttttggaatagtgtcaataagattggtatcaattcttctttgaatgtctgatagagttcaactgtgaattcgtctggtcctgtgcacttttttgttggcattttttgttgttgttgttaccatttcaatctcgctgcttgttactggtctgttcagagatgctttatgttcctggtttaatgtaggagggttgtatatttccaggaatttatccatctcctttaggttttctagtttgtgcacgtaagtgttcttagtagcattgaataatctttggtatttctgtggtatcagttgtaatatctcccatttcatttctacttgagcttatttggatcttctctcttctttccttggttcatcttgccaattgtctatcaattttatttattttaaaagaaccagcgttttgcttcatttatcttttgtatttttttgtttgtttgtttcagtttcatttagttctgctctgatcttggttatttcttttcttctgctgggtttgggcttggattgttcttgtttctccagtttcatgaggtgtgcccttagattgtctatttgtgctctttcagactttttaatgtaggtattcaatgcatttgctaaggggcatttccccttagcactgcttttgctgtatcctagaggttttgataggttgtgtcactattatcgttctgttcaaagaattttttaacttttgtcttgatttcattgttgacccaatgttcattcagaagcaggttatttaattgccatgtatttgcatggttttgagggtgccttttggagtttatttctaattttattccactgtgatctgagagagtacttgatataattttgatttttaaaatcaaggcttgttaaagattttcttaagtgagacttgttttgtggcctatcatatggtctgtcttggagaatgttccatgtgctgatgaatagaatgtatattctgcagttgttgggtagaatgtttttttgtttgtttgtttgaggtggagtctccctctgtcgcccaggctggagtgcagtggcacagtctcagctcactgcaagctccgcctcccgggttcacgccattctccttcctcagcctccctacaggctcccaccaccatgccgggctaattttttgtatttttagtagagacggggttttaccatgttagccaggatggtctggatctcctgacctcatgatccacccgtctcggcctcccaaagcgctgggattacaggcgtgagccaccgcgcccagcctgggtagaatgttctataaatctctgttaagtccatttgttcgagagtatagtttaagtccattgtttctttgttgacttcctgtctggataacctgtctagtgctgtcagtggagtattacagtccctcactataattgtgttgctgtctatctcatttcttaggtctaatagtaattgttttataaagttgggagctccagtgttaggtgcatatatatttagaattgtgatattttcctgttggactagtccttttatcattatataatgtccctctttgtcttttctaactgctgttgctttaaagtttgttttgtctgatataagaatagctactcctgcttgcttttggtgtccatttgcatggaatatctttttctgcccctttaccttcagtttatgtaagtccttatgtgttaggtgagtctcctgaagatagcagaaactcggttggtgaattcttatccattctgccattctgtatcttttaagtggagcatttaggctacgttcaatgttagtattgagattgaggtactattctattcatcatgctagttgttgcctgaatatcttggtttttataaattgtattgttgttatataggtcctgtgagatttatgctttaaggagcttctatttcagtttattttgaggatttgtttcaagatttatgcttatttttagcaattcttgtagtgctggctttgtagtggcaaattctctcagcattttttttgcctggaaaagaccatatctttccttcatttatgaagcttagtttccagtggatacaaaattcttggttgataattgttttgtttaaggaggctaaaaataggaccccaatcccttccagcttgtaaggtttctgctgagaaatctgttaatctgataggttttcctttataggttacctcatgcttttgcctcacagctcttaagattctttccgtcgtcttgactttaggtaactgatgactatgtgcctaggtgatgatcattttgcaatgaatttcccaggtattctttgagcttcttgtatttggatgtcgagctctctagcaaggctggggaagttttccttaattatcccttcaaatatgttttccaaacttttagatttatcttcttcgttggaaacacaaattattcttaggtttggacatttaacatagtcccaaacttcttggaggctttgttcatttgttaaaattcttttctctttgtgtttgacagattgggttaattcaaaagccttgtctttgagctctgaagttctttcttctgtttgttcaattatattgctgagactttccagtgcattttgcatttctctaagtgtgtccttaatttccagaagttgtgattgttttttatttatgctctccatttcaccgaataattttcctttcatatcctttatcatgtttttgatttctttaagttggacttcacctttctctggtggctccttgattagcttaataatcgaccttctgaattctttttctggcaattcagggatttttgtcttggtttggatccattgctggtgagctggtatgatcttttggggatgttaaataacctcgttttgtcatattaccagaattctgtttctggttccttctcatttgggtagactgtatctgagggaagatctgggattcaagcgctgctgttcagactcttttgtcccacggggtgctcctttgatgtgttgttctcctccttcccctaggaatggggctccctaagagctaaactgtagcgattgtttttgctcttctgagtctagccacccagcagagctacccagctctggcctggtactggggagtgtctgtaaagagtgctgtgatgtgatctgtcttcaggtcttgcagttgctccagtggaggtagcaggggagtgaagtggagggtccttagttgtgtttttcttaagtgcaccggttttgtgttggttggcctccagccaggaggtggcgccttcaagaacgcatcagctgtggtcctatagggaggatgcaaacttgccctggggacacctgtttaagtattcaggtttctcaggcagcgggcagggccatagaactcccaagagattatgacctttgtctttgtctattggggcaggtagagaaagaccaccaggtggaggcaggggtaggtgtgtgtctgagctcagagtctccttgggtggggcctgctgtgggggacgggggtgtggttcccagtccagtagagttacattcccagggggattatggctgcctctgctgagtcatacaggtctccaggaaagtgagggaaagccggcagtcacaggcttcaccccgctcccatgcagcctgcagtcctagaggccggtctcactcccactgtgcctcgctccccgcgctccccgcgctccccgccctccccgccctccccgctccccccgccctacccgctccaaacagcactgagtctatttccaggcagccagtgaccagggctgagaacttgccccagaccatgagcctccctgttgagaaagcaagccaacttacagttgtttggcatctcagggagcctgcagcagtgatccagttccttcaaagggtctgtggattttcttggcttccctggtatgttcctggggtagttttaggagcaaaagttcatgatgtgagtctccacatgctgctctgtccatccgagcaggagctgtaagctagtcctgcctcctagccaccatattagtaggcagaattattgatgattttttaaacatatttttctctagttttcaaaatttctgtaatgatatgatattattttgtagctaaaattttaccaagataaaaagagaatccccaaaattacagcaaatgtaacaaagggttaaaatctctaactgttctaattgatttttttaaacactaatactcagataaatgaacaaaaaacacaaatagacaattcacaaaagaggaaacattaaacaagcatgaaaaaatatttagtatcactaataaatagaggaattgaaatattagcagttagcccttgaacaacacaggtttgaactgtggggattaatttatatgcagatttttttctataaatacagtcagccctccgtatcagcaggttctgcatctgcaaccaaatacagatacaaaatacagtatttaccgaatgcaaaacccacatatacagagggctgacttttatcatctgcgggttccatggggccaactgtgggatttgagtgtgcatggattttggtatctgcaggggtcctggaaccaatcacccacagatatcaagggattgtatatatatttttccctcctaccaatatgagccaaacaaaggaagatctttgataacatctattactcttggtaatctattctaaggaagtaaaccgacccaaaatatggtaaagatgtgtttgtgaagatggtactttctctgttacttatagtagccaaaaaaggggcaggagggagacccaaatattcaacaacagtgggttaggtagtatactgcaacatatccacttgaagggatattataaaaccattaaaaatggtggctattggccaggcgcggtggctcacacctgtaatcccagcactttgggagaccgaggcaggcggatcacaaggtcaagagatcgagactgtcctggccaacatggtgaaaccccgtctctactaaaaatacaaaacattagctgggcatggtggcatgagcctgtaatcccagctacccaggaagttgaggcaggagaatcacttgaacctgggaggaggaggctgcagtgagcctagatcatgccactgcactccagcctgggcgacagagggagatgccatctcaaaataaataaataaataaatagggtggctagtacaactgcataaatagaaaaaatgcttatcttataatgttgattttgtttttaaagggcagttggctaaacctcatatattcacttagagtcctgtaaagaatatatgcatatgaaaatatcttagagggaaataaaacacaatgttaacagtggctttgtgaggatggtgatattgggtatgtgatacacatatatatatatgtatatatacgtatatatacacatacatatatatatttttttttttttctaagacaagagtttcactctgtcacctaggctggagtgcagttgtgcaatcatggtttactgcagccgcagccttctgggctcaagtgatcctctcacctcagccaagtagctgggaccacagccacacaccaccacacctagctaaatttttttttttttttgaaacggagtttcattcttgttgcccaggctggagtgtaatggtgcaatctcagctcactgcaacctccacttcctgggttcaagtgattctcctgccgcctcagcctcccgagtggctgggactacaggcacatgccaccacgcctggctaatttttttacttttagtagagatggggttttgccatgttggccaggctggtctcgaactcctgacctcaggtgacctacctgcctcggcctcccaaggtgctgggattacaggcgtgagccactgtgcccgggccacctggctaaatttaaattttttttttttgtagagatggggtctccttatgttgcctaggctggtctcgaactcctggcctcaggtgatcctcccacctcagcttcccagagtgctaggattataggcgtgagccacagcatccagccctatatttttatatgtacacacttatataatatactcacatcttttctgtttcctatattttctctaacgtgattgtattacttttataaataaaactttttataataaaaactgctggaaacaaggcaggaagtagttataatgcagtgtggtcagagtgttaacattatatacaaggtagtgtggtgtccagaagaaggaataggaatttgctttcccattggtggggatagaaaattccaagcagaggaaataatgaaattctggcaccaagaaaatacagaacatttgtagaaccacaagtagtgaaatgtggccagagtctgagggcaaataggacaaggtcagattataaaggttttataagctatgctgaggaattggacttttttctgtgcttgatgggaatttactaaagaattttagggagggctgaaaatgtactggttggattggagggaactgagactggaggcaggggaggctttcacaatcaatcaattaacgaacatctattaaactccttctgtatgcctggcactgaggaaacaaagagttatacaggaggttcttattacttgaaggcagttggtactgcacaaaaggccattagtgaatttatttaaaagggggaccaaaattttagagtaatagtggaaggggtagggtttgattaggatgctagcttgaataactaaaagctattaaaatatacatattttgtctcatttaataaaattgagtgctagatataacaatgcactaattcttaaaacaaaaaatatataaaagattcatggcttttgttttgtgcctaatttttcaaacaaaattgcatgatatttcaagatggtgtgtttcacttcctgtgagatatttgtagcatgatctttaagagggctgattttgccaaaatattcaaggacttcattagtgttcccaaaggcttttctttaatcacttggtattcaaatcattctgttttgaaccacttttaaaatcattattcatatttatttttctcctcttcaattgtggactgttctaccagatcctcatcagttttgtgtgtgtgtgtgtgtgtgtgtgtgtgtgtgtgcgctgacttcaagatttccagcatctttttataagatttgtaattttactttctgacagatttgcattgaattgctaactgatatacctgacgatccatgagagacaaaatgactgaacagatggatggggttagattctggtatttaaaggagtgggttctttgagctgggactgctataagtggtcagttcattagcaaacacttgagggcagttggtactgcacaaaaggccattagtgaatttatttaaaagggggaccagaattttagagtaatagtggaaggggtagggttacgacagcttttgtatccttagaaaacctcaaagcctgggtactgctggggctaagataataaattctcagtaataagatctgcctatttcagcaaaggtctagtgcagtgtttttcaaaccagggactgcaacttgttgatggacattatatcaatttagtgggctacaatgagctttctttcatatcaaggtgggtttcgtgaaacttgttctggggtgtgtgtgtgtgtgtgtgcatgtatgtatgtgtttgtgtgtgtgtttgtatgtactaggtcacagtgtgaaatgtcaagccactgtagagtagaatgactgtgaacattaaagtaagacctggatgtaaattcaggctccaccacttactagttatgtgtgtaacctcaggattattccaggaacagcatgtgcagatgcttagaggtgtgaaagttggtggggtgggggggacttccaagtttgtcattaaagctggaaccataggttcctatagataaatggccagagataagtttggagaggtataaagagtccttgaatgccaagctaaacagcttggacttgatcctttaagtcagtggttcttaaccttctttggttgtggaccccactgaattttccacgaccaaaaaaggtttagaaccactgacctaaagaatgcatatacatcccctagaaaatctacatacacaaatttctccttgtagtttcagaaagtataaggatttcctgaagcccatgtatgggtcctagattaagaacttcagctttagacagtgagaagtcactgaaagaatttttagccaggaagaagtaacgttgtcagacatgcattttaggaatatgactctagcaatagttggccgttaaaccagagggacagtgactgtccatagagaaatctgtgaggacattattttgataatatttccaagaagagatgaaagcagcggtgatgagcatagaggagagaataaattcaagagccatttagtagatacaatagatagtaaagaagaccaattagatataaatgataaggaaggggtggtctagatttcttgtatagatgattaaattatgttgccattaactaagaagcctatggggtgaagattcatgtgcttatggaacatctaattgaagatgtctattagagagctgataatagggcccagaccaggacttctctacatttgatgtgtatatgaaacctctgggattcttgtttaaatgcggattctaattcagtaggtctgagatggaacctaggaatctgcatttctaacaagctcccaggtaatatatgctgccagtctgtggaacatacttgaaacagcaagagactggagctcaggagaatcaccttcactgaagatagagatttgaaagtcaacagcattatagattgtattaaaactaaggaaatcaataaaatcaccttggaagcatatatagaataataaggcggggggggaacaaacaaatactgagacttatgggactccagtgtttaaaacggggtggaaaaagaaaagcctccaaaggaatcctgaaaaggaatggtcaaaaagaaagagaatcagaaaagacatcatagaaaccaagggtgaacctcaggaagaccagtttgaatagcaatgtctgatactgtagcgcatgcatctgcaacagaagtgatattggccccaagggaacaaaaatttattcttggtagaaggaggtgaaaaaaacttatattttatgatggtttacagtcctccaatgtaccacagtacataaacagatgtacagtatatctgcagtattaaaatgttatgggggggtcaattaggaaaaggtatctaaaaaggctctttcagtagaggtgggacatgataatgaaaaaatgtttgacagcctgggcaacatagtgagactccatctctacaaagaattagaaaattagctgggcatggtggtgcatgcctgtagtcctagctactcaggaggctgaggtgggaggatcacttgagcccaggagtttgaggttgcaccactgcactccagcctgggtgacagagcaagatctggtctcagagagagagagagagagagagaagagaaatggttgagaaacagtgctatagagatgacgtaagatttatcagtaaggaggtgatgatgaagatgtcttcaaaggatgaaaagggatgtgccagtgagacaaggaggtggcagggtaggggtattccagaaggccagaacaacatttttaaaagtagggcaatataaaataaaaaggcagaaataaaataatgtaaaataaaaagcagagcaatgtaatatagtttggcagatttgagaaactacacatagctcaatattgctggagggttaaggtataaagtagataatggcagaagaagaggtagaaacacaggaaatgggtcatgaagcacttcatgtatattggaatcaccgaattttaaaatgtagatttctgggtctctctcagacatcttgatttggtaggtttggggtagtacataggaacctgcactttcaaactctaggaataattctgttatatgaattttaagaaactctgctataggaaatggggagccactgaaaaattgtgttaggaagtaacacggttagatgtttgtaggaaaataactctgattgcagttatagcagatggattgcaagaggcataggctgaacgtagggagaccgcttaaggtatcacagtcccactgaaaaatgaagacctgaacttaggcaaagcaatgagattaggggacggggaatggtgaaggctgatttgagacagctttaagagataaaagcaagtattgatgattaactagatgtgggaggagatgaaagatgaggaagataactcaggtttctggcttgcctaagtggagtcccaagcaaaatgggaataacaatagctaacctatgttgagctatatagtaggcgctaccttatgtgcatttttctcatctatcctcagaggaacactaagcagtaggtacaaattattatctctgttttatacatggaagtacagagaggttaaatgacttgctgaagtttagtaagtgaccaagttgggttcaaacccaggcaatctgattcttcaagctggctacttaaccactgtgctacacttactacactacctcaataaataggaataggtggtggtgtgcatcagaggtaatatatagggaaatttgatatccagatttggaaatggaagtagaagctggaactggagatagatgtgttgccagtatatcaagtggtggtgaaaaccatgaaaatggatgggattacttagggaaaaggtagataataaggagaaaatgaaagtagagcctagaaccccaagaggcaccaacttgtaatgggcaagcagaagaggctccagttgattcagctgaaaagcaacaatcaagtctagccatataatcaaaatagaaaggggttatggaatcccaagggggcagaagagcttaaggaagaaaagagttctcaacagtttaatgtaccacaaagaggtaatctagataggtactgaagtgtgaatcgtatttgacaattaagatggtcattaatgaccttggtcagagaactttgtagaaagtgatggaagtatacctcaaaccattgaggagtgagtaggaactaacgaaataggaaaggaaagctactgtgtctgtccagaggtttgaatgataaagaaaagaggaggggtgtggtcaagggaaagtaagggttgaggggtggtttgttggtattgttttaagagattaggaacatttagattaagaacatttaggagctgaaggggaaatattggaaatatgaaaaagataagagatggagcaaagtcttagaggtggcaggagagagtgaggtgaatgtcttttagagaagcatctcttgtgaagccagagcgaaagaagtcaagaatgagtgtggtaaaggagtgtgggggttgcctgctagcacactgatgaagtgcctgtccagtggcctctgcttctctatgttgtcctcttgccttgtgtcacttgttcacagacctctttgaatcctttgattctgccttctgtcatcagtgtcttaggaagtcatcttgttccatgtaaattcccttacatggaactaaccctatccatgacattattcatttcacccagcacggtgactcctaacctccagaatgtgtctagatcacatcttgcttggttactttgactggctagtcttcacccttccaccagccttttctagtgtcttattctgtttggttctgcatctcagttcccaatatcttccttcatcttactgataatccatttaagacccacatctctaacatgaccacatccttcttcccccaacaattctgtaatttaccctcttgtcccataacatttcagccttctgtccagcaacataggatctatgccagttaggtcccctctgtcctgcttccctgctaagagagggagaaattactctcccatggaatgctattggtttctgggacttccacctgggggcagtaaatggtagagccataaagctctatgctgtttgtcttggcaagctctacaggaagaatgtagaactagacctccagctcttagttaccacccacccagcagttagaatcaaagctactagagctgtataccaagagcttcaccctttttgcctcagagagagtaaatggtagtgaattacactacagttccagttccccaaagggctctgtgcacagtgtaacttgttaaccaagtagccaaacctcctcctctatccacaccaccccagctccagcctttataaacaaataaataactgcatgaaaatggagatctggattcagtatcagcaacattgcctcaacaccaagggaaacccctccttacctgtggggggcatgtctctgtacttgctattcacaactgttctgtgctggcacctgtagaacaggcacatcactagacaaaaccaacaggcctttaccatagtagcccagatcattctctgtcaatacatgtccaacccataaggcactagccccttcatcagaaaactgcctggccagccaccagcataggaacgagctaggacatgctttgtccctatggcatccctaccactagcctctagtgggtgaggggtgttcctaaaattcctatagaaatggggaagatggtatgtcacaggtgaagtgtggcacagggaatcccagctccatcaattactacctctctgtgcctcagtgtcctcatttataaaatggagataacaatagtatgtaccttatagggttataaggattaaatgtgataattgcagttaaagagcttagcaagagcctggctcatagcaagcatttgataaaagtcatttattatatccagactaggttatactcaggagttcttaggcaacctctcagacaggttcctggtccagcaagtctaactgcctgtgcagctgaggtcagccttgatattgtttgtcacccactaccctttgtccatatgccattccttgctgagaatagactattctctactgccttcaagactcacatccttcactttgtcagaattttgctaccagcatttccaatgaccttctaccccacccaaaacaacacagagaattccctgttcaacccacccctcacactgctaggatccaactcatacctataaggcaaataaagatactatctaccaagagacagagcgaccgcccctaattgatgaggatgactatgtggtagccctgataaccaggacttgccttactaccaaaggagcagattctctctgagtctaaaatcaaggccttctacaaaacaaaaactttggacagcatcttgattcctcctccacctcttccatattagccttgagactctttctgaaaataaaaaggagggagttcttccttgtcataattatcccatccttagtgtaatcactatccaaaattagtctggaaccttctaaatcaattccatagttcttgggcaatattttgagaaattcgcttaatgtgacttgacagaatctctgggctggatggtattagagcgattacagtagtaccaacttcaggccaagccccaaagtgtaaaaatcgtgtttctgggctacattctgttatgccagagtttatatagtgctgggtaacatgtaagcctttttgaaatgaagtctcctaggaagattgaaaacatcagcaatcccttgataccaccagcaatccatctaccacctgtacattttcactaccccaatattcgatctccttaagagaaaggaatttggttccctgtcacacaaaaaaatgaccttccagtagcttaaagtcttgcttatttctaccccagccctggcctatactgttgactaatgccttcaacatccaggtgtggggagtgggatattgtcctgtcgcaggagaacctgggtactttgatctctgcccctgtccccacttctccaagaagttggtcctaaccaaggtcaattactccaagtgcaaatgagagctcttagcgatcaaggccacttttaagacaggacatacttcctttcagagagacaggcagcttgtggtcatgagctcaaaccattacagcctggaccagccagggcatactcgcacccatcctgtttcagaattcagaatcttaaggggaagtggaaatggttccagcttgagaatgtcacagccatttaccccagtcacagcataggtaacaggcagatgcacgtgtagaacgtaaagatcctggttcatcatggcgcagcccagaagtttctgttccatgtgccccattctaataggatctgcagtcacttgtgcccattagcaccactccaagaagcccacacaggtattcaaatatgcttgtaatctgatggagcgtgtttcataatgtagtctgcagaccacctgcatcttaatcctaaaatgatgattccggaatcagaccctttaggggtggagcccaagaatattcatttttaaccaatgcctacccaggtgattctgatacacagcacattttgataactcttcatctaagtggtctttcagttgtctcctgtctgacctaacctgtagtatgcctttatgatttctacagttgaagtagaaagaccaaggtatccttcaggctctcgggacattgggacattgtcccaatgaactctattgtagattcacatctagaacaccttcaaatcagtgattgatccctcttaccctcttggcccaattcacaccagctactggtgccttgttcatctaaaaggtcttccctttcacaagtcccacggccacctgctctccagccacagccatatgcattaaccacgtactggcggagaatgctactgctactctaacacataacacattggttctcctccccagactcctcagaatgcatttcttaactcactatacccctccatccaggcctcttcccttcaaggcatcaatcgtttctagcccactattgccctggctagttactgaaaccatcaacactccagagtctgccaatacctgggtcaaccaaaaccaagtatggactacacaaggacatagccagttagccttcagcatacaacatagcacaggggttaaaagcaggaactctgaagtcacactgcctgggtttgaatcccagcactatcactttctatgtcaacttgaacaacttaaaccctcttttcctcaagttcctgactataaaagggagatgataatactacctacctcaaaaaacagtgtgatatgatatgaactaatatgtgtaaagcacgtagaatagtgcctggcacatactgagcaccaaaaagtgtttgctcttaaattgtatatgaattacactaactgaatcattcaggtgtgagacatcagtgagatttcatttgggcacagactcatctgcccatgccaaaaattgaaggactctttataaacctttgaagtgaaattcagtcatctgcccatagacctcctacagcagcagctccttgaacttcacgcccttcctccgcatgatcactcatccagtcttttcagtactccttggtgtactttgactaccttgtctctgcaattagccccagcaaacctaaggctaagagaccagttatgtcatgaaagaggtgccagatttccagcagcatcatggttggtccaccgcctcattctctgggaaagttgttgaccaagacgtagttgggtggaccactcaaagggaccttgatataatctgattataggtatgctttctcagctcaacctcagcaatctctcttaaatgttattctgagctgggtggtaatggagtgattacagtagcaccaactccaggctaagcctcaaagtgtgaaaatgatgtatattcactttcagttcaaggtaccaggactgggagtaaattacttgcctccaccctcacttcctgaccccagatcagctggatcactctacccattctcactgataaaggaaaaagatcagactgttatgctcagtgaccaaagtagagattgggaaagtatgaacaaaattaatgacagcagatgtgaaaagaaaggatagcacttgagagtaatttgggaagtataattgacagaatggacatggtgatcaattggctgttgggggtgaagagaagggatatgtcaaaaatacccagtttcttgttaagtagatggaaatattataactaagactggaaataacataccaaaaagtacatagaagtatcaaaggatttgtgacagagagaaatctgagtgggtaaaatgtataggcaggagaaggtggtagagagtagattggttggtgggtgtctgattgacatcctaaacttaatatgtccaaagctgaacttgcaatctttccctcccatatggcaatcttattcttctagttgtttaagtcaaacatatcagaattgcccttgactcctttcgttcacacctcaaattcaatctgtaaaaaaaccctgtcaactctgtcttcaaaatacatccagaatctgaccacctctcactacctctagcactataactctagtacaaaccatgatcacctctctcactgattattgcaacagcctcccagctagcgttcctgcttctagccttgccccctttggtctgttctccacacaacattaaaattacccttttaaaacaaattagatcctgtcactcccctgctcaaaacactgcactggctccctgttccactcagagtaaaagccgaagtccctaccatggcctacaaggccctgcacaatatccccttttctcctctccctggtaaaactgctattctctgctttccctcactgttcttcaggcactggattcattgtgccccttggacataccaggcatgttcccacctctagggctttgcccttgctattcccactgcctggaatgcttttcccccaaggatgtcccttcacttccttcaagtctttgctcaaataacactttctcactgaggccttccctaaccacatttttaaaaaatttgcgcacgagaaaaaaaaaaaaaagcctcctgtcatccttttcctgttttactgttctccataccattgataattggaaaaattacctaatctacttgttaattatatctattttgtttcaccctcccgccaccactagagcataagcttcatggggaagggaagttttgtctgttttgttccttactatagcttcactgcctagaactctacctggcacatagtaagccctcatacaaggccccagctcgtattgttggggaatggacaagcgtgaaagttgcagtagatgggcaggacagagatgaataggaaatgttaattcccaaccctttaagagactgtccatcatagtgttaccagttgacttactgaatgttaaaatgtttgggaaataaagttattaaattggaatgattagttaatgccttctcaagatagattctcaataaatatttgttgaatgaatcagtggtaatatcttgacagatatcaaattatcaggaccgggagagagagaaggtgagaggttccacgtggcagtcagagattacagtgctcacaaagtcaagcagtcaggatgtcagagattccagcatattgaacattactagactgtgggctgttatataagcttcacattttaacaaaaaaaaaaaccactagagggagtgcaaggttaaatcaagtatgttctccgcttaatgaaattctattaacgtcattctcgtttctatttattgatctatgttcatctaaactgtttcatcaggtcagagcattctgcaccattttctttcaccagtccagtatctgactcataataggtcttcaataaatgtttataatttgaataaaagaatgaaataatgaatatttagaatcaacagacttttcatcttgaaatttgttttgctaattaacagtggttagtatttccattaagaaaccattcttcagagttcataacctggctgataaagataacactcatgatccttagtcttaaagaatctttaggcaagaggaggaaaagagtcagacttggagtttgtgtgccttatttgtataaatgatagtgtcagacaagagtgtatgttgtaaagccagagctaggagtcactaaagccccagtcaggcctctgctcccatatcagctctttccttctcaggaggggtgggcagctgctgaaggatgcggttcctctgggcttgtttgaccccacgggaatcattagctctgcttttgtacatggggatttcactgcttgagaaacctgctgtccacaatgtgcttgagagctgtagggttgttcaggagaaagaaagttaaacagactttgcttattgtcttaatcatccattgttctcactgaaattctctgaagggattttgggtgtctggatttgcagctttctgacctgggttattgttgggggtgcggagctcttgtctagttatcatctgatggctgaagcctccaactgccctggatccaggcccatgagctgggccctcatattaggaatttttcattaatggaatcatttcaaatggtctgacaaaataaccctttttaaaattttgattaacattttttaagaatggttttagatttatagaaaaattgagcagataggccaggcacggtggctcatgcctgtaatcccagtactttgggaggccgaggcgggtggatcacgaggtcaagagatcgagaccatcctggccaacatggtgaaaccctgtctctactaaaaatacaaaaaaaaaaaaaaattagctgggcatggtggcgcatgcctgtagtcccagctactcgggagactgaggcaggagaatcacttgaacccgggaggcggaggttgcagtgagcggagatcgtgccactgcactccagcctggtgacagagtgagattccgtctcaaaataaatacataaataaataaataaataaataaaattgcacagatagtgtagagtttccataaaccccacacagtttcctctattgttaacatcttacatgagtatgaaacattgttacaattaaccaatattgatacatgatcactcattacagtccatagtttattcagagtttatagttccttagtgtttacataatgtcctttttctgtccccagatcccactaggacaccacattgcatttagttgtctccttaggctcctcttggctgtgtcaatttctcagactttctttaattttgatgaccttcacagttttgagaaatactggtcataatactcagtactacatttttcagtgtgttttatgtattttaatgtatttttccatctatttaatggaatcttttcaaaagcctgagaaacacaacccatttttattgctcttctcaacacctatttttatgatatgtctgaaccgttcctgaagctagtccttgctagaggagggcaagtgtctctagcattggtgaattttctaatacagtatagactccagagtaagcctttctatttgttttctgttgtcaccaaacccatcctgatatcttttctcaggcaactttaaatggaaattgaaggtgcaaactcaaagtttgtatctaaaactaattgatcttttgccttcttttttcttctgatgtcttaactgtagtaagagtcctaatttttcagtgtcagtgtttaaatataagaaccaagggaccgagagcagtagctcacacctgtaatcctggcactttgggaggccgaggtgggtggatcacctgaggtcaggagttcgagaccagcctggccaacatggcaaaaccccgtctctactaaaaattaaaaaattaaccaggtgtggtggtgcgcacctgtaatcccagctactcgggaggttgatgcacaagaatcgcttgaacccaggaggtggaggttgcagtgagccgagatggtgccactgcactccagcttgggtgacagagcaagacttcatctccaaaaaaaaaaaaaaagaaaaacaaaaccaagggctaagagaaaggaagtaagttgcatagagccacattattccacagctttacctcaatatgattttctaccccaacttgtctttaatataactgtattatcaccaagataaaactcatctttttttcagcatatttgcaaatatttaatccaactacccactcagattcttatacaactgatactactaaatttagttggaatgctagtaagctgcattcacttcctcactggtctttgctagaattcagtggatttttcttctgataatcattagtttcaatgcctttcatgtactgtctttggaatttagtaaaaatggctctttaaactcttctggaaactaaggacaaaggtaaggcataaggggcagaggtaaggcataaattgagaggagcttaaaccactagtcttgcctgatgtactttaatataacagtaataataaagcatataaagtggatcaagtcaactggtaactatggactttattccagacaactaacaaattttctttaagagattatgacagcctcctctgggaggcatcttgaaggtcactaagctcttgttaatgccttgaccaggaatccctatctgtggatttactataagagggatatatatccataaagaaggtacaacaattaacttcagatttctgcttgccattcaaggcttaataataaataatagcagtatttactaaaaatttctcaaatgcatactaattgcaggaaatgtataaatagttggaactcaagccattcacatgagataacattaattattgggtgtaatagtacaaaatatgaaacttttagaactgttcaggtaaataaaggatctttccacctcattagatggcaactttggaataggctcaacattggatacaggtcactgagactgaatgatttatctgtgccatatacttgaatacatttttgtttctgattaaaggttggtcttctttcaggtaatatctgtagttagttagctcagaaagttagagtatagtgctaatgaggccaaaactatgattttagtccttgtacaaaccagttagttttcatttactctaatgctactactggctgcaccatttcccttggccagccagctcttcaaaagcatattctaagtcataagggaggccaatctgggaggcgtaggttgataaatctatcccagttttgaagaaacagcccaaaccttctttctctctgtgctgggtcaattacatcattgtcactggtttggctcactatgctgttatgagtaccctaaaatgcagaactatgtccactgcctcctctgttttatatcctattagctcaggaaagattttcattccattgagcaccagactgtggggtatatttttggaagcaagtgtaggtgtaccagagccaaaaaaggttgggaacaactgtagacaaactgatctcactgttcctagagctgccaactctaggcacagagcccttaaagtggactataaatgtcaagtgggtagttaaaagaaaacccattatgtggaactaatttctgatttcccacaattaggtgcatgtattttgtgtgcatgtatattttatgtggagagaagcagatgtgcacgaagcttatttatttagctatatgtattaaatcacaattgggggcttaatgagagaaaaaatgtgagtttcataattacaatagttaaaactttggatttttaataaatatctttaaacttatcatgataacattcctctgaaggagacaggtaagattagggagtttttggtaagatgaaaaactgaagcagagacctaggtctcctggtttctaccccggtttctatcatgtaagtgtccaagaggacttgcttgatataactatgaagtcaaataacagaaagatttctgttttttccagtctccttctttgatagaggaaataatgcagttataaacacaccagcttgatctgtaaaagccattgagtcagttctcacaagagagctctgcatttgacagctacatgaactgggccacagaagtagtgaatggggtgttacgaaaaggagcccacagaagatatcataacaaggtttggacattaggcatggaaacatctgattatataatctgttaaccagccataagctataatgacataggctaggacttgtaagctcatgtttccttccctagatcattatacccagcagtgaggaaaagaaagctaatgtgttctaatagggatgtcagcactatcttaaagatcaagtacgggtgtgctccaactgaaagaaatctcaggaaataaaagatgtgccgttaccaaatttatagatacagggattttggatagagtattcactttatagaagggctcttccctatgaccggatttacctgagttccttaaattaagttctccagtgaattcaagatttgatttacaaagaattatcacatgacttttcaggaatatattcctgaatcaaattttaccatagtattactatttataaaatgtaggtattttatgatagtattactatttatacaatataggtatttcacaatacacagtctatgcactaacataaagcaaagagcagatttcacagaactttgttttcctgtttttttttgtagcaccatatgagatgtgtagatttacatgtaaggtaaagcataaaaaccagattatgagtactgtctagagagaaggagagacacaagggcactaaaagactatgagaattcaatgggcaagagatacaaaaagagaaagaacactgaaaattttagccatttccaatttctgggaaagccatcatgatttctatctctggtatgcctctcacctcagaccaatcagttgaattttcctcccctgctgatctcctgtaaccatttctgcccttaaacatagaaattacttataatggtacaaatagcatcatttaatgaagcgacagtagaagcaccaataccacattcccagaacagcttaagaggtttgatcagctagtactgaaaataaggaaaacaacgtaccttgtttgaaagtaagaatgaaacttgctaagcccaaccctggatcataaaagctacaggcttgggtaggggtgctcttaaatgccaaagttacagctagaaaaatgacccttgtcctgacctgccaacaaccatggaaatttacagaagctccaacaactgcagctctgtagaaatggtggacagaattataaaaagatatttcagagcttctagctaattgcagttaaacacccaaaatgtatgaagtgaataaatttctaaagggcatcttcccacatcagaaaaagcatcagctgttttctccatctttccatgtaataatcagcatatatcaagtactggaactaccatccataattctactatgacgggccccttgaaaaggtacatttcaagaatcataacttctttccatttatttagatcatctttaatttctctcaacaatataattttcagtatacaagtcttgcacttcttttgctaaatttattgctaggggccggatgcaatggcttatgcctgtaatcccagcactttgggaggcccaagcagtaggatcacttgcggtcaggaattcaagaccagcctggccaacatggcaaaaccccatctctactaattgtacaaaaattagccgggcatggtgatgcgcgcctatagtcccagctattcgggaggctgaggcacaagaatcgcttgaacccaggagttggaggttgcagtgagccaaggtcacactactgtactccagcctaggcaacagaatgagactttctcaaaaaaaaaaaaatatatatatatatacacatatatatatagctacgtattttattcttttgatgctattataagtaggattttctttcatttttggattgttaattgctactatatagaaataaaattgatttttgtattttgatttcatatcatgcaatcttgctgaactataactattagaagtgatagtttttttagtagactccttaggattttatacatacaagattatctcatctgccaacagacatagttttacttcttcctttgtattttggatgcctttcttttctttctttttttttcttcttgccaaattgccctggctagagcctccaatataatgttgaatagaagtggtgaaagtgggcatccttttctgttcctgatcttatggggaaagcatctagtctttcaccaggcagtatgatattagctgtgaatgtttgtaggtaccctttatctggatgaggaagttccctattcctagtgagtgtttatatcgtgaaaaggtgttggatcttgtcaaatggtttttctgagtctgttgaaatgctgatgaggtttaatcctttatcctagtaatatggtatattatattgattttttgatgttaaaccaaacctgcattcttgggataaatccttttttggtcatggtatataattattttaatatatttgctggatttggtttgttagtattttgttgaggattttgtatctatattcataaggaaaagacgttagtctgtagttttcttatgatgtttttgtctgattttggtatcggggtaataatactgacctcctaaaattagttgggaagtattctgtctgtttctagttctaggagacaatgtagataactggtattatttctactttaaatgtttggtagaattcaccagtgaagccatctgggcctgggctttcttgcagaaattgatatgatgattctaaaattcatatggaaatgcaagggacccagaatagccaaaacaatcctgaaaaagaataaagttggaggactcacaattcccaatttcaaaacttaccataaagctacagtaatcaaaatagtctgttactggcataaggatagatacatagatcaatgggatagaactgagaattgacaaataaaccccacacatccatggtcaatttttggcaagagaaccaagaccactcaatgggaaaagaatagcctcttcaacaaatggtgctgggataacctgataaccaccttcaaaagagtgaagttggacccctacttcactccatatttaaaagttaagtcaaaatagatcaaagacttaaatgtaagaactaaaactataaaactctttgaagacaatttagaagtaaatctttgtgacctgggttaggcttcttagatataataccaaaagcacaagtaacaaaaaaatagattgaatttcatcaaagttaaaaacttgtgtgctgcaaatgatttatcttcaagtaagtagaaagataatccatagaatgggagaaaatatttgaaaataatatatctaagaagggtcttttatccagaatatatgtgtatagaactcttgcaacttaacaataaaaagagcaatgactcaattgaaaaatgtataaaggattcaaatagatgtttctcaaaaaaagatatacaagtagtcaataagagcattaaagatgttcagcatcattagtcatcagggaaatgatgagctaaggaggaggatcgcttgagcccaggagtttgaggttacagcgtgctatgataaagccactacacttcagcctggatgacagagcaagatcctgtctctaatttaaaaaaaaaaaaaaaaaaagacactagcaagtattcaagaggatttggagaaattggaaccttcatacattgctggtgagaatctaaaatggtacagctggccagatgcaatggcttacgcctgtaatcccaacactttgggaggacaaggtgggaggattgcttgagaccaggagtttgagaccagcctgagcaacatagcaggaacctgtttctacaaaaaaaaaaaaaaaaaaaaaaaaatgcccaacacggtggtgcatgcctatagtcctggctattccagaggctgtggtgagaagatagcttgagcccaggagttcaaggccatagcagtaagctatgattttgccagtgcatgctagcctgggcaacagagtgagatcttgtctcaaaataaaataaaataaaacaaaaaacataaaatggtacagccactttagaaaacagctatgtagttcctccaaagttaaaaatatgacccagaacttctactcctagggatgggagtgtatccaaaagaactgaaaatatatgtccatacagaagttttttatgccattgttaactgccacattattcactatagccgaaaggtggaaacaaccaaaatgtgcatcaattgatgaatttaaaaagcaaaatgtggtatatccatacagtgggacattgtttcataataaaaagaaatgaaatactgatacatgctacaacatggatgaatcttgaaacattatgctaagttaaagaagctagtcacaaaagaccataaattgtatattccatttgtatgaaatatccagaataggtacatctatagagacagaatgtaaattagtggtttgccagagccttggggggttcaggagaaatggggagtagttattgttaatgcatgcagggtttctttttgaggtgatgaaaatattctaaaattggttgtgatggataaacaaaaaagttgttttctttttaaagaagaagaattaaaactagtaggtcttacagtagactcattatgcatattagtgaccagaaaataaaacttttctgaataatcacctttctatttttctgttcagtggaagaaattgataaggaaactggggaaatggatagagaaactgagaagttggctcaagtatccctccaaatttaacacttttcagaaaacatattctgatcagtttttcttctttagatagtatagattttatatagtaattccacagttaaaacatcctctttgaagtgcaaattttctattgggggtgcttttcacatgaaatagaaatcagatccattggctacccttcacatacaaaatataagtccagacaatccaagtatggctttaaaagtctggccttaatctacccttctagcctcatcaccaatcattccttgctctggctaattcttcagttcacaattcccctgagccttcccatgcttttcctctgtctagaatgccctacacacctcttctcctcctggaaaactgctactccttcaaggcacggcttaattgtcaccttcacggtgttcttcctgactcccatagacagaattaattgctctagcctctgttttaataggatttgtttttgcctctagcatatcatgttatgttataatgtgttagtttttcggtcttctgccattggaggcagaaaccaagtgtttttatacttctgtatccactgaatgtactaagtataagcctggcccatggtaagataccaattaatggctgattgattagagggtatgtatgtaggtaggtaggtaggtagatagacagacagacagacagacagaatcagttaactacttgtggtctggaaaaggaagcataagataacattctcctgctcagcgttctcaaggcttgattatcagcaataaatatttcctgaacccctctgagaatgtatagtatcattgaaaatccaaatatatacataatggtttctgccctttaggatcttaagagattaaggagatacgactgagatatatgctgtaaccaaaaaaaaaaaaaaaaacgcataaaatagcatatgagtattcagcaatttaagacagattataattgctatcagaattcagtgagaaggaagctatatcttatttctatatctcaggtttggggctgcatggtacagcatttcaggcaactgagggctctagaagtaccctcccaagtagatttccaaagtggtaatagaaggctgataactctcagccctatggtaggcagacagtaaactgcactattgatttccaaggtgacctagtcaaggggaaagtaagctgtggctccttggagcattttcaaggcttttaggctattttccactgggtagatatattagtccgttctcacactattataaagaactaactgagactgggtaatttatgaagaaaagacatttaattgactcacagttctagaggctgtagaggaggcatggctgggaggcctcagaaaacttacagtcttggcagagggacaaaggagaagaaagcacatgttaccatggaggcagaaaagagagaagggaaaagtgcaacatactttcaaacaaccagatctcataagaactcactatcatgggaacagcaagggggaaatccacccccatgatccaatcacctcccaccaggtcccccctacaacactgggggacacaattcaacatgagattttcatgggaccacagagccaaaccatatcagtagggaatccctgtatctttacctgttttatggaatgtaaaaaaaatctacttattcacaaatgtgtattgagtactgtattagtttcttattgctgctgtaacaaacttctacaaatttagtagcttaaaacaacaggaacttattatcttacagttctggaagccaggtgtctgaaatgagtcttacagggctaaaatcaaggtatgggcagggctacattttttctggaggctctagggaaaaatctgtttacttgccttttccttgggtcaagagctatattcattgctcatagccccttcctccaacttcaaagctagcaacatagcttcttttctctctcttatgcttccatcacatagcttccttctcttccatgtcaaatctccctctgcttccttcacaaagacacttgtgattacatttagggcccacccccataatgcaagctaatcgctctcatctcaagacccttaacttaatcatatctgcaaagccatttttgccatataatgtaacattcataggttccagggattaagacatgggtatctttagggtccactattcagcctttcacaggtatttactacatagcaggcactgtgctaggcactttttatctgtgctacatttattgtgtccatagcttttccctcctgctatactgtaaactcctggaagacagagtccttgttgctttcttgctcccaatgcctagtatgtggccttgcttgaggtatataatagataccaggtaaataattaaagaatgacatgagctacaccttgtcacatagtagaatttaaattaacttcattcaaccaatgtttattgaggcaaagagaacgggtttggatatctagatagatacaattcagcaaacagttgttgagctcctgctatgtgccagatatcttactagttattaaagataaggacatgagtaaggtagttccaccccctgaggaaaagtagtgggtaaccaggtgtgcccagactggataagaatggcctggttggtggagaagcaatgtcccagcttcaggcacctctgaggagagcaggttaataaggatgcttcctccagaaggaagcctgaatgtcatataccgtcaccaccatcatgacccccagccattaccccacgttccctaccctatctgctgctgagatgccctctactacattactgccaagcattcttcagcttctgattgctcacctcttatcacaggaagctcacttttccctggggaagcccatttgatactcaggccgttttaaaagttaacaaaattcattgagctaaaacaatgccactgctcttcctacctcttctgcctcctgcagccacacagattaatctaatttttcagtctcatgacagccattcaggtatttatagagactcccttgagtcatatcttctcattcatccatttgttcattcaacaaatgctttctgagcatctcttgtagggctggcactgtgctagggggttgagatagagatgagtagacaaaattctgtcctcaaggagctcctagtctagcaaacagacagcagtacaggtgttctaggagaaacagaaggagatacaaaatgctgtagaaacagggtagagaccaaccagctgtacctagggctaagaggacagaaaggtgggccaggcatggtggctcatgcctgtaaaccaagcactttgggaggccgaggtgggtggatcacctgaggtcaggagttcaagaccagcctgcccaacatggtgaaaccttgtgtctacttaaaaaacaaaaattagccgggcatggtggtgcacacctgtaatcccagctacttgggaggctgaggcaggagaatcacttgaacccaggaggcggaggttgcagtgagccgagatcatgccattgcactccagcctgggtgacaagagcaaaactccatctcaaaaaaaaaaaaaaaaaaaagaggtcagaaaggtggtacttcagcttggtatcattcgttcattcagtatgtgtttagtacatgctgtatgtcaggaactctgctagatgctagagatacaatagtgacctaggatattaccagacagagtatgccaggcaaatagatcagcatttgcaaagtcaagaaggtgtttattcatgtatttaaatacttgtttcggtcattgggtttttactgtgttcccataaatgatgctaggcactggagataaaatagaccacaatgacactgtccctggcttcaagaagttcatggtcaactgagactgacaaactagcattctaccgtaatgtaattcatggttgtaattgccacagagtactaggaaagcatatcaacaaagacactaaactcaactgggctgtggggaagtgccgagttcagaccaggcctttctgaagtattgaggctgttgtggtacttgagctgagtcataaggggccaggaagcattagcctggcagatgcagaagaaaaagataaggaaaagggaactgaacatgcaaaggtaggaaggcatgagagaacaagacttgtgttgagagctgtcaagaattcagcatgactgaggcagaaagtttgggtcagtggcaagagatgaggctggaaatttagaagagggctgaatccttaaggaccttgtgtaacatactaaagtgtttggactttatcctaaaggcagtgggaagctagaaaagatcattaagcagggaagtgacacaatcagatttttctttgacaaaaataaccctggcagcagtgtggaggatgaaatccagggggtgagactagaggcaggaagactggtacagtcagccaggggcgcgataatgaagccaatggcagaggaaataagaaggaggggccaaagggaggttttatgaagtagaattatccaagagaggaagacagaataaacaaaattgactctaaggttgccagtctgagaaatgatgttaagaatacaggaggaagagtgggtttcagggcgtgataatgatgtcatcattggtcatggtgtcttcgaggtacctgagaggtagaaagatgcctggtaagcatttgatcataagagtggagtgcagcagagtggtctgggcataaatgagaatggcatgtgcaagtaacaatccttaattcaacaaatatttattgagggcctagtatgtgctatacactggaggaagttctcaaggtcctggagttacaaaggtgaattagacagtttccacccactgagagcacaccctaaaaggaaaaccaagatacagaaacaaaccacgataaggcagtgtagaaatgcggcgagagaggtgtgcacagtatattattaagggagcatggacaagacacatctaacctaggggagaagaaggatggcttcccaggtgatgtgctgtcttagctgaatcttaaagaagaaataggagttaatcaagtaaaaaaaaaagagagggtagagcattccaggcaaaagggacagcaaaagcaaagttggggcaggagcagggagaaaaaacagtgtaggcatttcagtattgctagagcacaaaatacaagaaatgaaactaaagtacctaagggctgggtcacaggaagccttaaataccatgttcaggtagtttggactataaataatagggagctagtgaagagttttttaaagaggcaaggtctcactatgttgcccaggctggtctcaaactcctgggctcaaacgattcttttgccacagcctcttaagtagttaggattataggcacaagccaccacacatggctagtgaaggttttaaagagagtgacatggtcagagctgcatgcaaatgggtcacttgatggctgtgattccccctcctagaacataagctccatgaggaccgggattttttttttttttttttttttttttttttttgagacagagtctcgctctgttgcccaggctggagtgcagtggcgcgatctcggctcactgcaagctccgcctcccgggttcacgccattctcctgcctcagcctcctgagtagctgggactacgggcgcccgccacaacgcccggctaatttttttgtatttttagtagtgacggggtttcaccgttttagccaggatggtctcgatctgctgacctcgtgatccacccgccttggcctcccaagaggacagggatttttgtctcagtgcctagaacagagagcatttagtaaatactcattagatatttgttgaaggaaggaattaatgtaggagaccaatttgaggggccaagacaagaggcaagaaggttgtgacgctaatcctgggtacaaatgatgaaggtctggcctgtgattggcagtgggaggtgcagagaaggcactggagtcgtgagctgtgtaccaagctttcgtctgggtagatggtgatacctgcgatgattttatcctccttccaatctatcatactgacggtctgctctgttctcgatactgctagacaccaggcatgcaaagagaattaagatacgtggcctgcttttaaaaagctcttaatctcatggggtagacagaccaacctatgaaaagatagatataggtataatgcaggaggtgagtggcgggcaagacagcattactgcttgagctctgccttctgtcagatcagtggtggcactagtatcatagaagagtcaagtgtattgtgaactgcgcatgccagggatctaggttttatgctccttatgagaatctaatgcctgatgaaactacccccaaccatgcccatggaaaaattgtcttccacgaaaccagcccttgaggccaaaaaggttgggggctggtggtataatgtatcatgtattagtgttatgagagagttcagaactagtaagggcaccatgtagggaatagctacatgggggaggagtagggaaaggcttcatggtagtgacatttgaactggttgtcagacatgggaaaaggggttgccaggcagagcagggagagcgtggcattctgggatgatgaatcttgtgcatggacgtggaattgtgaagggacttgatcagattccaggactagtgagaagcgggtgtagtagtagctaacaatcacgggtatcaccatctacgcagacaaaagttagacacacaagcctccagtatctccatagactgttgattctacctcctaaaaagttcttgactccaaccctttctctgcacctcccactgccaatctcaggccaggccttcatagtttcataaagcctgtgttaagattctgaggcctcatctgggcttaatgggaaagagcgctgtgatcaattagcaatgtctgccatgggtataagagtgaagaatggcagcatgcatgccacatccctgggcatccctagggcatagggtatgaggtagagaatggcagcagctggtaccttagaatccagttttgagtgtgataagactgaagtacttctaggctagggatgtccggttgataagtaaataaagagctcagaagataggtcagtgatgaagatatagatttttggagttatcagtatacagatcagaagtagacaaactatttctgtaatggtccagctagtattttagacttcacaggccatagagtttctgtcatatctattcagctttgctgtggcagtgttaaagcagccatagacaatattggaatgaatgggtatagctgtgttccaataaaacttcatttacagaaacacatgacaggctgggtttggcctgtgggctagtttgcctacccctgatgtgtatggtatacagaatatagtcctacctggtgtcagacaagacctgagtttgagtcccaactcttacatactaactttgtgaccttggataagtcagttcaacattcctgactccattttctcatctgtaaaatggagattggtgatagaacctaccttacaagattactgtgaggaataactaagcttttccatataagcactagttatagtccctagcacatagtaaattctcaataaaggtttgataatcgttaatatcactattactattgggattgttcatgttgttatagattttaattaagatcagaagagtggatgggatcactgaggaaaagtgggtagagctgaagagaagagagcatcaacatttagggggcaaacagaggattggaaaccagagaaggaaactgagaaggaactggcaacattgtaggaagggaaccataaagaagtagtgtataggaatcagaggaaagaaagtgttttaagaaacgggtgagaggcaaaggtcttctacactagaaaaatgggcaaaggacatgaaaaggcagttatcaaaagacatacaaatggataataaatataagatgttcagtttcactaacagtcaaagacgtgaaaacaaaatcatgtgtttttagtgtttgcctatgagattagcaaaaatttaaaagattgacacaatgttaccatggctgtgggaaaacaggtactgttttatatttattggtgggaatgtaaatgtttttgtactttccagaggacagtttagcaatatgtatcaaaatgaaaaataagccgattctgtgagacagcaattttacttctgggaatttaccccaaagagatagaaaattatacaaacgtattttttaaatacacataatgacattggtcctagcattatgatagcaaaagcaacataaaatattcaacaatagaagaattatcatggcagacagacacaatggaatattgtacagccatttaaaatgatgacagagctctacacttattgacgtggaaagtgtccatgacaaattgtaaaaaggttataaaacagcagggtagcattgtctccattaagtaaaactttgcttcctagcaaatagtgttttttgtttgtttgttttctggatagtgagatttcagatcattacattttttgtcaaaggttgaatattttttactgagcacatattacttgataaaaacagtaacaagtactgtgttggtaaaccagctctctgaaaaaataaagcctcaatttatagcagttgtcaattttagtaatataaatactccccaaggcttgcaaaatttttaatatgcagcaatcggctcttaccagctggctctggcataccactggcaatgactctgtttaaaactcaataatgtggtgtatgtttaccagtgtcaaatgctaatcaagtaagatgaagattaaaaattacctatcactgatgtgcctggtaaaaggcatttcagtggaacagacagttgcagaataaatgggaaataaggaagtggagaaagcaaggcattttgtagtcaacagaaggaaagacatgggcaattgcttgagggagatgtagagtcaaggcaagtttaatttgaaggagtggaaagaaataccaaacagagataatgttacaaactttttcatttcttacttttgaataatctttagagttcaaagtatgcatgcacgtgaaagttcttgaaacaacccttccttcgtgttggtgttattatcattaccactgtatatatggagaacctgaggttcagagaggtttagtggcttaccccaggtgtcagagagtgagccacatttgtgtgtgcctgttgggtttcacccactgggtaagccctgaaaatagggagacggataaaatgtggccactagcacaaatgcctcaatccttctcgaacctgagtctccctcttctataattttaagttctttttctgcttgttctgggaaggccgtggcaagccatgaacctgggtatggattatttgtctctgattggatgagaagagaagctagcccagcatgagagcgcaagtggttattagcaacaatgaagttgagtatgttgaggaccgagaatgggtctgttggatttggcaatcaaagattactgccatatttacagtggtgtaaaaagaacaggctgaggagcaaatgaacaataaggaaataaaggcaggggagagagagacagagacagatagagagaaaagaagaattatagtaaatatgggtaattttaaaagcacttgtttttagtgctcaaattatcccaaatttggcctttgagctggctcctatgtgtttgtgacatgaccccatcagtttttcagcacctttaatttctggtgaacaaggtttccctggttttctgaactatccctgctccagccctggaatcagccgtttctctcagaaatcctggttccttttagtagggaatggcatttcagtaccaaaatctaggtactgggtatgctcattgccactggcatgcattgcttgccttttctgtagaccaacctaagaaatatataatttttaaagaaattatgaaaagattgaaggaaatggattatagcatagtctatagtgctactccaaagacagcgagagagagggggaaaaagggagaaagacctactttagagcagaacagcagctaataaatgtagaaggtagactaaaaaaaaaatcactgttttgcagccccccagtacaataattgattttggcaaagatcatcagatggatgctaaaacctttgagcagaaaggtccttgagaacaggatattcacacagtttcaaattatcaccccacagattccttgctaattacaaagaggaaaatgcacatttacaataggaaaatctggcagtcaccaggttaaacaagttattaaactcagcattgtcagtagcaggacaagctgacatcgtgctttctgatgtgatctcagatgaagtacaaagcatcatttatgaaatattcttgccagaaatgtttatgaagaaacaattagatgaacctagagtgtgggatatccaacaagtgaactagcctggactcttcagaaagccattatcatgaaaaacaaaagaaggtggaggaattgttctggattttagaaaacaatgaactcaaatacaatgtgtcaaccttgaatggattctgaattggagagaaatcttaaacaattattaaagacatttttggaatgatttgggaaatttacagactatattagatgatattcttgaattgatgttgattttcttaggcatgataatgtagaagtctttttcttaggagatgcatgatgaagtgtttaggagtgaaatgtcatcatatttgtagcttactttcaaatggctcagcaaaaagtgtgtgtgagagagagacagaaatgtggaaaattatgacaattggtgaatctaggcaaaaaggtatatgattgcttgtcatactattctttcaactcttccataagtttgaaatttttcaaaataaaaagttggaaaaaacagttcttttaaagcctatgaaatgtatgatgagtttcagcaaatgatgctgggacaattggatatgcagatgcaaaatgatgaaattagaccattacctcaataccataaacaaaaattaactcaaaatggaaaagagacctaaatgtaagaggtaaaactaaaaaaacttttagaaaaacaaacataggagatttttgagacgctggttaggcaaagatttaatacatataacaacaaaagcatggtccataaaacaaacatttgataaattgaacttcatcaaaatttaaaacttgcccttcaaaagacaatctttgaaaattaaaagacaagctacagactaggaaaaaatgtttgcaaatttcatatatgataaaagtcttgtatccagaatatactgttacaattgaataatagacagacaacccaatttaaaaatgggcaaaatattttaataaatactttgtcaaagaaaatatatgggccaggtgcagctgctcactgaagcctggcctgtatattccggcactttgggaggctgaggcagatggattacttgagctcaggagttcaagaccagcttgggcaacgtggtgaaaccccatctctacaaaaaatacaaaacttagctgggtgtggtggcacattcctgtagtcccagctacttgaggggctaaggcaggaggatcacttgagcccgggaggttgaggctgcagtaagccatgttcgtgccactacactacagcctgggtgacaaagtgagaccctatctcaaaaaaagaaaatttataaatggcctaataggcaaatgagaagatgctcagtatcattaatcagtaggaaatcacaaatgaaaactaccatgagataccattactcatccactagaatagctgtaatcaaaaagatagacaataagtgttggcaaggatgttgagaaataggaaccctcatacattgctggtgggaatgtagaatggtacggctactttggaaaacaatctgacagtttcttaagaagttaaacataaatttatcatatatcccagcagttccactcctaggtatctacccagtgaaaacatacctctgcacaaagacttgcacataaatgttcatagcagctctattcattatagccaaaaagtggaacaacccaaatgaccatcaactagtggatgtataaacaaaatgtgagatatccatacaaggaatactattcgggaattaaaaaggaatgcaacatgaatgaacctcaaaaacattatgctcagcaaacgtgctcctaggttatttacacaattgacttgaaaatgtatgtccacatgaaaacgtatacacaaatgtttatagcagctttattcataattgtcaaaatctggaagcaagcaaaatgtccatcagtagatgaatggataactaagctgtgttacattcatacaatgcactattattcagcaatttttaaaatgagctattaagccctgaaagacatggaggaaacttaaatgtatattgttgagtgaaagaagccaatctgtatgattccaactatttgatattctggaaaaggcaaaactatagagacagtaaaagaaattaatggttgtcaagggcttggtggggagaggaagggaagagaggagggatgaatagctaaagcacaggggatttctagagcagcgaaactattctatatgattctgtaatggtagatacatggcatcatgtatttgtccaaagtcatagaactatataacactaagagtgaaccctcttataaactatggactttaatgaataattatgggtcaatattgaaacaaacatatcacgctaatacaaaatgttaataatagggaaagctgtgtgcagggaagaagatatatgggaattctgctctatctgctcaatttttctgtaaatctgaaactgttccccagaactatactaatttaaaaaaatgatgctaagtgaaagaagacagatagaaaaagaccacatcacatattatataattccatttatatgaaatgtctagaaagacaaatctacagagacagaaagaagatgaggggttgcctgggtctagggatgacagcagggattaactataaatgggcatgagggatcttattggaatggtgaaaatattctaatacgagattatgatgatgaattgcacaactcagtaaattcactaaaaatcattgaattgtatacttaatatgagtgaactttatggtatctaaattatacctaaatcaagctgttaaaaattcatttgatctcacattttaaaattattttacattagttccttataactatgaatcatgtaaaaaatgtataatgagatctcatgttcatggatcagaaaacttaatattgttaagatggcaatactcccgaattgacctaaagattcaacacaatctctatcaaaattccagctggcttgttgtagaaattgacaggctgatcctaaaattcatatggaaatgcaagagaccccaaaacaactaaaataatcttgaaaaagaacaaatttgaaggactcacactgtaatcaagaccatgtggtcctggcatatggatagacacgcagaccagtggaatagaattgggagtccagaaataaaccctcacatttatgatcaactgactttcaacaaaagtactaagacaattcataagggaagaacagtcttttccacaaatggtactaggatctacatgcaaaagaatgaatttcaatccctacctcaagccatacataaaaatgaattccaaatggatcataggccaaaatgtaagagctaaaactgtgaaagtcttacaagaaagcataggagtaagtcttcatgaccttgggtgaggcaaagctttctcagatatgtcacagaaagtacaaaaaaaaagaaaatatagataaattgaccatcaaaactaaaagcttttgggcttcaaagaaagtgagaaaaacatcaagaaagtgaaaatacaaccaatagaatgggaaaaagcatttgcaaattatatttctgatcagagatgtgtccagaatatataaataattcttacaactcaatgatgaaaagacaaataacctaattcaaatataggcagaagatttgaatagatgtttatccaaaaaaaaatataaatggccaataagcacttgaaaagatgctcaacatcattagtcattagaaaaatgcaaattaaaaccacaatgagatgccacttcactaagatggctagaatcaaaaggtcagataataacaaatgtacatgaaggcatggagaaattagaatcctcatacattgctggtgggactgtagaatggtgtagccactttggaaagcagtttggcagttcctcaaaagcaaaccatataactgcaaatgcacgccattatccattagaagcttctgaggaacaacaagaaagccagtgtgcctggagcaaagtgagtaatttggacagtggcacaagaggacagagaagttgccataggccacatcatacaaggccttatggaccatggggctttggattttattctaaatgcgacggaattttaagcaaggagtctttgttcttagtaagtttataatgtccactgtaatgaatgagaaaaagacaattagaagaagtgctgaacatccttgaaggcccacctgtgatgggaaccataagtgtttaatgtgtgtctgcagttatagttttgtgggtttttttccaaaagcacttggctgtcctagctttgaaagcagagaaaatggcagaaaggggtcagatgctaagaggaaactaaacatgctaaactcgtaagtactcaggcaggttcttacagagaaagatggaattttcagaagcccttaagaaagggaatgctgtatttctactttttgccatcttttactgctttgctgtaaacaattagatgcaattaacttagtgaaaaaaaaaaacaagaatcagaagatttaaatatgagcctcagctttcccggtgactgtgacactacaggtaaattgccaaagttgacaaccttaagaaagctaaagaagctctttctggctacttgttaagtcacaccaagaaattagctttataccattaaactaaactcattaacctttcttggcaacaattctgtctcgcaaatttcctgtcttactgttaataaatttctcctgatgcagtttagcccattctgcctggtactaatgatagactaaaagatagtttacatcagatctcatcccttctctgctcagaaccctccaatggcttctcatctcactgaaagtaaaatccaaactccttgcagtggcctacaagcccctgtgatgtcccatcagacagcttcttgtacccctgtccttcattacctgtgtttcagccatactggctgcctttcagcttctcagaccagggaagttttttcctgcctcagaccttttgcagtgctagtccctctgcacttttaaaaagtgatagaccagtgaacttttcattaagtatgtccaaaaagtcctgaagacttctccatctcagtatggatgagtttcttttcaccttttgggtctctatttaaatgctacctcctcagagaagctttcactggactgacctatctaagccctacacaccccactgctctatcacattcctgtgtgttatctttgcaacattgcttgtcacaatagggctgttttcttatttggttgtttgcttacctatttatcatctgttccacatacttcccccccaccccccccccacacacactgaaagatccttgagaatgaggtattatctgtcctgttcatcattattcccagagtgtagaacagagtactcaatacaaatttgcatgttgagggaggaaggaagggaaggggcttcttgttatccatgccctgctgttaagtaagcccagttttcctcaagattatttcttaaatgtagtatatattcacaatggaatattattcagccttgaaaaagaaggaagtcctaccatttgtgacaagatgaataaacctggagggcattaggctaaatgagctaaatcagtaccacgtgatttcacttatatgtgaaatctaaaaaggtcagactcaaaaacagagaaaagaatggcggttaccaggggtagagaagggggaaatggggagatgttggtcaggggatacagtttcaggtacacaagatgaatacgttctggaaagctaatgtacaacaatgtggctataataataactttattgtatacttgaaatctgccaagagagtagatcttaagtcttctcatcacaaaaagtggtaactatctgcagtgatggatatgttaattagcttgattgtggtggttatttcacagtgtatatgtatttcaaatcatcatattgtataccctgaatatatatcatttttaattatccaatatacctcaatttttttaaaaaaagattatttctcaagccctcaagttatttggattgacctctcctagcctcttctgtaagtggaataaaattctaatttttggactggtcctgagtatcaaagagaggcttatcatattacagactttcggaggccgaaacaatagaagtcatctgttctaacctctctgtccatatagaaacctttgccataagcacctatctcagaaatttcttagaggtgcctcaacagtaactataggaagtaaaggggtggctaaatacatagggttctggacctccaaatgcccactctctactcactttaccagcccctactttaaccagagcaaagctgattttgtttgttttatgtattgggattccacataaaattttatttgagaaaaacttctgctgcttaagaaaagtttgaaaactactaatctaacctgtgcctgaacatgcacagtgaccaggaatttactcttaatattccttcatgctgtttttatatctcttatatctctgtcttcaactttcaaagatgaccctactgacaacaatcaccatttatacatgtgcctgtcactataaagacaaatgtaccaccaagtggttatttctacatttaaagcctgtccaccggtttcaggcagcatccgtaagttaaagaaactatttcatagattcatcttgatgctagatggtctgtgcagcctatattgctatcctgcagtactcagaaccacttcaaatatgaccttacatcatatcttccaccctcctgatctgtttcacatcagtgaattaccttctgagtttcagtattaaatttcacgctggtgatagccacccactttgccaactgattcaagtcatttccattttaagtgtgtttaccaaacaatactaccacatctaactttatttttggacctatttaatgaaaagtttctcatctatcacttaaaagaaaatggttaatggtgtgactcttgacccaggatcagcctctacataaatccatgctttgtttctctttttgtttatgactggggacagttgaacaatgggtcacaggcccttaaagcttcctgattttggtactgaccagtacatttttaaaataatctgttccagtgtttctctagtttattacattttaatttgtaaatgtataatctggaggttatttttctcttttattcaagataaataatacaaatattcttcttcattctctaggcattttacaattcctataaaatctttaaaattaaaaaaaaacttggccaggcgcagtggctcatgtctgtaatcccagcattttgggaggctaaggcaggcagatcacctgaaatcaggagtttgagaccagcctggccaacatggcagaaccctggctctgctaaaaatacaaaaaaattagttaggtgtggtggtacacgcctgtggttccagctactcaggtggctgaggcagaagaatcacttgaacccaggaggcagaggttgcagtgagctgagatcatgccactgcactccagcctggatgacagagagagactcagtctcaaaaaaaaaaaaaaagtaattagaaaaagtttaaagcatagcatgtgctaagcactgtgctaggtaccaaaggtgaataatatacagtctttgctctccaagagtatgtagtctagtggagaagacaagtacaagaagtaatcattgcaaactagtttgagaagtactatggtagaggtttgaataaactgctggagcacaaaaagagggatcaactttctttgcctgggaaaggaagctggaacttcagagatgtcttcacagctgtatcttaaaggatgagtaggagttcatcagaggagatggaagtcattctacaagtccaaaactatgcatgtacaaaggcccagaggcttgaagaacattttatgtttagaaagtgagagaaaagtttggtgtggttaagctttgagtacttgagggcaatagtgagataagaggactgagaagtaggcagggacaaaattatgaagggccttgcatactacgcaaaagaaaggatctttcttcctgtgggcatggggacctactgagaggctttcaagcagggtagtgatattgtcagggttgtgctttaggaaggtctaattagcagtgtaaagtgtgcgacccaggaggggacagacagcaggaggagtacgggactgccagaggctctgcaacgctctgcaacgtttggccaactccttaagtgctctggggtagatttcctatttgtttctcaattgtaaaagaggaatagccttttcttcccctacttcacatagagctaatgagactacatgagatcataagtcctctgagcctcttagaagacagcttcgaggtttggactagatggttgaaggtggagacaagcacaggctgcacgatataattgaactcatactcgtgcacattttatgcatttttaaaaatgtgtattagtcttatagcttgattcaactcagttgtgaactcaagggcaggatccagaaatcttgtgttgaccacaacccctagcacaaagggagagcactgaatgagtcctcagcacctatcagaaggttaattgcatagagtgtcccctctcaggcagaccacctgagactgaagcatcacaggaaggccacagtattatttgggactagtggcaatgttatatttcaaggttcattatctaggagtggccaaaaatattccatgctttgtttgaccaggcctatgaggaccaggcaaggcccctttacttcctgcctttagcatgacactcctctgtaaatacaagaggtaaattcatagaatttccctttctataaagtataatcaccattttgctaagaagtcgcagcctacagatgaaagatattgagtagaatatgtgcatattattattatgaacaatctttcagaatttagctacttgtttacagaaaaagtctagaaagaatgcttaaaattttatatctgtctacttagtgttgtaattaatgtagctataacatgacaacaccctagatgtttgaaatccaagttttgaaccatttcagtaatatgtggtcaaacgttatagaggggccaaaaggatatttgaagagcatccatgtgtttttgttgtgtgtcaaaaattactctagattttcatcaaccaaagccagaaaatctgaaagctttccctgcattttaaagcaaacactcttctctctctcctgacttgacagagattgtgatcagtccactgaacacaatggcatttcctcctatccacacctaatataaactccagccaatttaatggggtctattacatagtttggggatgcaagcacataaagtctttggctcttgagacactcatcttgtgtgccaggaccaggtgcagaaatacaaatacatatgtattaagcccgagacagctgctttgccggtgcttttaactagaaaggttgagccggcacaatttccatcaattatacctaaagtgttctttttcttgtggaggaagagagtacatttaattcgtctacccagtactgatgtctaaaccattaaggtttttaagttcattaaatgagaggtgaaaatcaaaagtgatattttcaactaactagaattctcagaaaatggggtttctggttaattgaattttctggcttagtggacagttatactagacagactttttttgttctatccatgttctttaacctctttttaaaatgtacgtatacatttttgccttagtaagcacagtggactgaacctgattgaatcttgctatcactaaaagttacacagtgtttctgtactctgacttctattgaataagatcattggagatagaggatagtgactaaatctgggctgaacctgagatataccctgggaaactgcttttggaaacctgtttggttttggtttcttcttatttgcttctttccctaaaaacagagtacataaaagaaaaattcatagccaagtgaagattttgatttgctaacctacattttactgaataaaaacatattttagggcaggaaaattgtacctaagtaatctgaaaaaaagtgtgctaaagaagcttacagccagaaaaatgtgaccttgcatgtccaaaggaaacaagcagtgaatttagttcatcatgacctatctactcaatttattccctagctgaattaatcttacagcaattttcacggacccactcaccacttggatttttctgtagtgcaaatgttaggttttatgaactatctaagattcttggtggtgaacagaactgctttatacttttttccatccatgtaccttaaatggtataattattgaaagggaaagatggcctatgggtccaaaaactggccttccagcacttttcaccatcatggactcatagtcaacgttcttgatacattttcaggcaagtattaccttgtttctacttccacaaaccttcgtttgtcttcagtagtgactgtttatcgtgccaaatggtgtagagagagtgagaactgtgtagaatcatactactgttgtatttatttcctaggtaacatttttggtagttttgtcacacagttaatggatttgtttctattaacatgtagggccttcttgacctaatcatttttcacacgtgttcctatgtaaattctaaatccaaacgtgctaggtcaatagctaaattgagtttatagaagaaaggaccactgcaaaatcaattattccagtttgacgctggctcatttacttgcctttgggaggacttttaatacccatttaccccaaatgcaaataacccaaaagctgaaatgattaaagtttagtgggctattatagtagaaatctggacacaaaaattgctactaaaaggaactgtggttggtcatcttagtaaccaaaaacttttaattccaaacattcaggaaatggcaaaggagacagaggcaaactgaaaaagtggtaaaatggtaaatggggatagacaagtaaacaggtaagggaaaactgtgaaaattgactaatttcaacaacattacagtattaaaatggtgaaaggggagtagacacgaaggagaaatagaagaaattacaaggaaaaaaaaagcaataggtgcagatagaaagtccccatttccccctctcctctgccccggcaactaccattccactcttcgcttctatgagtttgactattttagattcctcatgtaagtagtatcatgcatttgtccttcttgtctggcttatttcacttagcctaatatcctccaggttcgtccctgttgtcacatgatttccttctttttaaaggcggaataataatccactttatgtgtatatcatattttctttattcactcgtccatcagtgaacacttagttatctactgtacagcatagcacctatagttaacaatactgcattgtatacttaaaaatttgctaagagaggccgggcggggtgactaacgcctgtaatcccagcactttgggaggccgaggctggcggatcacttgagatcaggagttcaagaccaatttggccaacatggtgaaaccccatctctactaaaaatacaaaaattagccagatgtgatggtgctcacctataaccccagctactcaggaggctgaggcaggagaatcatttgaacctgggaggtggagaggtggaggttgcggtgagctgagattgtaccactgcactctagcctgggcaacaggcaagattctgtctcaaaaaaaaaaaaaattgataagagggtagatcttatgttaactgttcttattacaataaataaataaataaacagggcaggaaaaacttttggaggtaagggatagttttgtggcatagattgtggtgatggtttcatgggtgtatacttaactccaaattcatcaggttgtaaacattaagtatgtacagcttttggtatgtcaatcatacgtttctttgttttctattgctttaactgaatacctgagactgagtaatttatgaagaaaataaatttatttctcacattttggaggctgagaagttcaaagttgaggagccacatttggtgaaggccttttttctcgtgaggactctgcagagtcccaaggagtgcagggcatcacatggcaaggggcttagaagagatggccacattggcctttataacagacctactcttgtggtaactaacccactgcctcaataacccattaatccataaagagattattcttgagggtagatccctcatgactcaatcagctccaaaaaggcttcacctcttcatactgttatattggtgtttaagtttcaacacgagttttggaggggacaaacatttaagccatagcataccttaataaagtggttttaaaaattcaaattcaagttcagacactttctacctatgtttccttggacaagttacttaatttccctgtgctttagttttctcatttgttcaatgggcataatagtagtacctacttcacagggtttttgtgaaaatttattgagttaacaatattgaaagcacctagtacagttcctggcacagggtaatcacttaatagatgtcagctattatttttattatatgccaacaacagaggaaagccaaaccttactaccaatgaaagtaaaaaattgtaagaggtatgctaatatgtaaagagaaaatagatgtctgagcaagtcttaggtccaaataagaaaacattattggaaatctataatgctaacttctgataccagtactggcataaaagattgttgcaaaatctttgccagtaacaaactgttgaacagagcaggtatctggttgtgcctgggtaaggtagccacctgcttgctgttttacataaatttcttgatgtcgtgatcaaagcccctgacctttaatggacctaaaatggcaaatgcacacaagtaaatacagttgactgagccctgcactttttcttaaagattgattttgtggtttataattcaccagggtatttaagaagcaagatatatctggaaaaacaaaaacaaaacaactgccaaaccacaacgctgcagacacatttcagaaatgtgctttcagaaatacgtttgcagaacctggtctcttccatgaacatgtttgtgttgatgatgtgaaagacaaaatgtaccagacaattaaggaaatgattttattcaggtattgcaatagggggaatatttattaatgaggaccagctcaaagaaaatgaaggaagcctggcattttatagagacaggtaaacaagggagtcatctgtaagtcttttgggagttgtgaggaaggatggagatgggtcttcccttggaataatgtgtcagtgtaggatggtcacttgtggttaaccttttcctggaaaacaaaaggttgggggggattttttaaccattactgctttctagggtacacagggctcagataaacttaaatactgtcatttctctcttttgtttaaaacaaatatcatttataattgagccactcagaggagaacataaagctcctaagtgaggtgaagctgaagtctaagaaatagtctctcaaggactcttgttggtattgtttctgtaaagccacttgaaccatctgttgagagacaatggcaaaggtcagttgttttagggtcctggaaattaggcatattaaaagagggatggcaataatgaaaaaagaaatgttggccaggtgtggtggctcatgcctataatctcagcactttgggaggccgaggtgggtggattgcttgagctcgggagttcgaggccagcctgggcaacatggcaaaaccccgtctctacaaaaaatacaaaaaattatctgggtgtggtggcatgcacctgtagtcccagctacttgggaggctgaggtgggaggatcacttgagcctggtggaggttgcggtcaactgagatcatgctgctgcattccaccctgggtgacagagtgagaccctatctcaaaaaaaaagttaatataaaagattatattatagtaaagagccaagaattgaaccctgaaagtaaccagtccagtggattccaacgcatcagtggaagagaacttttccattttgcagcaccactcatggagctagggtatgggtactcttggcaatgttgtttgtccacagtcttggttaccgctatggtttatatgtggtttccccctgccaaaactcatgttgaatttaatccccaatgttaagaggtggagcctaatgggaggtatttgggtcatggaggcagatatctcatgaataaattaatgccctcctgcagaagtgagtgagtttttattctctcatgggaatggatttgttcccacatgactgagttgttttaaagaagtctagtatcctcagtttctctctcttgctttctctctcaccatgtgatctctttgcacacacctgctctccttctgctttctgccatgaatggaagcagtatgagggaggcccttaccagatgcagctgcccaattttgaactttccagccaccagaattataagccaaacaaacctcttttctttataagttatccagcctcaggtattctgttatagcaacactaaatggactaagacagtcatctttcatgtaaaaggtatgcatgacttgagcatttcttacaacttctatcatagtctaggcagcagcttgttcaaggagaattctagtcatgcatggtcggctgcagttctgtgttcgtctaggtttatattgagccactggagtttagcttgcagggctgcctcagatcctggaaaagagggcaagctccaagacaacttagagtcccaatagggatttgggcagtcgggttttagttctcagtgactctgagtcaggtgggagggagaaaacttggaaaagttagtttggaggatattagcaagatattgaagtaacctagaagaactgaaaatttggtaaagattgacaatttggacaagttaacaagatccagtttgatttacaagtaggtgccaaaactggtttttccacagaagaaaaggaagtcaattatctaatttttttttttttaaacagagtctcttcacccaggctagagtgcagtggcacaatcatagcccactgcagcctcagactcccaggctgaagcaatcctcctgcctcagcctcctgagtagctaggactaaaggtgcatgcccagctaatttttaaaactttttgtgaagatgaggacttgaattcccagcctcaagcaatcctcccaccccagcctcccaaagtgctggaattacagcatgagccactgcgcctagccctaaggaagtcaattatatctccaccagacaagataaagtttgcctatccatcagtaacctgtagcttataagtaggtaccaaatagctcaaagacagtgaataggactagactctgataacctagagtggtgtgccatagatgaggcagagttttctgctgaaacacaaaatttctctctatagtcacttccttttgactaaagataatctcaagaaagattattcttgaacgcaaaataaggctggtctcaaaaaacaaaagaaaaatagttaaactggagttcatcaaaatgtaaagctttggggcttcaaaggatatttatcaacaaagtgaaacaacaacctgcagaatcggagaaaatatgtgcaaatcatatatccaataagtgtgtgacatccataatataaaaagaactcttataactcaacagcaaaaaaaaaattaaaaaatttttaaatttttaaaaattttaaaagattaaaaatttaaaaatgggcaaaggacttgaatagacatatctccaaagaaggtctacaaatggacaacaagctcataaaacaatgcttgacatcattagtcatcaggaaaatgcaaaccagatccacaagtagataccacttcacacatactaggatggctagaatttaaaaacaaaaataactggaaaataacaagtgctggtgaggacgtggagaaattgaagcccttatacactgctggcgagaaagtaaaatggtgcaactaccgtgaaaaacagtttggtcgttcctcaaaagttaaacatagaattactatatgacctaaaaattccacttctaagtataaatattcaaaagaattgcaaacaagtactcaaacgaatacttatgcacaaatgtttatagcagcactattcacaatagccatacaatgaaaacaacacaaatgttacccattcgtcaacagatgaatggataaacacaatgtggggtgtgtgggtgtgtgtgtgtgtgtgatggaatattattcagctctaaaaaaagaacagagtactggcacatgctacaacatggatgaacctcaaacacattatattaagtgaaagaagccagacataaaagatcacatattgtgtgattacacatataaaatatccaaaataggtaaatccatagagacccaacacagattactggttgtcagaggctggaaggcggatgagagtgtaagaagtgaatgtttaataagcatgggttttcttttgaggtaatggaaatgttttagaactaggttgaggtgaaggttacacagtattgtaaaggtactaaatgccactaaattgtacactttaaaataattaattttatgttatgtaagttttgcctcaataagaatattaaaaagtaaaaattaagtctcattagatttagcttgattatttacataggcacagtaagaatggtaatttaccaaatagaccttaagcttgctttgctcaaagttttcataaggaatctgaatttgaaattttaaaagcctatcaagctaagaagattttacttgctgcatctataaatgtgggagaactgttctctttttgaggtcgacaaaatatcctaagcttctaagacttgccaggaagtaaccttccttactcagttgtaaggctgagaaccctgtaagtcaggtaccaggctagttttcccaagagggctttgtatgcattggctccataaagtcagccttagttccttaaaagtgtctgatcatatctgattcagtgagcatcattcacaaatatggcattccaggtaaggccttggttacataccaatgtttctaatcatgatctggtaagaagggcagacagatttttattgaaccaatgcagatatttatattgctatgaaaataagaatactcaatgagagtttccaaatcctggagaactcaggggtataagatatcatttacaaacatttcatttcagtttacaaaagcatggtctactagatagttatgaattatagatagtgtaagagaaaagagaaataggaagtgagtttcttatatatccagaaaacagaatattaaagctttagcaatattccaaacaaaacccaaatcatcccttctatcattcaggtctatgtaattagttctttttccactccaccttgggttagcactatcttattaacacacttgcttctcaactagagttctcaaaatcctgcctcagttcactagtgtggtctcaaagttgtttaaaccatctcatcataagcctgtacacaaaagtacctggcatagttcttttccacgggactctgaaaaagtgctttgttgaagatgaagccctctagcttgtagctgatgcaagtgctttcagggaagcattggtgtaaaacataaaaagctgtctacctgtagctgataaaagacttacaacagctatggttaacttattgctgatcattttcaaaagggaaaaatacaataagagttcattacaagaataataaagcaactgacaaagaggtgtagtttctgtggtatggaaaatgagataaaagtcaatccaaaaattttttttgacaaaatatcttttatttatttattttttttgagacagagtctcactctgtcacccaggctggagtgcagtggcgtgatctcagctcactgcaacctccccctcctgggttcaagcgattctcctgcctcagcctcctgagtagctgggactacaggtgcatgccaccacgcctggctaatttttttttcgtatttttagtagagacggggtttcactgtgttagccaggatggtctcaatttcctaaccttgtgatccgcccgcctcagcctcccaaaatgctcggattacaggcatgagccaccacgcccggccaaaatatctattttcttaaaaatttttagtttaggttcggggatacttgtaaaggtctgttacttggtaaacttgtgtcacaggggtttgtcatacagattatttcatcacccgggtattaagcccagtacccaacagttatcttttctgctcctctccttcctctcaccctccaccctcaatagatcccagtgtctgttgtttccttttttgtgttcatgagttctcatcatttagttcccacttttgagtgagaacatgcagcattgatgagcattccaagtctttgttgttgtgaatagtgccgcagtgaacattcacgtgcatgtgtctttatagtagaatgatttatattcctcttggtatatacacagtagtgggattgctgagtcaaatggtagttctacttttaactctttgagaaatcaccatactgctttcctcaatggttgaactggtttactctcccatcaacagggtataagtgttttcttttctctgcaacctcgccagcatgtattatttttttgaatttttaatagtagccactctgactggtgtgacatggtatctcattgtggctttgatttgcattactctaatgatcattgatattgagctttttttcctatgcttgttggccgcatgtatgtcgtcttttgaaaagtatctgttcatatcccttgcctactttttaattgggtttttgtttttctcttgtaaacttgttaagttccttaaagatgctggatattagacctttgtcagatgcatagtttgcaaatattttctcctattctgtaggttgtctgtttactctgttgatagtttattttgctgtgcagaagctctgaagtttaattagatcccatttgtcaacttttgcttttgttgaaattgcatttgttgtctttgtcatgaaatctttgcccgttcctatgttcagaatggtattacctaggttgtcttccagggtttttatagttttgggttttacatttaagtctttgatccatcttgagttgatttttgtatatcctataagaaaggggtccagcttcaatcttctgaatatggctagctagttatcccagtaccatttactaaatagggagtctttcccccattgcttgctcttgtcagctttgttgaagatcagatggtgataggtgtgcagccttatttctgggctctctattctgttccattggtctatgtatctgtttttgtaccagtaccatgctgttttggttactgtcagcctgtagtgtagttcaaagttgggtaacatgatgcttcaagctttgttctttttgcttaggattgtcttggccatttgggctcttttttggttccatatgaattttaaaatagttttttctagttctgtgaagaatgtcacatgtattttgataggtatagcattgaatctgtaagttgccttgagcagtatggccattttaattatattgattcctcctatccatgagcatgggatgtttttccatttgtttgtgtcttctctgatttatttgagcagtgttttgtaattctctttatagagatctttcacctccctggtaagctgtattcctaggtattttattctttttgtgtcaattgtgaatggaagttctttcatgatttggttctcgggttgactattgttggtatgtaggaatgctagtgatttttgtacattgattttgtatcctgaaactttgctgaagctgtttatcagctgaaggagattttgggctgagattatgaggttttctagatatagaaccatgtcatctgcagacatagtttgacttcctctcttcctatttggatgcccattatttctttctcttacctgattgctctgaccgggacttccaatactatgttgaataggagttgtgagagagagcatctttgtcttgtgccagttttcaaggggaatgcttccagcttttgcccattcagtatgatgttggctatgggtttgttatagatggctgttattattttgagatatgttccttcaatacctattgagagtttttaacatgaaggggtgttgaattttattgaaagccttttctgcgtctattgagatgatcatgtagtttttgtctttagttctgtttatgtgatgaatcacatttattgattcgcatatattgagccaaccttgcatcgtagagatgaagcctacttgatcatggtggattagcattttgttgtgttgctggattcggtttgcaattattttgttgaggatttttgcattagtattcatcaaggatattggcttgatgttttcttttttgttgtatctctgccaggtttttgtatcaggatgatgctgctctcatagaatgagtcgaggaagagtccctcctcctaaattttttggaatagtttcagtaggaatactaccagctttctttatacatctggtagaatttggctgtgaatctatcaagtgccaggctttttttagttggtaaagctatttattactgattcaattctggagctcattattggtctgtttagggtatcagtttctccctggttcagtcttaggagggtgtatatgtccaggaatttatccatctcttctgggttttctagtttgtgtgcatagagtgttcatcatagattctgctggttatttttgcttctgtggggccagtggtaacattcccttcatcatttctaattgtgtttatttggatcttctttcttttcttctttattagtctagctagcggcctatcttattaattttttcaaaaatctaacttttgcattcatcaatcttttgaaaggtttttcatgtctcaatttccttcagttcagctctgattttgcttgtcttatgctagctttggggttgatttgttcttgcttctctaattcagttgcaatgttaagttattaatttgagatctttctacctttttgatgtgggcatttagtgctaggagtttccctcttaacactgccttagctgcttcccagagattctggtgtattgtatctattttcttattagtttcaaataacttcttgatttttgccttaattttattatttactcaaaagttattcaggagcatgttgtttagtttccatgtaattattttgttgcatggctttgagtgattttctcagtcttgacttctatttttactgtgctgtgtcccaagagtgtatttggtggtatgatttcagttattttgcgcttgctagggattgctttatgtccaattatgtggttgattttagagtaagtgctatgtggcaatgagaagagtgtatattttgttgtttttgggtggagagttctgtagaggtctatcagatccagacaaaaatgtctatatacataatgattagcccttgtcttagtacatctgtgttcttttaaaggaatacctgagtctgggtaatttataaagaaaagaggtatttggcttacagctcttcagtctgtacaagaagcatggtgccagtatctgcttctggtgagggcttcaggctgcctccacttatgacagaaggtaaagggaagccacatgtgcaaatcacatggtgagagaggaagcaagagagagggagaaggtgtcaggctctttttaacaaccagctcccaggggaactctagcagtaactaatagagtgagaactcactcattactgtgagatcacaaccaagccatttgtaagggatacacccccatgacccaacacttcccactaggccccacctccaacactggggatcaaatttcaacatgaggcttggaaggccaaatatccaaactgtagaaatcctattttcaaagaagagagggtattatatgtaatttataaaaatgcatgaacatcatctttatagagaaaaaagactcagatataacatataataatcctgacataatatatcatcaatataccaagcatataggttgaatatacccagaatatatcaagaacatcaagtaaagagattcagtaatctggaatagttcttaaacatgtgtatattaacagaatttcataggtaaatgatgtgaatccccagttgaaaactaatgactggaaaaatgctagattcaaaacaaagaagcaatgtggagaccaagttaacattttaaaaagctgaaattattactgaaaacactatactatagttatctaatatctagcaaagcagcatcaggattctgacatatctcggccagtgagagcactaatgaatctgtagaaacgttccatacagcatacaatttctaaaatgtttatgctaataacattttcctataccaatttaacctagaaaaagcaaagcatctgttctgatttgacaactcttcccatgcaactcctcaatagtaatatattgaataaatctaattctttctagcacttctctttcaataaggtgaaagaacaaatcttttttttttttttttttgccattttaacagtgaggaaaccaaattctagctttgcatcagaatatttgatactaaagttctttttggaaatattgtaaatcaactcatcaaaccttagccagccacctcaacaaataaaattccctttctgtgatccctctacaactttctatatctatatgcatcctttataacaacttctttaattggcaaaaaatagcatgttcattaccaggcccaagtatacataacttttctgcagcatgtagaaataagaagcaaaagcatacaaaattatatgtagtaattaatatttcagcattctcttacttagaaatggtctaggtatgtaatgaatattcattaattcaatttagtatcagctcaaagtttttagttacctaaagattttataaattatcttcaagttgatatactgcaaaacataattactgttgaaataaagtttgtcagaataacgactcaacttggttaaacaaatttacattttttataatcgtaaacacttaggagaagtaatgttagctcattcaatcagtaaacctgtctatgttgaggaagaatatactcaagtagaaaaaaaatctacctgtatattatgcccaacactgataaatcagaaaagacatggctggttttagtaagccaaaaattactaagttagtctcatttgcccaagatttacctaaattatatgaacttgaattcttaaagtatttgagtttgtttttataggaatactttttttagcatattgaaaatcttgaacgttcaattgccttattttctggggattttaggaatattctatttatctaaacacttattatttctataagccaatgagaacagagctcctttaagagattttatcatctaatttagtaatactatccagaggtagaaaaatgttacaaattcatacaatgagacataaaggcctttctgaatgatagacatcatcttcgtcatcattattattattcaggctattgccatgaggagaatgttcattagtgtaaggaacatcttaaagaaaaggaagggggccacctgcttaatggaggcaggtaaataaaggagtcatctaccagtcttatgggcatgctgaggaaggagagagatgagtctttccttagaatatgccagggcaatgtggtcctttgcagttcgccatttctcgtaacgcaaaagggtggagggtttcttaaccatcactgcttttgcaaaagcacagggctcaggtaaatctcaatgttgtcaatgagaagagtctactttgtcaattttgtctatagcttttctctgtattctcctttatctgccatattatttctggttgccttttttgtttggatgattggtttttttttttttttctgtgtttatgccttatctccccaatttaattgtaagttctgtgaggaaaggaagtatgtcttgtattgatttgtactcttcctccacatctctctcctctttttgcctagcacttagtgttccgtcccatctacctaaaagttattgatgttcagaaggtcagcaaattatctctttttttaatgtgctaaggcagtaaacttacaaaatgtaagcttttcataattggaaaatagcatttgcatctaagaacttccaaaatcacacatttaattcttatttaaagagaattcatagatggagaaatctttttctttaattggtctctacctggttgcatatctaaggccaagctattctttggctagatgattgccgagttcaccatcatgaagcaaagtcagtgtctaaagatatttttaccaaccttctgcttgccagtgtacatgtcttattgattcagcctgtgaaccagggcattatttagaatatgaaatgttattatggaagagatttcatgaagaagtttatgcattgtgaaggcactacaaagagctttacagtctcatagtagcaaagatgccattttaactgttgcttatgcctaggcaatctcaaggagaactcagaaaaaaatgggctggatatttgaagtctctgtggaagtgaaataaattaagcatttaggatgaggccttaaaaataacttaaatacactcttgatgataaagaatgttatttgacatctaatcagcaaggcttaatggaagtgtagtaaaagagcgggttaaccttgacaaggggttaaagtgacgcattatcactgatagcacaaaagttaaaggacaccagtgaagtcaatgaagagaattttagtgaagaaaacaaaataactttataaaagactgcttcactcttcgttgtaataattgcatttacagacaggcgaccacattatactgcccaggagattatgcatttgtatattctacactcagcttttatgagcaacaagtgcaaaactaactttttaaaaattctagtttgtgtcatagggtcagtacagagaatccaatctctaacatcttctacatctggctgagcaagattgtctttaaggcctcttctagattctagctttcttaaagtcctgtaagtgattaccagtgttcctcatgatgaccccagggtatacaaattttttgaagtgattcctaaatccagggaaaggtggttctctcttgttcaatatagttataatattctaatgctttgaaaatctgggatcatgaatggaaaatattaccaatttacccaaatatttactttactgaaacacttcattccctgatcattctgggtcatttacttataatctttgtagatggatttctgtttttcttaaaagaagggggaactttaggggactagatctcaagggttagatccttggctgtaaagactcccttggattgctttttggctgttggctgtagcaacttgttttcttacagagatgaagcatctggtttttgttatctcaatgatgctgtcctgggaatattacgattgcgacggaaatttgagcgtattctctacgtggatttggatctgcaccatggagatggtaagccctttggttttaaagatgctttgctgcgaggacagcaggtttttatcagttaagctgcttctaggcaactggtagaaatgtctgctgtaattgaaattttcctaattgagaatttaaagtaggtagtgtagtgattcctctaattgatgcaattcctgctttgctgcccaagccaggctcctgtaatttcctcttctctctcctcctgtagcaagcctctagaactaatagagaatgttaagaagtgaaaatcttacctagtgtttactccagtgctcagtaacctccctcaggtcatttccattcattctaagggaatctatagggatgacagtcttgtctcttttcattgatgcttttctcaagatagaatgggcgtatgatgggctaacattctgaatttttcaccaataggttgccaactcgtgtagtgatcagaatctgtgccattttctttgtattgctaaaatatttagtgccgtacaaacaggacatcttccctaacatttaatagcagaatcacttagcagtttgccttaacccattaatcctctcttagaagactccactgacaggatttatccgaccctcctatgtattttccatctagaatgtagagctccagtgacagttgccacattctgtttctttaagcaatcctctctgggacacgtagtatttccatttatttaagaacacttatcctgtaaattcttagttaaaaatactcctccctcacatcaatgattgccatttccctgtttccagggattttttttttttcagacaaactaacataatcaaggcatagagaggaaaagaatattatatgtctgaagctagggtcagctccactgccaaaacagagaaagaaggatgaaattgttgagggaacctttccagagagcttcatctgcatggatgctaccatggaacgatgacagaaaattaaaggtaacagagagaagagaggttaaaaccaccaatatactactttgagaaccattttcactgaatatctgaatgctcaaccagtgcaaaacatagccttgctcaaaagccttcagagactccttattgcctataacaaggggtagcatttgacctatggcttgtttttgtatggccagtaagctaagaatggttaagaatggtttttccagccaagtgcagtcgctcatgcctgtgatcccaatattttggaaggatgaagtgggaggactgtttgaaaccatgagtttgagaccagcctgggcaacaaagtgaaacccccatctcgaaaaaaattagctgagtttggtgttgtgtgcttatattcctagctacttaggaagctgaggcaggaggatcgcttgaacccaagaggtcaaggctgtagtgaattatgatcgtgccactgcactccagcttgggcgacagaccaagccattgtctcttaaaaaaataaaataagaatggtttttccatttttaaagggttataaaagagaaaatatattttttaaaaatgtgtctgtgtgtgtgtatatatgtgtgtgcgtgtgcaatagagaccttgagtggtttgcaaagccgaaaatgtttactatttagccacttagttcattgacccctggcctacagcagtggttctcaaacttgaaagtgcatcaggatgacctggagaagtttgttttaaaatgcagattgctgggccatatccaccagatattcagatttagtaggtctggcatggaaccaaagaaactacgttttaatacctcagctgttctacaggccacactttgaaaaacagtggtcttcaaggtagtccacactctttacctagtctttcaaggcctaccttgaataggtctcacctcatctttccacccttatctctcattacttgctgtccaggctacactactcaatgagcatgtctaactattcatgacatgtctcactattcatgacatggctcagtattcccagacatgtctcattattcccacctccctgactttgcctccttttttcctaatttagttttgtttcacctgtcccaaggtctacccatttgttcaagttccaacagtaacagatttgccctgaccactccagctcaagtgttctctccctcctctcaagtcccgtattattcatatcaccaatttgatatttcattacatattgccttgtatttctaattaattttttaatgtgtctgtgtcttctcttcccatagaaactataagttccttcagagcagagatcaagttgtttacttcttcctgttttatataatgccttgaaccaacagtactatgcatatagtagtggctcattaaaatatttgatcaatgaatgattatgaaattcaaactattagtatcggagtttaagaatacaatcaactctacagaaccacataagaatgaactgaaactgtcacctgaaagtgttctttccatttgcaatgttatttctacacccttcagagtttcctgttttagccaacttttatggtgtgtttcatttcagtttatttcccctcttcagcacctcccttacagtgacccctgccccaccccccaacacttatgcatttggtttattttaaatctcccatgattacataactagcatcctgtggtggcttcactagccacccctaccccatccttgccttctttcatctacctaactactctcctctttcccaccaagtccatagcttcctcctatctgtgtacatctcctttttaaatatgattttataactgtgcctagtggtatttcccatgagaagaaatacaaatggccactaaacttatgaaaaggtgctcaacactctaatactcaaagaaaggcaaattagagcaaaaccattctttctgcctaagattaaagagaataacaatagtttgggaactctcatacatgattggtccaagtgtaaattggtacaacatttctggattgatcaataatcaggattttcatgaattatccttgtttaagacttcatttctaagttgaaatactattttcatttattttgtttgttttattttttttacttcatgctttttgcttagagcctttaactggatttaactgcctccctagggccaaacataaggcttgggaaattcaaacatacctgttatatataaatagagttaatatttttttaaagtcgctgttggggctgtagtgaagactgaaaacattaaataaatacagagacaatttctttgtttgaagtaagaaagaggacagtacctgaatttgctaatagtcctcccattttacagattgattatctgaacatagtgtgactatatgtgattctgagaggaaaggggtggaggtgggcagtgtgtttacctgtatacgtagaggcttgtgagggttactttaaatcccagcttttatctcccaggcctctaatcgtttactcactaagttaaaatggaaaacagacccctttctcgcccatctttcttcagattttaaaacactcttataaggctgctattaggagacaaggtcacggctgttttcagccttccatgttttagccagaaagatgtactataagttacttatttataaccaaatctgcattatagaaaggcactttataattaggtttttggtatataatggctaatgtttctattggtcatatttttcaaagggttatcacgttgtacgtctttggaaaaaatcccaagactttaactataaccacttaaacaagacaaaacatacaacttgtaagatggttccagtttcccttattcaattctgttgataatgcctcaattctaggctctcgcctttccctactttttagaacaggttgtcaaagagagcccagacatcccattgcttggaaaggggaagtccagttatagttttccatgagtttgaaaaggaacccccaaacttcacttggggccaaagttctacctcatcttgtaattacgagattagagaccagaggttcgtattacttttattcctcagcttgttagttttatattgctgccttctcatctaccctccttctcacagctgctttctagattttcagatgttgaaaataggaatgccatatgtgaagtgattcttttgatgtttctttatctgttaggtgtagaagacgcattcagtttcacctccaaagtcatgaccgtgtccctgcacaaattctccccaggatttttcccaggcaagtgatcataaactcagtattacatttgatgactaaatactgaaattcttctacacatttcttatacttggacagttccatgctgttaatgccttactgccacaatcctatgcaaaatttttttttttgcattttcattcagataggagataattttgtaaatttcttttttattatactttaagttttagggtacatgtgcacaatgtgcaggttagttacatatgtatacacgtgccatgctggtgtgctgcacccattaactcgtcatttagcattaggtatatctcctaaagctatccctcccccctccccccaccccgcaacagtccccagagtgtgatgttccccttcctgtgtccatgtgttctcatttttcaattcccacctatgagtgagaatatgcggtgtttggttttctgttctcgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgctgcaataaacatacgtatgcatgtgtctttatagcagcgtgatttatagtcctttgggtatatacccagtaatgggatggctgggtcaaatggtatttctagttctagatccctgaggaatcgccacactgacttccacaagggttgatctagtttacagtcccaccaacagtgtaaaagtgttcctatttgtccacatcctctccagcacctgttgtttcctgactttttaatgatcgccattctaactggtgtgagatggtgtctcattgtgattttgatttgcatttctctgatggccagtgatggtgagcgttttttcatgtgttttttggctgcataaatgtcttcttttgagaagagtctgttcatgtccttcgcccactttttgatggggttgtttgtttttttcttgtaaatttgtttgagttcattgtagattctggatattagccctttgtcagatgagtaggttgcaaaaattttttcccattctataggttgcctgttcactctgatggtagtttcttttgctgtacagaagctctttagtttaattagatcccatttgtcaattttggcttttgttgccattgcttttggtgttttagacatgaagtccttgcccatgcctatgtcctgaatggtgatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgattgtttttctcagtcctgtgcaaaattttaacacaggtcacctcaggtgacaataacaagaagaatgacattaaagctgtttctttttccaggtgatttttatggactgttaacagatcacttatgcttactatactagtagacaccccatgcaactcctaacatcctgaataattgcagtgataaattgatgttatgtcaacctaaaaagcatgaagccaagcaaaggagttaatctcttattttttcatttgatccagtaaggtgaaaactgaggtttttcagtttccttatgatttgcctgcttctccaagattgtttacaatacttacttctttatataatttttcttaatttctttccctagaaatttccctatcaggaaatcctttaagttttctgggttctcatgttcctaataactgatcatagtgctcttctcttttataggaacaggtgacgtgtctgatgttggcctagggaagggacggtactacagtgtaaatgtgcccattcaggatggcatacaagatgaaaaatattaccagatctgtgaaaggtatggcagtaacactagccagtaataagtggattgcagttctgtaggatgaaatggcccccatctcacaatgtaaacaagaacaatgtaaaaaagaaaacatctatatacctataaagcttttgtatactggtcattatgcttatttgatcagtagctatccgctgtatggcagagccaagcagttggaccagagccatgctccaggttggatcttactcaatatgattaagcccatcccaagagcagagctttttttgctatcctgaagaatcccttatttgctactttcttagctaaataaacctacatgtgtcttatttcattaacctggcagggttcatttcagttgtcagggttcattatggagacctgtgctttcttctactggtgtaaatattagagaattgactattattattcatcatgcattcttaccttctatccactgtgttaaaattggagtcagatacctgttctttctacaccatggctaaggattaagttacagacaatcgtagacagacagattggtgccaatgtgtggaccactagagttgaaaagccttatggaatgggggtggggggttgtgttaaactcatattcataaaaattgagattggtcaggcacaagtggtggcagagaaagcaaatccgaatagaagtcagccagtcaacattactgaaggtaagtaacggggattgaggtactcttgatccctccccaacttagctcgtatttctcccaacctctggtggaggttcttcccaaagaagcctgcctgcactggccatcatcactggcagttgtataaacaaagcagaactattaaaaaataaaaactttatgcttcaaaagtgcttcttagctcaagagatttggtgagccaagtcatcattcagttattcagcagcataagcctcttcataattttgatcatgtctcctggctacctctgtattatcatgctgaaaaaactttttttttttttttttggagcctgccatcaatggtttaattgcccttctttgttccccttaagctctcttctgtccttgagatgtgcagatcagagctgcttatgtaactttaccaataaagatatcctgcagttctatgtaaaaggagaattattttgtttttcttttaatccctttcttaacagtgcctgattttgttacccttttttttttttttttaccataacagaaaactaggttgttctcttcagtgcactgtccacagtgtctcctcgagccctttcctgggtcttaattgaaaggtcagcactcatcatccagcaagtatagtttgtaatatctagtgctccctagatggatcaccctaaatggatcaccttacatgtaccccttacaaagccctaaatggatcactttacatgtgcccctattgaaggttatctgccaatcataaaacctcctgagatcttctttatctcccatcaacttggcatttcactgcctgggaaagctgagtattatctgtagacttgaggattttccagtgcccacccccaaggaagtctatttatccttcttcagtcagaaaaaatatctgtttctaccctatattttctcttttttttctgtagaccagttcctactacatgataaaaaatattttaaatcccatggtaattcatgtttaaaaatagccttggtatcaaacctaatcagaagcatttttaaagtaagtttagccccaaggaaaagatctgtagaagattacacatgatttcgctttacaaaaagcatgatgccacccacatcccaatagattgatggcttttgtgtacaggaggctagcatttattaaaaattcttccagcttgcctactgaagaaccagacactcatcagtttatagttcccagggcccctttgcctgtggacccacattggcaatgcaagccacacagtgatcatccagaataacaggttccaggttttcattagaggtataataattttttttctttgctttccttcagaagtcaagtctggtcagggcattatgtgaaggcacctctgattccaagggtaccaaggaggcttcctggcccaaacatctctcctatctgttggattaatacctgaaattcctttaacaggaaacatacttttattctacaattagaaatagtccttaaaacgaaattttggcacaacctctcatcctcacccctgctgtactatagaagtatagtttcacagaacctttcttttttggggttgtggacagggtcttcccctgttgcccaggctggagtgcaatggcatgatcacagctcactgcagccttgacctcctggatccaagtgatccccttgcttcagcttcccaagtagctggggcaaacaggcacacgataccacatctggctaatttaaaaaaaagaaacttttagtagagatgaggtgtagcttcacagtgccattcttgagaatgaattgtgaaagggtcagagcatgagctccttgagtattctgaggagcaggaattgcctagtggagcagtagagggaaaggggtaccaaaaaccacagcgatctttgccaagagttttgcagagggccagccctggtaactagatcactcagtcccaggcattatgcctttgaatacttctggtatgtggcttggaaacagtctcttacacatttgccattgttacctctgacccttctgcctacctcaaaagatatattacacagaggaatggcttaatctttttgtaaaaagtcatttagtttatctactatcttcttttcatccttttattttattttatttatttatttttatttttttggagatggtgtctcactctgtcggcgatctaggctcactgcaagctctgccttccgggttcacgccattctcctgcctcagcctccccagtagctgggactacaggcgcctgccaccacacccgactaatttttttgtatttttagtagagacggggtttcaccgtgttagccactatggtctcgatctcctgacctcgtgatccacccacctcggcctcccaaagtgctgggattacaggcatgagccaccacgcctagccccttttcatcctttttatttcatgaccccactggttctctggctcactccttacttgtgatgtgtaaaggacctcttattgctggttcacttataagatgctctcatttttatttgccacccaatttctagtttgctcataaattgctcctttttccttttccttctttctttcttctttcttttacttttcttccttccttccttttcttgtcttgtcttttccttttctccttttccttccttttcttcctttgttcttcccttcctccctttctttcctcctcttttcctttctaaaatggttttttcctctgctgtagccttttttactttgccagctagtcaggcaggaacttaatggttttagtttaagcttgaacatacccccttcagttaaaaattggcttagagtttttttgtaatagactagatatggaatctttacatgaacatttcctaacaccaaaagatctcaagctccattttatataaatgacagatttcacagtgagatctccctagatcattcaattctaagggcaagggccactaattcccaaaagcttcccataattttcatgagagctgctagagttggtatcacaagtagagccctgttttaaccagcataaaggaacatcatcaacattgctctggtaagcatacctcctccttcaaatggaagcctatagtcctagtatagagatgatagaggtatactatattttttatgtatgtgaaggcctaaacctgaccccaccaccaccccatccccgggccacacacgcatatacccatgaaggttggtgggaaagggaggctgctttgcgaaaggaagggtttgctaattcccaagttttatcatctgagacaggaaatattacgctgcctatgtttaacccatttgctctctaagtataatatatttgaatgcaatctgagatagtcttaataatgtttaatctattacctaaaactctgtgttgacaattttgggagcatttatagttaaggattctgagagaaaaggacactaacaagtatgaccttgctgttggttaaagggagattttgataaatagtagggcactattctgaaatctcaaatctttcaggatgacccaactacttgtccactctgaacttccatgacatatgtgaagttcgaatgaagaaatttagaattgtgccaatacttcttaattctcatcctacctatcattttatagccctaacagccagaaagttttctttactaaatatctgattatcaatagatatcgcataagaaaaccatatatgaagtgcttataatgtgtatgggtgaagttgacagttcaaagttttgaaaaacaatcatgtttttttaagaatattcaactattcagcttagtaatttcaccaaaaggaagatacattgttaaacagacttctcaacaaataggacttataaaagattctattaaaatggagttctcattcagtagcagtgtttatatccatataggcaaaactccactagttagagctaccaacccatccagagaaatagccttactctagtgaaccagagttcataatagtagtcattaaaataagaacctacctgtatttggtccttggcctatttgccttgagttctatggcttatattgtatagctcaaaattgaaagaaaccttttcttccccatcaaagactattaacttaaaaaaaattcagagactgcagaagtgaataaacaacttaagattcgtacctctttccttttatgggagaaatattacacttttctattttaaatatttattttatagctctttaactacttttctggaacattagttctgctgttaacagccttacccaagtagcctacccagaaaggatttgctctctaggacaacagcagagtcattaaaggaatagctcattaaagcctaagtttttattcctgggtagaatctttttgtctatctatactgagccccactgatacccaacaaagaagaaaaaaattatagtatctttatattatatgtttatggcatgataatttttcttagactctgtcattgcttctgaaatatatgtcagtggtattttaggcataggatcaattcctggggtctggggccaaaattcagctctctgaagccactctgaccttcctacaaaagagttgagcacctcaagtcactttataaggtgtgttagtctgttttgcattgttataaaggaatacctgtgacagttatttataaataataagaggttaatttggctcacagttctgcggactgtaaaagcatggtgccagcatctgctcagcttctggtgaggcctcaggaagtttacagtcgtgatggagggcaaagggggagtcagcatatcacacaagagggagcaagagaaaaaggaggaagttccaggttcttttaacaaccagctcttattaactcataaagtgagaattaactcattaccatgaggacagcaccaagtcattcatgaaggatccacctccaagaccctaataccttccaccacgccctacctccaacattggggatcacatttcaacatgagatttggaaaggacacacattcaaactatatcaatagggttttaaaaacattaaccacaagaaggagagttggggaaggagctaccaagctacatagtttattgtttgcctgatgctgtgcttaacatttgacatgcattcttgtgtgtgtatctttaagtataataaaagcattttattcattcatttggccaaaaaatgtattgtctcctctatgactggtacttgcaaatgaggcagatgaggctcctgcaccctggagcttaactctaagggaacccttgcctgtgccagtaattacactaaacatttacattgcttcatttgatccctgccgcaatctataatacctactaaagtagctattagtattgccattttacagtgggaattgtaatatgttctgatttctcatgagatatgagaaaactggagaaaagattgacttgcttaaggtctcacaattagtaaatggtgaagcctgtgtttgaacccacgtctgtctgcctcttaactattgactatattgtccccaaagttgtcacatggaagtgagaaacttaatggttgcaaacaaattaaaaaacaccatccctgggacttcttggaaaactttatctcaggggattgcagaaaatccccccccccaaaatagaaaccatttaactatgcaaatgaaccacatgatccacagtatatgcaatccattgtatttgtttgtgtaagtgcaacttagatttttgcccaaaaaagaattgtttaatctcaaggatttaatttgtaattttatagatagaaaacaaggataaatattgccagaattaacttcttaggttttcaattcctaaagtttgtaaacatgcagattctgtaaaaccacctttcccttcattttcaatggagaaaatcctgacttcctactttagaaagtgaatagtgtcccctgtcattttacagaggtcttctcatggaattacatctttttcatgtggttgttttagatgagtatagctaaaaatttttaacatcatgcatttttaaactataggcaaaatttataccacctcttggtccttgtggaaggccatatctgcataaagggtagagattctccatccatgctaagctgttcaaccagtaccagttgaataaaatgaggaccaagggacatcactaaagggcatttaagggaagtgtttcctttcactattgacttactgttaatatttaaagaagagatgttttaattatgataggtttttctttcattataataagtcatctagaatttatcttccacctgggactccaggttatcattcaattttagaagcaggtagggctgggcacaggtggctcacagctgtaatcccagcactttgggaggccaaggtgagcagattgattgaggctaggggttcaagaccagcctggccaacataataaaaccccgtctctactaaaagtacaaaaattagctaggtgtgggattataggtgcgcacctataatcccagctacttaggaggctgaggcaggagaatcacttgaacctgggagatagaggttgcagtgagctgaaattgtgccactgtactctagcttgtatgacagagtgagactctgtctcaacaacaaaaaaaaaaggaagcaggtagatcttcagtgaaagagagccgaaaaagtgtaatttactcctttaggcctggtgatgtggcaaaagcaatgcatacacacacatattcataaataactattttaagcgatacaaattttttaaaattctctttcatttgatgagaagggatgaaccctctagaaatttgcatgtgagaacaagtaattatttagccttccatcttcatccctgatatggtctagctttgtgtccccacccaaatctcatcttgaattgtaatccaaattgtaatccccacgttttgggggagggaatcatgggaggtgattagatcataggggcaattccctcatgctgttctcatgatagtgagttctcatgagatctgatagttttataaggggctttccccccttcactctgcccttcctcctgccgccatgtgaagaaggacatctttgcttccccttctgccatgattgtaagtttcctgaggcttccccagccctgcagaacctctataaattacctagtcttttttttttttactttaagttctaggatatatgtgcagaacgtgcaggtttgttacatagttatatatgtgccatggtggtttgctgcacctatcaacccatcatctaggttttaagccccatatgcattaggtatttgtcctaaggctctccctcccctggctccccaccccctgacaagccccagtgtgtgagtttcccctccctgtgtccatgtgttctcattgttcagctctcacttatgaggaagaacatgcagtgtttggttttctgttccagtgttagttttctgagaatgatggcttccagcttcatccatgtccctgcaaaggacatgaactctttcatttttatggctgcatagtattccatggtatatatatgccacattttctttatccagtctatcattgatgggcatttgggttggttccaagtctgctattgtaaatagtgctgcaataaacatacatgtgcatgtgtctttatagtagaatgacttatattcctttgggtatatacccagtaatgggattgctgggtcagatggtatttctggtagatccttgaggaatcgcaacactgtcttccacaatggttgaactaatttacactcccaccaacagtgtaaaagcatttctacttctgcacagcctcaccagcatctgttgtttcctgactttacagcagcatgagcacaagctaatacattccccatttcattacaatctaagaactgataaaaaattctttacaaacttattctacctctcttcagttgggtcacagctacactaccttgataatcactagctcactgtcgcccagtgattaaggtaacagaagctgctaattcattctataagccttgcactttgaactcagccctctgtaagtaaggtatttgtgttaaatgcttttgttctatttaataaacttttatcctgcctctccggggtatggcagatgtaaaattacctgttgttctggaaaatggatgactcagacactaattaaagttactgttaatattagccacaggtggaaatgaggccaaagtgagccattcatttattgttcctactttgatgtgtcttttaaaatattaaattcaagaggcactaagtgtgtcagaatgtaggataattaggaagagggagatactgtgcttcactgagttatcctgaaacctcagtcagtgaactcaccctgcctgtcctcaggatttgtttagggttgcagtggcgaaccggtgttttctctcacctaatccttagggctttaaatccaggtggttagagggacagttcttatattctccttcctctctcaactgatgtcttttatgactgtttgctgaactgcacgaagtagccctgccatcatgacagtccctcccaccctgagtaaacaagtcttcataggtatattgtttcatttgtatcaaggaagacagtcttctggaattctgtaggtttgtgctgtttctctgatgtgcctcttctctggtctcttgttatgctgactgatccctgcctcctggagcaagtgacctgattctttggcagcagttgaataagttctgatgctagaacatgttctgaagctctccagagacaggaagaccttgctcctaaatggaaatcttgaaaattacaccctttaacataactctgctctgaaaagaaccccagacttgactataatctgggcttcataggatattctaacatcaaaattcatattattcctctcagctgctctccaccatgcaccccactaacctctgccctaatcctctctctcccacattctttagtcactgctctgtcccttcagtgtagcctagaaaaactactgtttacgttttgcttcgacatgttatggctttgaacgactgtgcctgacattgccatacacctagcagctgccgagactgatgagctgcctcgttgggatgtgttgacaaggactatacagagatttagttaaacccagtgtccagcacctgatgaaaaagcctgatgttacgttggctggactttgctctgtgtgcactgttaacccattgtactaccaggaaagagccatgtccattggtacttaaagaagaactaaagggccgagcacagtggctcacaccggtaatcccagcattttgggaggctgaggcgggcagatcacttgaagtcaggagttcaaaaccagcctggccaatctggtgaaaccccgtctctactaaaaatacaaaaattagctgggcttggtggtgcgtgcctgtagtcccagctacttgggaggctgaggcagattgaatcgcttgaaaacccaggaggcggaggttacagtgagccgagatcacgccactgcactccagcctaggtaacagagcaagactccgtcaaaaaaaaaaaaaaaaaaggactaaaggaaagaactcctcaaaaaaagctatatcaaataaccagctaacaagttaataagcaaaagggcacgtgtgtgtgccaggggctaaaagcaatgtgtttgcctggaggtgatgcaagtgccattgcatagtgagccagaagctaaggggtttgtgtgcgccagctccgtgttgagggggatggaggaatagagaggggagggagaccatcttaaacgtgttaggggtgaagtggaaaaatatctatcctatttaaatacaggcaagcctcactaactcagcctaattagaggaaagccagtctgaatcatgggatatttttaaatgcatttttattactttcaagcactggacatgctagtaattcaaactagactaacagcatagtacagcacctcagggaaggggctttaagaatcatttgtaattagcatatcaattatttgtatgtaagtggatatgcacaaagtgcataaaaagtttattctcctaagtaggacaaacattcccccgtgcagtcctgtttacactattaatttgcttagccagccctttttgtgccaagatagatgtatgtaagaaatgcttatttcctcagggaagaatgaatcgcttccctgtgtttagtccagtaactaagaagcggagcgccacttgattggtttgggatttccaggacatggagttttgaatttgcatacagactagagagatttcatatggagaagatctggcagccattgccagagatccagtttccccatctggatttcattgaagtgatctggatttcatcaagcaacaggacactgatcctaaatgatccaccagacactctaacataggcatgtttaacatacatcctgccctagaaaaataactgttaaaatatgatgagttggagttattctatgtgcagtacttaaaagtaataaaaatgcatttctttttaagtcccacaaaaaccatgcaatgtcaagttaatgatgaaaatcaatccccaaactctttcttgcacacctcattgtatgacggcattgcagagatttccaatcatctgggaaaggatattatattttgatgagctgcaccaggtgctaactatatggcagaatttcggctttgaatcttagggaggccctcaggggtaaagaagagtgagggaagggctaggagcatgtttattgttaacaaatcactattgttcacctaagcttgaaaagtgagcaattgaattggaaaagaagaggtatcagttatataaggaaggtagaaaatgtgattaggaaatgagaaacagagatataggcctttattcccacccgtatgtattaaactgtgctctaggtaaattgtgaattcttcaaggcttagagagtaaaaactaaggcagagagcataagcacaagcagtaaatatacacgtaaatgttctaactatagtttggaatgactccaacactcccctttcccccaagggcatcgctatccagggtctgcaaaggccaaatagctgtttggcttccaatctgattttttgcctaagaaatcagagaagtcggtttcaattttaataatatattctcccaacctctatataacagaaaggcacttgtgtttctgtcccttcttaaagcgaattttgtgtttggtgaaaggtaatagattgacagcactggaaaatgaattactgtattcccagaacaggtataaccgggcagtgacacgatgaaatttctctctgcctttggggaccattagaatactattcaggaagtcactgctctggtgtgctgtgctgaactcaccagtatcctagtgggctgaaagaattaacatagcactcaaagggcctgacttgaggccattcatttattcattcaatgttatggagtgcttactatatgcctgatgctgggagaagactttcacaaatgttatatcatttaatcctcacaataaccctgtgagggagagaatattattgttttacagagaaggaaactgaggttcagggaagtgatttgtccaagttgctatacaaacactgaatccaaccttatctgactccaaattcagcattctccctgaactgagtgctgtaggggttgcaaagggggacagatgagacatttggtcaaatgatgtgacacagagcagaatgcagtctacactatgagcagtcctggtagttacagagcagttaaatgacataccccagatcaaatagcacagatagccttaggattcatattctttaggtcttcttccattttttgtttttcagcttagctctccaaaccagcctaccactttgcccaccctaccccctgcccagataatgtacactctgcttgctaggtcctctggcctctcagaatgaagatagccaaagaccattgggatttagtaacaagagcattgcattcgaattagaattagtgttctaattctagctctgacgattcacttcaggccactggtaaggtgccatgaaaacactggatgactttaattctggatgactcactttccgttgtgtgaatgagaatggtttacttctaaaaggtatagtgagagataagtaataatatgttaaaaatagtatgcagccctttctgttgccaaggtgacacgtaattgatgagtagaattacctactacaaggcgtgttagaatgcccgttagaatctatgtttctatataatagactcagcagtgagagaaaagatgcccctttaaaacgttaagaaattacgttacgaaaattaaaacagcgaaagggatatgaggttgtttgctggttggttggttgtttggttggttggttggtttgggagtttaaggtttgtcttttattttatggatttgtttttttttctttcatgtttttagaagttcatggaaccagtacagcttgtttgatgctaaaagcagaaaaagaaacttacagaaaattaaatgtcttctgaatatgtccaagaggcacccatgttctccaacaaaatgacacatcatgctcactgcaaggcagcctccctcctcccaaatccctgcatccctgaaccatttgtaatagatattcagaagtcactgaggcatttaccatatgctgcatcccctggcaggttgagttgttgcagaatgagtcagcagtacctgagctcagataggattgagagaatttagagaaaacatacctatggaaagttgaacggctcccatttgggactgactagtaatactttgggtccttaacacagtctgcctctcaatcccatcaaatgcaataggtttaaaatttatgtcttagaaaggggttttgctgctggcaataacttttctcaggctgacattgagaattcaaagcgttagtagcaaatatttttctcttctctccttctgcatcctacccttcttggtttttcaactttgaatttctcattctttaatctctattgagggagtctctagagggtgctgagagtgtctgttggaaagcatgaagatgacaaggctggtttagactggtgcgcaatctagaaagtcaggagactaaaccttctgggagcatgaacccatcagaggtcttgctagagggacaagttagggttaccagaccccaccaccagtatcggttaagggtgactataacaccattgctctggcatcccattgccctgagatgaatcttttaggatattgattatctaaataacaaaaaaaccacaaaacatgttcagcccctgatattaaaggtaaagaagcaccagtgaaagatctcaaaggcacacagtagaagctgtgttctaccctgatggaatcaaagaaaagggagtaactctacgattttgttcttgggcttttcttttatccaaaagcatcattaatgtcaccactctggcttttatcctcctcaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagtgacatttcattcatgtattcatttaatgactatttattgaatgcctactatgtataaagtattgattctaccctcgaggaagttagtggaaatttttaaatgttagataaataaatagagattgattttcatattcacacacatttaaataaataaaacatagaaaattgtaagaaccataagagatagaatgctgtgggtattcaaagagagaaaatacttcagaaaaaggcgtaattgaggaggtaacatttgatctggtttctaaagggtagctaattactctatctttacaaagtgtgtgaatgtatatgagtgtttataaaatctgggtcaagtttgaatatacagagattgtagggaaggatgttctacacacagggtacagcaagatcaaagttgggagagactgagctatgtacaaagaatagcagtggttttagtttggctggactgtaaagtgcatggaggagaagttgcaaagaagattggaaacctgggtgggaaccacatcacggaagagctggaattcttagctatgaaaatttgtaccatattctgtaaacattttgggagccactgaaggttttagaatgagggaatcataagatcaaagcttgcttgggaagattaacactcttcccagtaaagttttggcaacagcatctgctgttatattgacataatgtgggtaaagtggctgacatagtatctgatgcataggagctcagtaagtcatggaagcagatatactgtagtggtttagagcaaaaactctggtgcctggatgcctgggttcaaaaaccagctctgccacttaatagctgtgtgattttgtacagatttcttaacctctctgtatggcagtttccccatctgtaaaataggattaaaaataatacctgttatgaattattatgagggtcaaatgagttaagacatgtaaaatacatagaacagtgctctattctgaataaagttctcaataaatgttagctgttgtcatcattattatcattctcattcatggaggagataaaatttaagctagcctttaaagaatggctgtgatgtagacatgtagaaaggtaactttcaggcacaagtaagtacacgacaaaaggcatacttgcaagaaaatacgaggtgagtgaggtgaacaatggagagttcagtttgcctatagaataatataggttaaggtgttattggaaaataagattttaaaggtaggccatagtcagattacaaagcactttggatcatagcctaagaatattaagtgttctctaaagacaatggagggacattaaaggtttttgaattaagaagtaactttatcaaaactatatccctaaggaaaattaatttgatggttttgtgtgtgaaggattggagagggaagagacttgaggcagggaaactgattaggaagctattggtgtaatccatgaaggtggtcataagggctagattagagtactgcagtggaagtggagaggaaggaataggagagagattggtggaagactggtaattggaaaggaacaggaaaagggaggaatctgaaagggtgactttcaaattcctcagttttgaacatgggtgactgaaaagatggatatcattaacagagtcagggaatagaagaggtaagatgacaggtttagcatagtcaaaatggagctgtaaatcacagctgacttctcttcacaaattgacatatctgatcctaaaatgtatccagaaattcaacccagaatagcaaaagcaatctcgaaacagaaggacaaagttagaaaactcaaacttctcaactttaaaacttacaacaaaactacagtaatcaaagctgcatcttgctggcatgaggacagacatatagattaatggaagagttcagagtccagaaattaacccccacaattatagtcaattgattttacacaaaggggccaagaccattcaatgggggagaggacagtcttttcaataaatgatgataggacaactggatgtatcaatatacaaaagaataaagttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaataaataaaataaaataaaaaataaagttggacccttacctcgcaccatatataaaaattaatttaaaatagatcaaagacttaaatgtaagagctaaaactataaaactcttagatgaaaacatagatgtaaattttcatgatgttgaaataggaagtggtctcttggatatgacaccaaaaacataagcaaaaaaagaagaaatagataaattgaatttcgtcaaaatttaaaactttgtgctgcaaaggacactatcaagagagtgcaaagataacccacagaatgggagtagatatttgcaaatcatgtgtctgataagagacatatttagaatattttaagaactcttacaactccatattaaaaagacaacccggtttgaaaatgggcaaagggttgaaatagatattatttcaaagaagatacacaaatatccaataagcacatgaaaagatattcaactttattactaatcagaaaaatgcaaatcaaaaccacagtgagatgctacttcacacccactaagatggttataattaatttaaaatgaaacaaaacaaaaaatagcaagtgttggtgaagatgtggagaaattggaaccttcatacattgctgatggggatgtaaaatggtgtggcccactgtggaaaacagtctagctcttcctcaaatggttaaacatagagttgccacatgacccagcaattctactcctaggtatatatccccaagagaattgaaaatgtgtctacacaaaatttgtacatgtatatctgtagtagtatactatagtggcattattaatatcagccaaaaagtggaaataacatcaactgatgaatggataaaatgtggtctatccatgcaattggatattattcaaccataaaaaggaatgaagtactgatacatgctacaacacaaatgaaccttgaagacagtcacaaaagaaaacattatatgattccactgatatgaaaggtcaaaattagacaaattcatagagacagaaagtatattagtggttgccaggggctgggggttggagagtgttgggaatagatagtgactggtaatgggttcagggtttcttttgaggacaatgaaaatattctaaaattcattgtgatgttgtgtgcacaactctttgaatatgctaaaagccattgaattgtacactttaaatgagggaattgtatagtatatgaagatcaataaacttattttaaaattacttttaaaatatttttttcctggaactgtagcccctgataaccagctgcagattttttagtagaatcaactgtcagttgcttctaagaagtttgaaaaagataacagagaaaaggcttttggatatggtaatcgagaggtctctctacctttaagagagcaatttcaggagagcagtaagatcagatcctggattgcaagaagtatgtataggcggccagtatgtggataagttggacaatgctgagaagaaagggagggatagatgggcgacttttaacttataacctacaggaactgaatcagcaggaattcagggactgaagatgtaagaaaagagctcattggtgatacatgacccttaaagcaacaaaagaggatttagtgctcacagggataaattaagctggaaaggtagaagaaatatgatggaggacattttcaggtagagaaaagaggtaaaggcactcattacacatagcttcaaccagttccgtccagtatgagacagaaaaagtttgatctagaaagatacacaacaaactatgaatcagcagttacctctggggtggaagttgagatggaaatagggagatttttcacttttatttgatagacctttatgttgtatttatgtatgtatgtatgtatgtatgtatgtatgtatgtatgtatgtatgtatgtatttgagactgtgtctcactctgtggcccaggctggagggcagtagtgcgatcttggctcactgcaacctccgcctcccaggttcatgcgattctcctgcctcagcctcccaagtagctgggattacaggtgcccaccaccacgcccagctaattttgtatttttagtagagatgaggtttcatcatgttggccaggctggtctcaaactcctgacctcaagtgatctgcccgcctcggcctcccaaagtgctggattacaggtatgagccaccgtgaccggccatgtttaattttttatatcaagaatgtcctctcattatatttgtatttttcaaaaattagactagctgctgtaagaaatgtaattcttcatcacttggaggtaaagtgaaacgtggccaagctgtagagagtgtgtggcccatattaatcactcaattaatgtttgtagaatttgttgaattgaagttataagcataaactctaatggaagcaattcacttgatttctcagcttcctccagcagaacagagagaaaattctgatggtgtggttcatccaagggtttaaggactgacaaggcaaaaatggcaaaggtgtgagggaactagggtgctaaagtaagttttcaaaatgactaatcatattctccagaataagtaatgaagcacatgaagtcaaaagataggctgagctgggcatgatggctcacgcctgtaatcccagcattttgggaggccaaggtgggaggatcgcttgagcccaggagttcgagtctaggctgggcaacaaaaaaaattaaaaattagctggatgtggtggcctatagtcccagcaacttgggaagctgaggtgggaggactgcttgaacccaggaggtcaaagctgtagtgaaccatgatcatgccactgcactgcagcctgggtgagagactgagaccctgtctcaaaagacaaaaaatttataggatggtgtactttgaaaataggaaaaaaaaaactagggaataggagttacagtaagaataaagaccaaatacaataggaattggaaagatagaaaattgtagatggagaaactagttcagagttcagggccttagaagaagagcaattccaagtgcttctttatcaggccccaaagtgtgtctatgacaaggaataaagtagagtgcaggtggacatcactattgttgaaaagataaaggaactctgatgttagagagttagaacaggcagggggaaaaaataggtctcttgttcaatactgtgaacccattgcccaacgtagtacctataacaggcattcaattaacatttgttgaatgaatgaatgaatgaaatgaatgaatgaatgaatattatagcacttatcacagttacttgttttcctgttttcctcccctagtggaccagaagcttcctgagtattgcttatttctgtgtctctagtatttgaatcaaggtttgagtgagggaatgaatattgaactgcagaaaatgatgacaaggaaaggcagaatgagaaaaattgtgaacgaggtgctaaaacccccaagggaggtgaaagataagaactttcatagtatttgagtaatattatcaaatgacattgactcaaaagagggagcgattgatgagaggaaagaatgttagatttggaagtggcaataggaaaaataatattccaatttttttttccgtcctgggaattctggaggaattggcacagtgttttcttctttgatgctccactcctactctgtcaattagccctcccaatgtttttccaaatttaccttaccttgcttcctgctgccatcatgactagaatgcttcaataccctttttgccaacccctgtggggttgacttcgtcacgttgaccctacatgcaagagcaaaaagctaagttcctaagcataatttttcagcaacattagtacttacctcttacttctccaatggtttccatttgactgtcaaatcaaatgaaaacttccagtcttgaatttaaaagtgttcacaatccagccctctgtaagctgcccttacttcagttgctttgaagtttgcactatgtacaagatgccctacctttctgaaagcttcttatcaaccttttcaatacccatccagagccctctttatcagaactccttgaggactcattttccctacctggctataatcaaaacaactactccagaaacacctgcctgcctttatcctttcctctctcctaaataccaaacactcataaatgttatatgtatatgcttttcttgtgtgtcactctgtattacccgatcaattctaccatataaatttctcccaaatctatctcttcctccttatccttgctgtcactggcctggatggttgcaaaagccctcatcaaccttcagggtatcctacaatagagcttgagtatctttaaaatggaaatctaattatgccttcaaagcacacacacacagatgcacacatgcacccacacaatgtttgagacattttgtaccctttaagcaaaagtccaaactcattagcctgccgggcatatatagcccacgtttacctctctagcctcatcccaccactcccgctgtcaagccttcatgtttctgcatgcatacttccttctccggacttagtcccctaccagtaaccccacaatcatctctgcctccaacttccctatcgtcaccctacatacctataaatttctatacttttaaaaaaacttttattgcacaataatcacagattcacagaaggttgcaaaaaaatgtacagggaagtcccatgtacccttcttccagcctcccccaatgttgacatcttatacaattatattacggcatcaaaatgaagaagttgatattggacattggtacaagccatagagcttatttagatttcaccagctatatatgcacgtgtgtgtgtgtgtgtgtgtgtgtgtgtgtgtgtagctctatgcaattttatcacacatgtagccttgcataactacaaccacaatcaagatacagatcagtaccatcaccacaaggttccctcatgctacgcctttatagctacatccatccctaacccctggcaaccaactaatctattctccacctctgtaattattattttgcaaatgtaatatgaatgggctcatgcagcagataatcttttgagattggccttcttgacccagcacaattcccttgagagccacccagattttttgcatgtatcaatagtttgctcctttttattaatgagcaatattccagtggcatggttgtaccagtttgtttaaccatttatctgttgaaatacatctgggttgtttccaatgtttggctattacaaattgagctgctacgaacattcatgtacaagttcctacacaaaaataagtcttaaattatctgaaatacattgcccaagagtacaattactaggtcatatggtaagtctatttttagtcttaacaggaactgccaaactattttccagagtggctacaccattttacgttcccaccagcaagatatgtttgtgatctagtttctccacatccttaccaggaatcgttgttaccatttttcattttagccatcttgagagttggctcagtgtagttctcatcttttaggacctaagtcaagagttacgtctgtagagcctttttaaaatcctcaggaaaagttgattattccctactctgtgccatttctgacacttcatttgtcgttgtattttaattatttattgacatagtctgtgtctttccctctatttccgggctacatgaagctaggggttgtgtcatattcatctttattcctgcagcatctggtacagttacatgctgggcacacagtggatgctcaggaaaatgtgtggtaagtgagggaaagaatgaatgaacagaacattagtcttgttgcctccccctcctcctccttaagctagaaacctttttagaacagacatcacgccttcctctgtatctcccagcagcagctaatagggtgctctgtacatgtagatgctcaataaatgtcgtctaaactattcagttagcttatcttccctctgcacccaggagataagcatatgaaagagagaataggcccaagtatccttgtattaaggatcatatgtcattatttttataatattcttataatctctatgatcactcaatatttttctgtgtagatgagaaatcaaaacaaaacagtcctttgagtcaaagaatgcctctgtgggtgagcactattcaataatttcaatacccttgttacatatggatttgggagaatggctttttatgtccctgaattctttttgcattttcagaaagatctgggatttttctggtcttgctgcactggtgtaatttgacatgttgattatgaagaggtcattaacctcaacattttttatcactttttgactctggattttctcaactctgatgtatcttaatttacacttgtttatacgtctctgtaagagttattcaggcccttgagggctggtatatattctgtctggaaagtagattgtaagccccttgagagcagggactttataactcctaaaaatgcattctggacactgccagtgttcaattaatgataatactgaaagcttgactaaggtcatctgtcacattgacatcttccttttcatctacaagggttctatcaaaaaaaaaaaaacagctaggttgagtaggtagcactgaatgattctatccaaaattatgctcattgttacactacaatttgttctttagggtgctttcaggtttataattttagatcagttgttacagttaccttccctacaataccctggttacatatgcattagggaggattgcatttcataaccctttagtccttttacataataaaaacttacctgataacatctatgcttgtaaagcatgtaattcttctccccagcccccactgagaaccaggtgattaaactccaagtatggtcctcatcttaaataaccagaaagaacccttaatgactattcaatgtatatcttattttcccagattttaaaatggactaaatgtgtatactgtgtcctatggctgttgaagttaaattaatatgaatatttcaaggaagtctgaattttaaaacagaagggcagatgtgttcattgatgagcgtggaagtagagggaaatttttttgtaagtcaggtttattaaggtatcatttacatgtagtctgattcacctctcttaagtggaaagtttgatgagtttgacaggttgtgtttttttcccttaactatttgctaattcaattatacctccaacttgccctaccaccaccactacccctagaccaaactgacctatattttgtatcctttctattttatatagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggtgagtataaaggaaggttaccagaatttgttgaccttcctccacattttgtccattggcactgaacttggaaaacttggctttcttgcattggataataccaacctacctgaggcccagaagcctgagtcaataaaatctgccacctccacagttcagaataagaaaatactctgacacacttctcagcttagcatgtgcattgacttcttggcactctaaagtctaaatttcaattcctgaagcaaagatcctctggttaaaggttacctcgaatcttaaaaatagaggatgttaaccccggtagactttgatccaccttctctcagtgtagtctttgattttcagttctaataatcatcttttgggaacatgtcactgaaattccaactctacttgtatgtaagtagtaaacacacagattaattaaataagctgaattcaagaatgcctcttcccccaaaaagcatggatttgttacagtgaagcaaaattgagagatctatagtctcttgggcattcttgcctttggtgtgtgctgattatttgtattacttagccaaaagaaagcccggtctattcaatagtagcatttaaacatttgagaaaagaacttgtcacaacatctaccacctttaaagatgccttgcttaaaatcttctgtctacctacctggcacaatctttatttcattggatgaatagattggtgtgttaaaataacatggtcaagcagattgagcttaaaatgcatatattatagaagagctaattgttggttgttttgtcaacctgttagaggaaattgtggggaggccttattaaatgagtgggcattcaacacaagtacacaagccttgtcctttggcagcctcaaactctagaaggctcaaaattaaaggtacttacaagagacaacctcttatgaaaagctggcaagaaatatattaacttcaactgaagaaaaagataaaattgataagtactgtgtgacatattacttttcttgacagcactaaggatggtgattatgatacaggtacagctaaggagggggaagagacctttctaccatatacatcaggttagaacctgacttttgtttgaggctataatctttacattaaaagcctgttagcattctctaaagcctttttgttttctcagcccaaagttttgacatttgaatatataagtcttcttaggaaatatgtgtattcctgaaaacgcttgtgcataaatggaatttttgcaaatcaaatcatattgtatatgtaccagagatagtttactacctaagcaaaacctatagtgacctttttttgaaattaaatactcatgccgaataagtctatcttataaagtcagatttttccgtgtcaggagtatttaaagtaatacctgtactatctaactgaaattctcagccctattaacacacaattcgtagagggagccacatccccaagcttcagtggaccccattgagacctaaaagacatagtcaaagcatccgtgacctttcaaatagtagaaaagcttaagaaaagagtgaccatatgtccgagtttatacatgttatcccagtgtaatgattaatagtgccctcttttacttttaaaagtataccattttgtatgataatttatatggtcaccctatctaaaatagaccagattctgtttcccttaggctgcgttgagattaggaaatcattccattttacccttatactcttagaatttagctaaaggccaatgttctaatgcttgcatggcagagcacatctattcagcacaaaaatgtgctgattattagccagtataatatggccgttgggtgactgtgacaggacctgacgagatgggtcagagcatccatcaacggtcccttcctcatctcactctctttgatctctgccaccaggcctatgttttgtggcaaaaaggaatgctgacatcaaaagaaggaagtctgtttttgtcagcattttccttttctctttcctgggtttttagggctagatctgccaatagttttaaaaatacaaatcacattcagcagtcattttatagaattgttgcaaaattcatcacagaaatctttccattgggtagatcacctcaagagatctggattccagagatctgagtcttgctgatggctcttgatggaactgaggagtttggattcctcaggtacatatttttggggagatgggagcctatttaatctttgcagaccttggactgcccagttttacactgtgcatgatttgactggtccaccaaagtctgcctactaggtggtttaaaaatatcacaaaggggggattaggggaaattctgcaatttgaggttgtcttttcttaaaacatttttctctctttccttaccccccttccctctcctgctgttttatgactattctttcctaacttcacaattcttgatggagacaggaggctataaccttgccaacacggctcgatgctggacatacttgaccggggtcatcctagggaaaacactatcctctgagatcccagatcatgaggtaagtaaggctctgacaagtcctctcttctttaaggggaagagctgagtcattccacctaatcaaaatcacgtcctcaccactcaataccgttttgttgagagacacttcaataacaataacacactgtcttggcagaatagtggactcttgttccaaaatatccaagaccttctgcctttttgtttttttacaagagatctcaaaggccaaccaactttaatttctcaattaattacagagactgtgggaaggggtcacctgttcacacaaagaattctttggaatatgtgcatatttttatcccctagcctcaaaaaggaaggggctatttttaaaatgtgtaagctggattctcatcttttttttaagaagtttcataggtggtacgtggcacatgttctttggtggtagtcctgatctctcaattttctttgactaatgtaaaattcaagaaacccacaagcactacaaagaccattgctgatgtttttctagcaattagtggcacacagaggctggaataggaccatccaaaatgtgaaacgtcatttgagcccttgccattttctttagtcatacaagatgggctttatgttttccaaagcaaagatgtctgttctagttttcccaaaacaagttcatggaaagctgtctgggacctgtgagtgtgctgataatccctaatccaaaggcatacctttgttcctacctatcaccccagttcccctgcaagtaggaaccatgttatagatcaagatgtataactacggaccttagactagatgacttaaaataacaaaccagtacatgcagccccaccttctcaagctatttcccaaggattagggatgctgctttggttttaatgttatgatttctgccagatacagtagctgtacacttgggagcatgatgctttttaaagttgctattattttttaaaaattagaaacaacttaaactaatttccttccaattttctcctaacctcaggtgaggtacaatatgtatctcacaaaaaccattcaatatgtctagaatacaaatagaaggtacactataatttgagacaatttgctgatgtcagggttaatagaagtctcttttcttggtttgtcttacctttattcagtatttggaagcttaatgaaatataaaggtaagtgctgtgaacaaatgtaatcgctgttattgctgtgggaatatctcagattgcattgtaatttaaagctctgggactttataaactgatcaagttatgtcagaaacaagttttaagctgtagaagcctgaactgagaatgaatgctctattcctgagaagcaaaagcaaatccaaagtttcatctgtgttaaaagattgataaaattttaataaagatgaatatcgcctctggtacatggagaagctgtgggcctgaatgggtgtaagctgggcctcataaataggtgttctgtctttatactgaaatattctgtaagattaaatgagatataatgtatgtcaagtgcctaacacgtagttccctggaatctaataggcactttaaaaatgcaagttctcggccgggcatggtggcttacagctgtaatcccagcactttgggaggtcaaggcaggcagatcacttgaggtcaggagtttgagaccagcctggccaacatggtgaaagcccatctctactaaagatacaaaaaattagctgggcgtggtggtgcacgcctgtaatcccagctactcgggaggctgaggcaagcgaattgcttgaacccggaaggtggaggttgcagagagccaagatcatgccattgcactccagcctaggtgacagtgtgacactccgtctcaaaaaaaagaaaaaaaaatgcaagttatctccttcttctttgcatgctgctcacttcttatacccagacatttatgactatgtcattcataaatttgtccaaaccttttgtgaattccttctgtcatatccttctggtttaagagatgtgagtcatgcaagaaagaacaaagaataaaattgaaatgacagtcttacaggtacaataagataacattttaatgaaaattgccaaaactaggctacacagtgtgaagtcatataagttctgtggcacaatacacagttgcacacaaatatccttgtggtcctctgaaatcagattaacaaatggtagatcaaaaaatatttgctgagcacccattatgtgccagacaccatgctaaatgtcttaggagatgcaaagagagaaattcatcccctacctcaagcagctagggagggagggtggtgtaagtgctggggagacatgcaaatgcacagatagttataatacagagcagaaaaagaataagacagtaggaagagtgactgtggagatgtgcatcaaatataaaggggatacaaaggagtacataaaataccctgccctccatgagctgaaaatataatcaagaaatctagtaggtgaaaaggtcaagataatgcagtggtcagttgcagccgggctgacctcactctcttcgctctcagtcttgggctttagttctttcatctcctagggtaataatcctcctcctccaaatgcccgttccctacttctctattatcttcctaggtccagcttcaagtcctgtgcccttcaaaaacccttacctaaatacatcaatcccctttgagctcttccttcacgttcatttattccttgtttcatttaacaattatgtgttgggcccctactatttgccaggccttattgagacctggattcagagatacaaagactaatgagataatcccagtgccctccaaaatctcacgatctaataaaggtgacagaacaatgtgctcacatccaggacagatgaggaccataggggatatgtttcaacaagactttgaactgactcttagaggctgattaggagttcgctaggtgaagaagaagaaaaaggcattctaggcagagggaacaaagatcagaaagggactggtgcctcatgggaccagtgaaaaatttgctatgtgtagattacagggtatatgagagacagtaggaaggattaaggcttgaatggaagttaaggccagattatgaagagccctgaatgctacattaaagagcttacacttttttctgtgaaaacaaatgagctttaacttttaaaaagctcagttggtagagatagattgcaaagaggagagacttgagaaacgcagacctgttaagagattcaaatatatacctataacacttacagtctgtgccattcatttggtcatcattgttttggttgtctgcaccacgcccccaaccctagtgcttagctgagtgttaagtagccaccacctagttgaataaatgagtgtttgagtaagtgtctcaatattcatattgggaaacttctatttttttaagatgaaagaattggaagcgtaatctagcctttctctgggaacccaatttaaccttaatagcaactttccatcctttgcaagaggtatcaggtagcccagctataggaaacaggtgtatccatgggagaacattatattaccaatgcagggaatggagttcagaaggcagaagcccagcacaaatattagaagtgataagggtaggacttcaagtatagcgctcataaaatataaaaccggtgataccataaagccagtgatgccataaggccagtgatggcataaagccagtgatgaggaagttagtttcagccagagcactggggagccaggttggccagccaagcagtcccagctgggaaagctgagaagaatggagcttgtatgtatgattggcccagatatctctaccatagggaaagcccaaaggtgtcatggtaccatgaaaagaccagtacatggcaaatttagcacaatcacatggattattatgtataaaaatgttctatagtccagtactactatttagatcccgtgacttatctaggatagagtagggctggggtgtgtgtgtgtgtgtgtgtatgtatatgtgtatcatcacataggtttactaatggaaaatattaacactacttaaccagactgctttttatggactgattaaactgtacctcattcatattagggaacatatgtagccattaaaaagaattaggtcaatttatatacaagtatatgttactaataaaaaaacagccttcttgcactgtaacctgtagatggcactgaatctatagattgatttgtgcaggagtaacatcataacaatatttaatcttttaagccatgaatttatctttctatttacttgagtcttctttaattccaaattataatctgtactctccagtaaacacatcttacacaaatattattgaatttatccctaagtactgtatttcattattttgatcctatgtaaatggtattttcatttcaatttccaatagtttgttgccagaatattgaaggacaattgacttttcatattgatcttgaataatgtaaccttgctaaatttacttattagctctagtaacttttttgtagattgcttagcataatccatgtatgcaaacatcatctgtgaataaagagaattttctttctgtataatcttcatgtcttttatttctttttctcacctttttcactggttgggacctccagtgcaatgctgagtggaaatggtgtgtgaatatctttatctggtccccagtcacagggggaaagtgcttaatcttcactatgaagtgtgatattagctgtaggatttttcaaaaatgttcttttttaggttgaggaagttcccttctattcctaatttactgagacttttttttttctcacaaatgagtactgattttgtcaaatgtttttcttcatctattgaaatgatcatatggtatcctcctttattgttagtacagtaaattgcactgattttttaatgttaaactgactttgcattcctggaataaaccctgcttggtcatgttatattatcctttttatgtattgctggattcattttgctgaaacttggtcaaggtttttttgtgtctatgttgataagggatgttggcctgttgttttcttttcttgtagtgtctttgtctggttttgatatcagggcaatgctgatctttggtttctctggggtttacatctgggcatctgtttgtttttgtttttgtttcgttttttgttttttgtgagacagaatcttgctgtgtcgcccaggctggagtgcagtggtgcaatcttggctcactgcaacctccgcctctcgggttcacgcgattttcctgcctcagcctccccagtagctgagactataggcgcgcaccaccacacccggctaatttttgtatttttagtagagatgaggtttcaccatgttggtcaaactggtcttgaactcctgacctcaagtaattcgcctgccttggcctcccaaagtgctgggattacaggtgtgagccaccatgcccagcctatagtatgcatttttaacttattagagtcaacttttaaatagtattacattacttcacatataatatagtacctttacagcagcgttcttccatttttttcctttctctttctttgtgctattgtagtcatatattttacttttgcatatgttataaacctcttgatacattgttattgttttgctttgaacaatttttttagtttttaaaatatttactaattcattttaagtagaataaatccagcatatattagcacaaataacatgttttgatgaaaaataactgtattttcaaagataaaaagaaatttcttaagaaaaatgtcattgttatacccttttgcccatttctttaacatctggcttaatagaagacagctgacttctcatacctgcttctacattcagtgtgttttgagatgttgtttttttaaaaatatataaagaaaatccagcttcacatagatatgtaattggaaaagggaaaatgtattttaatacactttcagataattatggatattcttcgatactacactaaaacttcacaaatgaaagtttcttaaaggttaatccagtgtggaatctgaaaccgtatcagtgaactttttatgtactattacattaaaactcattggtcatcttattctttgagtggatatttgacccatcttatacatattggttatttggaaaatattagttcactaagttatgcaaatattccaaatgctaacacattttatgcagtatcaaaaaatcagtcattgatctcaccaccgatctcactggaaaaaaagcttaagtattgagaagctgttatgctcccagtggcagaatgaagtttcctaaaattctaattttcactcaaaaaatgtgaatattatcattggcaagaaatgctgtcagttgtttgccctgaagtgacaaacttatttcatttttgagaaaatatttgccaaatgtccaagtatttaatcatgccttatccatcattctttcaagcaaaaatgatgttctatgaaaaatgtggctagttaagctcaaaacttgacatgcttttcctcaagacaaccaccatagcacagtttataccagaagcaccttacgtatacctccaatttcatcacacagaatattaaatccagcatcaggatttaataaaattaatactttttagtgctttatcagggacattcttaggtcaaattggattttattttactataagtgcatgtcagtaaataatacaataactgctggtatactttggtgctattgccttaatttgtaccatagtatctgcagttttacccaccattgcttttgcacctccatgcaaatataaacaaagttgctccagcataaaccatgagattcaaagttattcagcactttgaacattttagcactactcatgtttgttgccaaccattcacataaaagaagatcgtcttcaaagattagttagtgctgataccacatgactgactacaagcaaaactgtaagcccagccatatttgtagatttgtctgtttgtaaggtgcgaataaattctgtaaatgagatgctaactaagtcttcatgattacagctaaatgtttaaataaacaagttactgtgccattgagaaaagacaatgctgtaagctattttactaacttttcatccaataggcagtgagcaatgtcaattgtccaaggctttattggtctccaagctataatgtggaattctctagccaatgcagtaaaataacttacctataacatgctgcaatgactttttaatttctagtttgaaaaggtgcaacaaacaattcttggctatttgagttcatcatgtctacacttaatatattcaattccttttcccttaactatgaatgaatggtctaaaaatgatgctacaatttaaatgacgaattattttgaaactgttcaaaaatgttctgttgcataagacactataaggtaaattcgttacatatataaagataattttaatcatatttcatttcttatttacaatttcacccagtttttttaagtaaagttcttccttccatgggtcagaacccttactgatgtttcagtttcatctttttcagctctataaacatagatgttgtggccctggtttgagaaagcaagtcttttagctctggacaacaccccttatatccctaattgggctgtgtttggctggaccgtgttactccatttcctgtctgccaccagggtaacagcatgctttgctcctctctggccttcggtggcagtcctttgagctcagtacataggcagccaccactggatctgctgattccaacatgaccctacatggtcttctaaagaaattatgagtaagaaaatatcttttatattcatccattccagcatttttcaatattttgtgtagatccaggtttccatctggcacaaactgcattctgcctaggaacttcagttcatttttcttataccgtaggtctgctagcaacaaattctcagcttttgtttgtctgaaaaagtttctattttgtcttaattctggaaagatattttcactaggtgtagaattctaggttgataatttttcttttagcacttcaaagatattatttcattgccttcttgcttacatatttcctcatgagaagtctgtgataaattttcatctttgttcccttgtataatatgtgtcatatttctttggctgctaagttttctctttataactagttttcggcagctggattctaatatgctgtcatgtggttgtctttggatttatcctgtctgagatgcattgagctaggatctgtgggtttatagtttttatcaaatttggaaatatttcaaccactatttttttctgttacttctttctttcttctacttctaagactccagctaaacctagttagaccagttatgttgaagtttcatgcatcattcactgtgacctttttactttttctttctttttctttctttctttctttctttctttctttctttctttctttctttctttctttctctttatttttaagagacagagtcttactccgtcagccaggcttgagcgcagtggtatagtcatagcttactgcagcctcaacttcctgggctcaagcgatcctcccacctcaccctcccaggtaaataggactacaggtgcactccaccatgcctggttaattgttttattttgtagagacaagctctcactgtgttgcccaggctgttgtccaggctgatctgccactcctgggctcaagcaatcttcttgcctcagcctcccaaagtgctggaattatgggcatgagccaccatgcccggcctattttttttttttttcagtcttttatttctccctgtgatgtattttgaagagtttccattgctttgccttcaagttcattgatcttttattctgcagtacacctgctcttaatctcatccagtgaaatttccatttcaaatattgtgtttttcatctctagaatttccattcttaaaaatatttttaatttctctcctcactaggttcatattttttttacctccttaagcatatggagcatatttataatagctgttttagagtccttgtctactaactccatcatttctgtcatttctgggtctgtttctgttaactgatttttcttcagattataggtcacatttgcctacttctttgcatgtttagtaattttttattggatatcaaatgtcatgacttttatattgttgaattctggattttaaataattggatttcaagaggattatacttttttcctgataattaagttattgtggatcagtttgatccttttccagttttgttttgaaattaatttagagtaggtcttgactagcctttttattctagggctaatttagcctgctttgaatgtactacccctgtgaagcctatactgttaccccaggtattcagtgagatctcttcaatttggccctttgtgagctctagaaattgttcttctttttttgtttggttggtttttgtttgtttgtttgtttaagatggagtcttgctctgtcacccaggctggagtacagtggcatgatctcagctcactgcaacctccgcctcccaggtgcaagcaattctcctgcctcagcttccccagtagctgggattacagacatgtgccaccatgcccagctaatttttgtatttttagtagagacggggtttcgccatgttggccaggctggtctcgaactcctgacctcaagtgatccgccagcctcagcctcccaaagtgctgggattacaggcatgagccacggcacccagccaggaattgttcatcttacaacaccacaataattgtttttctgtaagtttttcaggactactcttgtgaagttgtaccctatacatgttcagactggtattcttcaaaagactcaagtagacttctacgtatatttctagtattctttttttggcttagctccatctctacaatttctaaccaccttggcctctctgaactccaatatccatctcctctactcagtgagattgctgggctctgtttggattcccccttcctacaccacagtccagggattacttccaggtagaaagcctgggtgaaagtagggttcacctcattcgtatcctctgtctttcaggaatcagtatcttgtactgtttattgtccaatttctgaaaatagatgtttcctgtaatttgttaattttccagttgtctctagagagaaagtaatctcgccctcatggccagaagccgaagtcctttagttatctgccttcattttctctgccttcatttttgaagaatatttttgtaggatttaaattctacatttacagtttttcttttcttctggcttctgttgtttctgatggatattagtcttattattattgtttccctgtatataatgtatcttttcccctctggctacctttataaatttatatttggtattcaaacctttactgtgggctaggcacggtggcccatgcctgtaatcccaacactttgggaagctaaggcaggcagatcacttgaagccaggagtttgagaccagcctggccaacatggtgaaaccccatctctactaaaagtacaaaaagaagcccggtgtggtggcacatgcctgtaatcccagctactcgggtggctgagtcatgagaatcacttgaacctgggaggcagagtatgcagtaagctgagatcacaccactgcactccagcctgggcaacaatgcaagactctgtctcaaaaggaaaaaaaaaaaaacagagagaaagaacatcgactgtaatatgcctcagtgtacatttgtttgtatttatcctatgtgggattccctaacttcttggatttgtgggttgctaatttttatatacaggttgggtatcacttttttaaaacacttgggaccagaaatgttttggatttcagattttttttcagattttgtaatatttgcaatctggaaattcaaaatctaaaatgctccagtgaacatttcctttgaacatcatatcaggactcaaaaagtttcatattttagaacatttcagattttggattttcagattagggatactcaacctgtgatttggaaaaagtatcagccagtatttctttattttttttttaacttattctccctttcctgttcttctgggactctaattacaaatatgtttgattgatgctgtcctacaagacactgaagtgagcttactatttttttcagtttttttctctccaggctacagtttgtttgatttctattgatcagtcttcaagtttactgattccttagtatacaatctactattcattccatccaatgaattttttttatttcatctcatccaatgatttccttagcttcttttttcttgaaaagattatagattcacagaccattgtaaaggtactacaaagaggtaccatgtactcttcactcagttccccccagtggtaacttcttacatgactatactgcagtaaaaaaaccaggaaattgacattggtacagcagaccttatttaaatttgaccagttttacatgagcccatttgtgtgtgcctgtgtgtgcataggcaattttattatatgtatagattgatgtaactactaccgtcgtcaggatacagcgctgttccattatcacagagaccttccttgtgctacccttttatagccactgctgccttcttttcccctactccatcacgaacccttggcaatcactgacctttcttcatctctatgactttttcatttagacaatgtgatataagtggaatgatacattatgtgagttgttgagattggattttgccctcaggataattcccttgagatccatccaatttgttccatacattaatagttcattcctttttatggatgaatggtattccatggtatagatgtaccataggttgtttaatcatttctccatttgagttgtttccaattttggctattaaaattaaacacttatatacagtttttgtgtggatataagttttcatatctctgggaacaatgcctaggaatgcaaatgctatatcatattgtaagaataggtgtgttgtttttaagaaactaaacagaaaggaaatgactaaagaaaagaagtgctttcttttaattactgtttacataccttatcttttccatccctttaaaaaatgtccctatatcattacatttgaagtgagtttcttgtagacaggatataattggattgtgtttttttttaacctattctgccatctctgtctttccaatggtgtgtttaggcgatttacttttaatgtagttattgatatgttagggcttaagtctgccattttatttaaacagtatgttttctgtttgttccctctaattttttttttatactttaagttctgggagacatgcagaacgtgcaggttggttacataggtgtacacgtgccatggtggttgccgcacccatcaactcatcatctacattaggtatttctcctaatgctctccctcccctaggcccccaaccccaacaggacccagtgtgtgatgttcccctccctgtgtccatgtgttctcattgttcaactcccacttatgactgagaacatgcggtgtttggtttctgttcctatgttagttttctgagaatgatggtttccagcttcatccatgtccctgcaaaggacatgaactcatccttttttatggctgcatagtattccatggggtatatgtgccacattttctttatccagtctatcattgatgggcatttgcactggttccaagactttcctattgtgaatagtactgcaataaacatctacaaacctatgtgttcatgtgtctttatagtagaatgatttataatcctttgggtatatacccagtaatgggactgctgggtcaaatggtatttctggttctagatccttgaggaatcaccacactgtcttccacaatggttgaacactcccaccaacagtgtgaaaacgttcctatttctccacatcctctccagcatctgttgtttcctgactttttaatgatcgccattctaactggtgtgagatggtacctcattgtggttttgatttgcatttctctaatgaacagtgatgatgagctttttctcatgtttgctggccacataaatgtcttctttagagaagtgtcggttcatatccttcacctactttttgatgtttgttttttccttgtaaatttgtttaagttccttgtagattctagatattagccttttatcagatggatagattgcaaaaattttctcccattctgtaacttgtctgttcactctgatgatagtttctcttgctgtgcagaagctctttagtttaattagatcccatttgtcacttttggcttttgttgccattgcttttggtattttagtcatgaagtctttgcccatgcctatgtcctgaatggtattgcctaggttttcttctagagtttttatgattttaggtcttatgtttaagtctttaatgcatcttgagttaatttttgtatcaggtgtaacaaaggggtccagtttcagttttctgcatatggctagccagttttcccaacaccatttattaaatagggaatctttccccattgcttgtttttgtcaggtttgtcaaaaatcagagggttgtagatatgcagcattatttctgaggcctctgttctgttccattggtctgtatatctgttttggtaccagtaccatgctgttttggttactgtagccttgtagtattgtttgaagtcaggtagtgtaatgcctccagctttgttctttttgcttaggattgtcttggctataagggctcttttttggttccatatgaaatttaaagtagttttttctaattctgtgaagaaagtcaatagtagcttgacagggatagcattgaatctataaattactttgggcagtatggccattttcacaatattgatccttcctatccatgaacatggaatgtttttccatttgtttgtgtcctctcttatttccttgagcagtggtttgtagttctccttgaagaggtcctccacatcccttgtaagttgtattcctaggtattttattctctttgtagcaattgtgaatgggagttcactcatgatttggctctctgtctgttgttgatgtataggaatgcttgtgaattttgcacattgattttgtatcctgagactttgctgaagttgcttatcagctgaaggagatttggggctgagatgatggggttttctaaatatacaatcatgtcttctgaaaacagagacaatttgacttcctctcttcctatttgaataccctttatttctttctcttgcctgattgccctggccagaaattccaatactgtattgaataggagtggtgagagagggcatccttgtcttgtgccagttttcaaagggaatgcttccagcttttgcccattcaatatgatattggctgtcggtttgtcataaatagctcttattattttgagatatgttccatcaatatctagtttatcgagagttcttagcatgaaggggtgttgaattttatcagaggccttttctgcatctattgagataatcatgtggtttttgtcgttggttctgtttatgtgatggattacgtttattgatttgcctatgctgaaccagcgttgcatcccagggatgaaggcaacttgatttggtggataagctttttgatgtgctgctgaatttggtttgccagtattttattgagcatttttgcatagatgttcatcagggatattggcctgaaattttctttttttctgtgtctctaccaggttttggtatcaggatgatgctggcctcataaaatgagttagggcagagtccctctttttctattgtttggaatagtttcagaaggaatggtaccagctcctctttgtacctctggtagaattcggctatgaatccatctggtcttggactgtttttgttggtaggctattaattactgtctcaatttcagaacttgttattggtctattcagggattcgatttcttcctggttttctcttgggagggtgtatgtgtccaggaatttatccattttttttctagattttctaatttattcgtgtagaggtgtttatattattctctgatggtagtttgtatttctgtgggatcagtggtgatatcccctttatcattttttattgtgtctatttgattctcctctcttttcctctttattagtctcttttttattaaactttaagttttagggtacatgtgcacaatgtgcaagttagttacatatgtatacacgtgccatgctggtgtgctgcactcattaactcgtcatttagcattaggtatatctcctaatgctatccctcccccgttcccccaccccgcaacagtccccagagtgtgatgttccccttcctgtgtccacgtgttctcattgttcaattcccacctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttgaacatttgggttggttccaagcctttgctattgtgaatattgccacaataaacatacgtgtgcgtgtgtctttatagcagcatgatttatagtcctttgggtatatacccagtaatgggatggctgggtcaaatggtatttctagttctacatccctggggaatcaccacactgacttccacaagggttgaactagtttacagtcccaccaacagtgtaaaagtgttcctatttctccacatcctctccagcacctgttgtttcctgactttctaatgatcgccattctaactggtgtgagattgtatctcattgtggttttgatttgcatttctctgatggccagtgatggtgagcattttttcatgtgttttttggctgcataaatgtcttcttttgagaagtgtctgttcatatccttcacccactttttgatggggttgtttatttttttcttgtaaatttgtttgagttcattgtagattctggatattagccctttgtcagatgagcaggttgtgaaaattttctcccattttgtaggttgactgttcactctgatggtagtttctttttgctgtgcagaagctctttagtttaattagatcccatttatcaattttggcttttgttgccattgcttttggtgttttagacatgaagtccttgcccatgcctatgtcctgaatggtaatgcctaggttttcctctagggtttttatggttttagctctaacatttaagtctttaatccatcttgaattaatttttgtataaggtgtaaggaagggatccagtttcagctttctacatatggttagccagtttttccagcaccatttattaaatagggaatcctttccccattgcttgtttttgtcaggtttgtcaaagatcagatagttgtagatatgcggcattatttctaagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaggaaagtcattggtagcttgatggggatggcattgaatctgtaaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgcacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggtgttgaattatgtcaaaggccttttctgcatctattgagataatcatgtggtttttgtctttggttctgtttatatgctggattacatttattgatttatgtatattgaaccagtgttgcatcccagggatgaagcccacttgatcatggtggataagctttttgatgtgctgctggattcggtttgccggtattttattgaggatttttgcatcaatgttcatcaaggatattggtctaaaattctcttttttggttgtgtctctgctgggctttggtatcaggatgatgctggcctcataaaatgagttagggaggattccctctttttctattgattggaatagtttcagaaggaatggtaccagctcctccttgtacctctggtggaattcagctgtgaatccatctggtcctggactctttttggttggtaagctattgattattgccacaatttcagagcctcttattggtctattcagagattcaacttcttcctggtttagtcttgggagggtgtatgtgttgaggaatttatccatttcttctagattttctagtttatttgcatagaggtgtttgtagtattctctgatggtagtttgtatttctgtgtgatcggtggtgatatcccctttatcattttttattgcatctatttgattcttctctcttttcttctttattagtcttgctagcggtctatcaattttgttgatcctttcaaaaaaccagctcctggattcattaattttttgaagggttttttgtgtctgtatttccttcagttctgctctgattttagttatttcttgccttctgctagcttttgaatgtgtttgctcttgcttttctagttcttttaattgtgatgttagggtgtcaattttggatctttcctactttctcttgtgggcatttagtgctataaatttccctctacacactgctttgaatgtgtcccagagattctggtatgttgtgtctctgttctccttggtttcaaagaacatctttatttctgccttcatttcgttatgtacccagtagtcattcaggagcaggttgttcagtttccatgtagttgagcggttttgagtgagtttcttaatcctgagttctagtttgattgcattgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtgtgcttggtggagagctgagttcattcctgggtatccttgttaactttctgtctcgctgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgtttgatcagagactaggattgcaacccctgcctttttttgttttccatttgcttggtagatcttcctccatccttttattttgagcctatgtgtgtctctgcatgtaagatgggtttcctgaatacagcacactgatgggtcttgattctttatccaatttgccagtctgtgtcttttaattggagcattgagtccatttacatttaaagttaatattgttatgtgtgaatttgatcctgtcattatgatgttagctggttattttgctcgttagttgatgcagtttcttcctagccttgatgatctttacaatttggcatgatttcgcagtagctggcaccagttgttcttttccatgtttagtgcttccttcaggagctcttttagggcaggcctggtggtgataaaatctctcagcatttgcttgtctgtaaaggattttgtttctccttcacttatgaagcttagtttggctggatatgaaattctgggttgaaaattcttttctttaagaatgttgaatgttggcccctactctcttctggcttgtagagtttctgccgagagatccgctgttagtctgatgggcttccctttgtgggtaacccgacctttctctctggctgcccttaacattttttccttcatttcaactttggtgaatctgacaattacgtgtcttggagttgctcttctcgaggagcatctttgtggtgttctctgtatttcctgaatctgaatgttggcctgccttactagattggggaagttctcctggataatatcctgaagagtgttttccaacttggttccattctccccgtcactttcaggtacaccaatcagacgtagatttggtcttttcacatagtcccatatttcttggaggcttttttcatttctttttattcttttttctctaaacttcccttctcacttcatttcattcatttgatcttccatcactgataccctttcttccagttgatcgcatcggctcctgaggcttctgcattcttcacatagttctcgagccttggctttcagctccatcagctcctttaaacacttctctgtattggttattctagttatacattcgtctaaatttttttcaaagtttttaacttctttgcctttggtttgaatttcctcctgtagctgggagtagtttgatcgtctgaagccttcttctctcaactcttcaaagtcattctccatccagctttgttcctttgctggtgagaaactgtgttcctttggaggaggagaggcactctgctttttagagtttccagtttttctgttgttttttccccatctttgtggttttatctacttttggtctttgatgatggtgatgtaaagatgggtttttggtgtggatgtcctttctgtttgttagttttcctcctaacagacaggaccctcagctgcaggtctgttggagtttgctagaggtccactccagaccctgtttgcctgggtaccagcagcggtggctgcagaagagtggattttcgtgaaccacgaatgctgctgtctgatcgttcctctggaagttttgtctcagaggagtacccggccgtgtgaggtgtcagtctgcccctacttggaggtccctcccagttaggctgctcgggtgtcaggggtcagggacccacttgaggaggcagtctgcctgttctcagatctccagctgcatgctgggagaaccactgctctcttcaaagctgtcacacagggacatttaagtctgcagaggttactgctatctttttgtttgtctgtgccctgcccccggaggtggagcctacagaggcaggcaggcctccttgagctgtggtgggctccacccagttcgagcttcccgactgctttgtttacctaagcaagcctgggcaatggcgggcgcccctccctcagcctcgctgccgccttgcagtttgaactcagactgctgtgctagcgatcagcaagactccgtgggcgtaggacccccccaagccaggtgcgggatataatgtcctggtgcgccgttttttaagcccatcggaaaagcgcagtattagggtgggaatgacccgattttccaggtgctgtctgtcacccctttctttgagtaggaaagggaactccctgaccccttgtgcttcccaagtgaggcaatgcctcgccctgcttcggctcacgcacagtgtgcttcacccactgtcctgtgcccactgtctggcactccctagtgagatggacccggtacctcagatagaaatgcagaaatcacccgtcttctgcgtcgctcacgctctttattagtcttgctagcggtatatctattttgttgatttttcaaaaaaccagctcatggattcattgatttttttttgaagggttttttgtgtctctatctccttcagttctgctctgatcttagttatttcttgtcttctgctagcttttgaatttgtttactcttgcttctctagttgttttaattgtgatgttagggtgtcgattttagatctctcctgctttctgttgtgggcacttagtgctataaatttccctctaaacactgctttagctgtgtcccagagattctggtacattgtatctttgttctcattggtttcaaagaccttatttatttctgccttcattttgttatgtacccagtagtcattcaggagcaggttgttcagtttccatgtagttgtgtggtattgagtgagtttcttaatcctgagttgtaatttgattgtgctgtagtctgagagactgtttgttatgatttccgttcttttgcatttgctgaggagtgttttacttccaattatgtggtcaattttggaataagtgcaatgtggtgctgagaagaatgtgtattctgttgatttgtggtggagagctctgtagatgtctattagatccacttggtccagagttgagttcaagtcctgaatatccttgttaattttctgtcttgttgatctgtctaatactgacagtggggtgttaaagtctcccacttttattgtgtgggagtctaaatctctttttaggtctctaagaacttgctttatgaatctgggtgctcctgtattgggtgcacatatatttaggatagttagctcttctttttgcattgatccctttaccattatgtaatgcccttctttgtctttttagattgttgttggtttaaagtctgttttatcagagactaggattgcaacccctgctttttttttttttttttttgctttccatttgcttgtaaatattcatccatccctttattttgagcctatgtgtgtctttgcacgtgagatgggcctcctgaatacagcacaccaatgggtcttgactctttatccagtttgccagtctttgtcttttaattggggcatttagcccacttacatttaaagttaatattgttatgtgtgaatttgatcctgtcattatgatgctagctggttattgtgaccattaattgatgcagtttgttcatagtatcaatggtctttacaatttggtatgtttttgcagtggctggtactggttttttctttccatatttagtgcttccttcaggagctcttgtaaggcatgcctggtggtgacaaaatctctcagcatttgcctgtccataagggattttatttctcctttgcttatgaaccttagtttggctggatatgaaattctgggttgaaaattcttttctttaagaatgttgaatattggcccccactctcttctggcttgtagagttttgcagagaggtctgctgttagtctgatgggcttccctttgtgggtaacccgacctttctctctggctgcccttaacaatttttccttcatttcaatcttggtgaatctaacaattatgtgtcttggggttgctcttctcgaggagtatctttgtggtgttctctgtatttcctgaatttgaatgttggcctgtcttgctatgttggggaagttctcctggataatatcctgaaaagtgttttccaacttggttccattctccctgtcactttcaggtacaccaaacaaacatagatttggtcttttcacatagtcctttatttcttggaggctttgttgattccttttcaatcttttttctctaatcttgtcttcacacttcatttcattaagttgatcttcaatctctgatatcctgtcttccacttgatccgttcagctattgatacttgtgtatgcttcacgaaattctcgtgctgtgtttttcagctccatcaggtcatttatgttcttctctaaactggttattctagttagcaattcctctaacctgttttcagggttcttagcttccttgcattgggttagaacatgctcctttagcttggaggagtttgttattacccaccttctgaagcctacttttgtcaattcatcaaactcattcttgtgatcctttggaggagaagaggcattctggttttttgaattctcagcctttttacactggtttttcctcatcttcgttgatttatctacctttggtctttgatgttggtgacctttggatggggtttatgtgtggacgtcctttttgttggtgttggtgctattcctttctgtttgttagttttccttctaacagtcaggcctctctgctgcaggtgtgctggagtttgctggaggtccactccagacgctgtttgcctgggtatcaccagcggaggctgcaaaacagcaaagattgttgcttgttccttcctctggaagctttgtcccagaggggcccctgccagatgccagccggagttctcctgtatgagatgtctgttgacccctgctgggaggtatcttccattcaggaggcacaggggtcagggacccacttgaggaggcagtctgacccttagcagagctcgagcactgtgttgggagacccactgctctgttcagagccagcaggcaggaacgtttaagtctgctgaagctgcacccacagccgccccttcacccaggtgctctgtcccatggagatgggagttttctccgtaagcccctgactggggctgctgcctttctttcagagatgccctgcccagagaggaggaatctagagaggcagtctgggtacagcggctttgcagagctgtggtggtctccacccagttcaaacttcccagaggcttcgtttacactgtgagtggaaaaccgcctactcaagcctcagtaatggtggacacccctcaccccaccaagctcaagcatctgaggtcatcttcagactgctgtgctggcagcgagaatttcaagcttgtggctcttagattgctgggctctgtggggatgggatccactgagctagaccacttggctccctgacttcagcccccttttcaggggagtgaagagttctgtcttgctggcattccaggtgccactggagtatgaaaaaaaaaactcctgaagctagctcagtgtctgcccaaacggcagcccagttttgtgcttgaaacccaggtccctggtggtgtaggcacctgagggaatctcctggtctgtgggttgtgaagtccatgggaaaagtgtagtatctgggccataatgcaccattcctcacggcacagtccctcatggcttcccttggctaggagagggagttccccaaccccttccacttcccaggtgaggcaacaccccaccctgcttcagctcaccctccgtgggctgcacccactgtctagccagtcccattgagatgagccaggtacctcagttggaaatgcagaaatcacccaccttctgcgttgatcatgctgggagctgcagaccagagctgttcttgttcagccatcttgccagctacctgttccctctatttttttctagtgccttcatgtgggttacttgggcatttttaaagaattttattttttatttatctatagtattcttaagtgtatcaatttgtatagtttgttaattgttactttaggtattagattatacatgtataatttatcacagtctactagtatcaacatttcacctctttgagtaaagaaaccttacctccctttatgtttctgtaccttcctccctttatagtacatcttaaatgtgtcctctacacatatcaataatcacatcagtcttatagtttttgtttcaatcatcaaacataatttagaaaggttaagaggataaggaaagtctgttttatttacccatattttaactctttctgttgtccttccttccttccttccttccttcctgatgctcttttttttcttttatcatttcctttctgtttagagaacttactttttctattcttataggttagatctgctgataagttcttttcgtcttccttcatctgagaatgtcttgatttccctttcactcctgaaggatattttcactgggtatagaattgggtatagaattgtctggactgacaattcttttctttccgcacttaaaaaatatgccacttccctctgacctccatggtttttaatgagaaatccactgtcatttaaattattattctcatgtgtaatgcatcatttctctctagctgctttccagatttgttctttgtctttatttttcagacatttgattattatttttattggagtggatttccttgggtttatcatgtttagggctcattcagcttcttgaatctgtaggattatgtctttcataaaatttggggaagtttcagccatttctttgaatattttttagtgccactttctttctcattctgggactctgaagacaaatatgtttgatcttttcttgtcacacaggaccctgagactctgttcattttttttttcagtttcttttctctccattgtctagattgggtgattgctgttgctctgttttcacgttcactaatttttttttctttgttgagacagagtctcactccatcacccaggctggagtgcagtggcacaatcttggctcactgcaacctccaccacccatgttcaagtgattctcgtgcttcagcctcccaagtagctgggattataggcatgtgccaccatgcctggcttatttttgtatttttagtagagacaggatttcaccatgttggccatgctggtcttgaactcctgacctcaagcgatctgcctgcctcagcctcccaacatgctgggattacaggtgtgagccactgtgcctagccaggttcactgatcttttctgtgtcatctccattcttctatttagcccatccagtgagttttttattttggttgttgtatttttcagctctaaatttttcatttggtttttcattatgttttctatttctttgctaatactttctctttttttcattgtgtttctagtgtgcttataattgctcattgaaacactttcatgatggctgccttaaagctcttgtcaggtgattccaacgtgtgtcatcttggtgttgacatttgttgtctgttctcattcaaattgatatttttctgattcttggtataattaaggaatttttattgggacctgtagattttaggtcttttgagactctggtgaccttgaactctgtgctcttacgcttcaggctaaaaagcctatagctttctgcctgagctctaccagccatcacacaaaatacacgtaaatgtgactctcacccagtgtggttcccttctttcagggattgaattccctctacttctgcctgattttgattattctccaatacccttaaacaatttatcataaaggttagtctgatagaaattattccaccattaccagaagccagaagtcaagacttactgttcattatattccttctggtaccttttgaaatttttaccatgtgtatatgacatcttaaaagaatgtaaacacatttttgtaactaaaactttaaaaatgaaataaatatatttatcagacagacctacttttattgaccagctctagggaaggatcatagtaacaaaatgtactaggcaagttgagcaaatcatttaaccagtgtccctcagttttctcacccataaaatggagattaatgtgagtattaaatgtgttggtctaagtaaagtgtttagaatggtggctgacatatagtaagcactcaataaattttagatatcattaatattattgttaattgttaataaatattggtaaaaatatcacagccagggacctattacctcttagtccctaaatgctgacagtttagtacccagtgagtgcctaataagtgtagaaactgagtatggtgctgtattaggtactatgtgattttagcctcacagctcttgctaataatactgacagctcatggaacaaaacattgaaaaatatcaaaattaaatattatcatatatgaatgaaggtgagtatgagcaaaaacaatagaaattgtatatttgagttttatatttagataaagtcatagtaccaggcattcagcaaactatcttcctactgtagaaaatgcttcatataggtaggatttaggaactctttaaatacaaaaggaacttaacatttatgaagcaccaattatatccctagtgtatatatgctaggttctttacatatattatctcatatatgtctgtcagcaaccctgggaagtaggcattataccccatttaccaatgagaaaagtaagactcagaaagtaacttgcccaggatcaactagtaaagtagtagagtcaggattccatcccaaacctgtgtgatttctgggcttatcctcttttccttactttcagcagggtccgggattttggtttaaggaatacatgagagaaaagtaaacatttattaaacatctactgctgccagacattgtgccacatgcattagtttatttagttctcaaagcattattgtattcaattctcacaaaaatcctatgagaaagaaaagaattaacatttattgagcacatgcgatgtgcctaacacttcagtgaggcttatgtaagttaccttacatggtctcctaacaacccaatgaaactggtataatcctgacaaccaggaagaggccaagctaagctttcaccacacttagctgccttgcaaggccattctaaaggacaacctccaggacacatgtttctaaacattttgcagaacatgcattccacaaaatgacatttttaaaagtacagtccagaagcacaaggtttctccaaacaagtggtttctcatcttttgggtggccatggacccctttgagaatctcacagctcctcctcccagataagtacttatatacacacgatattgggtataatttcagaccattcagcaatctcttaaagcacatcaatggactctgttcaaaacagaaacttgctctaaagaacagaagtaaatcttagaaaacaagagagcttattaatccttcattattcagttttaaaaatcctctagaacactaacacccatatttgaccattctattatgtttcacaaagtagatagtactcctgtttctcttttggtttttcagcacaagcactattggcttttctggtagtataattctttttttgttgagtagggggactgttctatgcattataggatgctgagcagcatccttggcctctatgcgctagatgccagtagaacactccctacttcccctctccagttttgacaaccaagaatgtcttcagacattgccagatattctggggagcagggcaaaattgcccctgttgagaacaactggtttatatacttacaatcatcacacatgagacactcacaagtataaagggcctaagaaccaacatttcttgaagtatatccttttcttgcttgattaaagtctcctacaaaactgctcaactgggttgagcaagatgaattcgtctcaacaattaaattactagctgaatatgtaaattgttgttacctaaaaggccaaaaataaagtttatatagcccctctgctttattgattggatgtttgacttatcaagtcattcagtcattcagtgactatttattgaatactaacaatgtgccagacactgccaagtgctggggctacaatggtgaacagtgtagatgtggtccccatgccatggaacttataatccagtaagaaaggtgcactaaaaaacacgcaaaacataagtcaaaagaattttaacctgtaataagtgccataaaggaagcatatggggagtggagatagaaactatcaaagggatttaaatcaggtctctaagaaaggcctttctgaaggtgtgacatttaaggccagaacttcaggggtaagaaagactcagccaggtgaaaaaaaaaaaaataactaaagggcaagtgttccaggcagagtaggcaaccatgtacaaagatgctgaggtaagaaagagctcagtgtattctgggtgctgaaaggaggccactgtgactaaggctaatgagtgaaggataagaggtaagagatggaatgggccgggaccagaccctcaggggcccctgtagaccacggtgaagagagtgggatcttattcttagagtcagaagccactgaaggcttttaacaggagaggtaccaggatgtgatgtgtgttttaaaactactctgagccaggcatagtggctcatgcctgtaatcccaacactttgggaggtcaaggcaagaggatttcttgagcccaggagtttgagattagcctgggtaacatagtgagaccctgtctccacaaaaaaaaaataaaaaattaattgggtgaggtggtacatgcctgtagtcctagctaatcaagaggatggggaaggagaatcacttgagcccaggagtttgaggctgcagtgagctatgatcatgccgctgcactccagcacaatgattaatatcatgaactcagacccaatctgtgtgtgtttatatcctccaggctctgccacttatcagccgtgtgacattgggcaaatgccttcacctctctaagcctcgattgtttgaggattaaatatacttgtaatacatataaagcccttagtatagtggctgataaatgcttagtaagtattagctaatatttatggaaagaaaaccagatgtcaaaagtttaaaagatggagagaatgctgagatgtgtcagatgcacctaagagttccaataagctaaggacttattcattagatttggcaacatggaagccattgttgaccttgatgagaggaacttcaacaaagtggaggggcagaagccagataataatagattgattggtgaatagacggtaaagaaaatggcagcaacaggtaggactaactttttcaagaagcttgttgtttaagaaaaaaaatcacaatcaagtgaaaaaaaaaagaaggatgtacaagaatgttcaccttagccttgtttatgataacaaaaaagtggaactgtcctaaatgtccaagaatgaggggatgacaggtcaacagagagggttggggaaagtggtatatgttagaacagtaattcagcagcatgggagaggaagctgaccagagacaagtaaaaggataaacaagaaacctgcaagtgcatgtgaagttggaaaccatggattttggcccatgatactcgtctgtccagtgatacagttttcttcagtagtgacagaacagagaaggcacgttgcgggaggtggtgttgacttggagtggtgatttttccaggtaggtggggcaaaaggtgatgaaggtgatggagaaagagggttcaagtgtgtaatcatgtggtctaggctggttgtgaggccaaaagacagcagacaaacagggagaaggcagggatcaggggattgggtgtctacacgaggtcagaagagcagagatagtggggtgaagagacttggtaggactagcacttggactcagtgtaagacaatagaggcagcgaagtagaaagggcacatgcttttgaaatcaaacacatttgaatttgaattacagctctaatattagttatgtgactttaggtaacttctttgaactctgcgaacttcggtttcttcatctgtaaagtaagtataatgacacctgagtcacagaaaaactaacacatggtcagcttcaatagctgttagtccccttctctcccactcaacatttattgggctcttaatatgaaacattctattttggggacactgagataaaggccaatttacttccttttagtgattcatggtttagcacaagggacacaaagaaataaatggcaatacaagataaacagataaactagtgttcaagttgctaagtacaataatagcagtatgtgctatgagaacccagaagaggtatgactaatagtgcctgagagagtgagggaggctttcctgtaaagctattgacaacccaatttttagtttctaacgctgaaagaaactagtgggaaatgagcagataacattttaaggggaacagcaaagaagcttttgcttttatttttctagacggcgtttcaaggagcaataggttcacaagaaggtgtttatttgttttaaggaaaatgacttgtgatggtttgttaactgaggagaagaaatacataattaaatgagaaatgtctaaggtgattgagagaaaaggaaataatcaagagttcaaggttctagagaaggaggcaagaggaggtaaaatccggagcctacgccaagggtttgctcctggatagtatgcagaataaccctttctctaaaatgagaggaaaaaagaaaagaagaaaagtagacatagatatttacatccaaaaggaggaaagaagtcaatgtctggaaattgcattttatctgtatacaatttttcttgatttttagaaaccaagaatatttccttaatacattcacaagaaatgagagcagcctgtttagggaactgattcctacaactggtggagctgccaaatgttggtgaaatggaggcaacagaaataaagagcttccaagccctcatttctgcacctggaagaggtggttctgattgctgcagcagcaggcaactgtgacagggagcagcaacctcctctcagttgctttcaccttgagttcttaaatcgttgctagataagcctcttttgcccactccaatcttcttttgctccagtccacacacacacactctatgaagaaattttccaacctgaattttgcccactgatgaatagaattggcagcccacaaggcagctgtgctggcttaaaggacccagtagcatttggctgcattattctctgtcctgacctttgcagccagcacctccccatttctgggagaatatcccacagtcacttctcactggcgtgcacctccaggaaatacaccttctgaaatgtgggtttctggcattggtatggagatagcatcgctgcctagcccaatagcaaaagatagactcgggcactgggaatttaccggctgctttaggcctaatacctcgtcaagttgcaccatttgataaaatcagaggaattaattaaaaaccatattagaaaccttcatataattgctgatttcctgcttatgctctaagcacatgccaaggtagcaaaatgtacagattgaaactggatttcttgtccttttaccattaatgtaaaacatgtctatatttcctgctaggtcacccattggccttataaactttttttataaccaggaaagatactccaagggagaaagagtatccctgtaaggaaatagggtttcttccaaggcaaggaagaaaataatatttccttagaggagtacaacaggacaagggcacaggaaggtgaggagactctgcctcttcaaaggaaattagcagaatgcatggaaaagaagcaaaaaaaaaaaaaaaaagaaagaaagaaaggaatcaaacatttattgagcacctactatttaccaggtactttactagttgctttcacaggacttatttcatttaatcctacaataaccttgtgaggaacttatctacgtccataggagagaaaattatgtctcaaagaggttaactggttggcctaaggtcccacagctaccaagtgagtaggataggagagcaagggaagagcagtgaagatgcttggacaagagaggagatctttgtcatttccattttgaaactagagaactggtttcctttaagactcattgtatcagcaggcagtgcttttctattcctggagtgaccttagactggaaggttaattgtcatttttaaaaaggggctagcattctttcctcaccttcagtactcctctcttacctctatgctcattctcttaaatcctccaagctaatctttcagaccactcacttcctcaattaattagaatacatcctctgttctttctactcccttgttggttcattagttcaaacaacaatcatgtattaaatgactactatgtgtcagcattctgccaggcaccaggaaagcaaaagtaaaaaccctattcctgctttggaaagattcataatcggcagggcgcggtggctcacacctgtaatcccagcactttgggaggccgaggcaggcggatcacgaggtcaggagttcgagaccggcctgaccaacgtggtgaaaccccgtctctactgaaaatacaaaaattagccaggtgtggtggcgcatgcctgtaatcccggctactcaggaggctgaggcaggagaatcgcgtgaacctgggaggcggaggttgcagtgagcggagattgcgccactgcactccagcctgggtgacagagcgagactccgtctcaaaaaaaaaagaaggattcataatctaaaggggggccagagacatggaatcattggtttaaatcctattgcaaagggcagtggcagatccaggatttgtaggcctgagcttatgcaattgtacaggcaaggacagggaactatttaagaaaaagaacataaaattttgaatataaaattaggtgcaagttgaaagatattacaaacctcacaaaattcaaaacaattttaacatgtcttattacttaaatgcatgacacatctatagtacttttttcctacatttttttggctgcatgtgctctaatcacctttcatttgaccatgattttgtaatgtcattttcttttttttttaattttattattattatactttaagttttagggtacatgtgcacaatgtgcaggttagttacatatgtatacatgtgccatgttggtgtgctgcacacattaactcgtcatttagcattaggtatatctcctaatgctatccctccccccccccaccccacaacaggccccagagtgtgatgttccccttcctgtgtccatgtgttctcactgttcggttcccacctatgagtgagaacatgcggtgtttggttttatgtccttgagatagtttgctgagaatgatggtttccagcttcatccatgtccctacaaaggacatgaattcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcaggatgatttataatccttagaatatatacccagtaatgggatggctgggtcaaatggtatgtaatgtcattttctatgtaaagaatagaaagataattcaatggatcccctagcatgtttgatcaaaatgtatttcttattattgatacgtggtatagtaatctattcaggcttccaaaacaaaataccccaggctggagggcttaaacaacagaaatttatttctcacaattctggagactggaagtaccagataaaggtctggcagcgttcacagtttctggtgagggctcgcttccttctctgtatgtcttcacatggcctttccacttaatgtgtgcagagagagagaagaaaatctctctctcttcctcttcttataaggccacccatcctattaaattaggaccccacccccattacctcatttagtctaaattacctcctaaaggctctatctccaagtatagtcacagtgggggttagggcttcaacatatgaattccgggataacacagttcagtctagtagatgggatgcataaaacttgtgactgcatacacagccatactcactgtttataatactgctaggaggtttggacccttcaaaaacaggaattatgataaatgccattttgcacaacttttatgaaaaaagaaaaaatacagtttgtatatactcatatatgctacactattgactctgttttttaaaggagaaaattttattttgactaggcattgttaaaaaccaaatcctccacttaaaattttaatatgctcattggaagaattttacacaaactttgaactctgtacatttcaaattttgtttctcctctactatccaatgtatctaaccccagatgctataggacacatttatatcatgatgctacctctggctctgtcctttttgtgtaaggatgctggatgagtaaacaccttaggttataggaccattcctgaagccattcctacaccattagcagtaagttaactatacacaataagtgattgcaagccacataaatgtatctctctaaacccaaactaaatgtatcctcacctcaacttcctcttcgccattccagttacactcaaaacaagggagaagtctgatggaaaagtcagactggaaagagagagctgtcttaaatgaatgtggttaaataccttactttgaaaattaggggaaaaatataaccttgtaaaaaaccagtggtggtacccctccctggaccttgagagggatctgtccagtgaggggctttgaagatttatgattagcttcatggtgaatcagcttctaaggaaagatatgtgcaggttgtctcaaacaatcagggaacacgtcacaaaggaggtaatatttgagctaaatctttaaaagtactcaagaggaaggacatttcagaaaggaacattgcatgtgcaatgctctagagggaacacagggtcttgtagaattgtaaatagtttactatgtctgtaggggcatctaaggggatgggggggaaatgaagcagcagaggttgacctgcaactgaaagacatcagactcttggaaatccatagaaacctctgttttcatcttttcttgagctaccttaaatgatctgacacttattaggaagtagttagtttatctgttattgtgggtgtgatagaaaaactagatggaaaatcagtaaagataaagaataattcaacaacaccatcaaccaagagaatctcattgacacttacagaacattccaccaaataacaacagaatccacattcttttaaagcacccatggaacataccaagatagaccacagcagaaaatggtggagtaggcaaccacaagctcctgttaccccacagaaacacaggaaaataagcagaaactgtcagaaacaactttgtcagaacagaactctagaaaacaatcaaaggtttacagcaactgagcaaatgccaaatcaaaaaaaaagtcaacttaaaacttattagaaaccacaatgagataccacttcacacccattaggttgtctattattaaaaaatggaaaataaaaagtgttgtcaaggatgtggagaaattggaactctgctttgctggtggggatgtaaaatggtgcagctgctatggaaaataggttggcagttcctcaaaaagttaaacatagaattaccatatgatcccacaaatctacttctagatatatagccaaaagaatcaaaagtgggtactggtatatcaatgttaactatagcattatgcaaaataaaatagtcaaaaggtgtaaacaacccaaataaccatcaacagatgaatggacaaaatattgtatagctatataaggaaatattattcagccttaaaatggaataatattctgatacatgcaacaacatgaatgaacctcaaaaacattattctaagtaaaataagccagatgaaaagggacaaatattgtatgatttcacctacatgaaatatttacaataggcaaagtcatagagacagaaagtggtttagaggttaccaggggcttggagaagtgggggttggggagttatttattaatgggtgtagaatttctgtttgagatcatgaaaaagttctggaagtggataacggtaatggttgtgcagtgttatgaaaatacttaataccactgaactgtacactttaaaatggtttttaaaaatttcaacaaggagttggaagatatagatgaagaaatctctaagaaaacagaatttgaaaatagggaaatgagaaataggaaagataaaagacaagaaaattatagtcaacagatgaggtccaatagccaataagaattcctgaaaaagaaaagagaagaaaaatatggctaggaaattatcaaagaaataattaaagaaaatctgtccaaatcctgaggatacaactttccagactgacagggcccactggttgcccaacattatgaaggaaaaaagatccaaagacattatcatcataaaactttacaacaaaggagaaaaaaagctatcctaaaaggtaaacagttgtaaggagaaaaattgaagatcacataaaaagcttcaagaatcagaatggcattggacttctccacaacaatattgaatacttcaagacattggaggagttcctttaacattgtaaaggaaaaattatttcaaccttgagttctatacccagccaagctaccaagcaattggaaagatcaaatacagatattttcagacatgccaaggtcaggaaacttggagtagatgtccaccagaatgaagataataagccaggaaagagaaagacatgggacacaggaaacagatgctccaatgcaggagagaacagcagagatttctcaggatgacagtgaaaggaaactccaagacaccagctctgtagaagggccagaagtcaaacagttcagattggagggctccagagggaagactctcaggtgaatatggaattcacagattgcctggtgtggttgatagtactaagaggactaataattctgtcaaagaatgtagtatgagttagtgataagtacatagaaagctaagcaacatttctaaggtgaggcaactattaattcaaaaaaattgtccaaggaagtaaaagtagtcataatacagtacatagctgagctgtgaacagtatttgttgtcatcataatttaaacattgaatgttaatttagccaaaaattttagaataattaaattgagagaatgagacaaggtgaactgtgcatggatgtgggagattgtggtgagactgaatctagaaggaagttggtagagcatataaaaaattgaaaaacaactagcagccttcctgtgttattcaaacatatggagggaaatactagaagcagcagctaaaagagtggtatgtggctatttctggggagtaaaaattggaaacaggaaagggtgaggtagagaacttctgtgtgtaattgtaagacttggttaatgtttgactttgtaaactatgtgcatgttattaaactactacttggaacaaaattcaaattaaataaaagttcagtgtcagatctaaaggtgcaccatgtaatcctggcctatgtgtgatgcccactaggatgaactgttaaaggaaaaagcatctcagggtaaaattaaaaagattcctttttaaaaaaaagttataattttttaatttaacttttattttaagttcaggggtacatgtgcaggtttgttatataggtaaacttctgtcatgggggtttgttatacagattatttcatcatccacattatattaagcccctgctctggctcagcaacagtattgaagacagcagcctgtgtttgcagtgtgggaccctggaccatggttccagggggaacacagcagaccttattcaaaaattattgtgtaggtctgctctaacctgtcagagggctatctaaatgacagatgtaaagaacttatctctgttgcacctaactcagaactcacccaagccagaaaattaccaggcattgctcaaaaaccctaagatggatgaacaacccagatgcctgaggcaaagggttacagttgaggcttacaagagacaacctaaggcctgagaagaaaagccatagggagagcttctttgggaaattagggcaaacaaaagtatccatgtatacgggaaaatatagaaaaatatgtgaataaattgccagggaaacttgcatgttcaggaaagacttgagaggaccttaaagactgggagaggtgttttacttgtctggattttttttttagctcctggcattcaaggatagcaattcactagaggcttcaggcacaagacagaatcagtgcacttggaagataggataattgaaatgaaccaatctgagggacaggaaaaaaaagaacgaagaataattagcagagcctaagggacctgtgggacaccatcaagtggtccaacatacacattatgggagtaacagaaaaaagagaagaggttatgaaagggatagaaagaatttttaaataaataatgaccaaaaacttcccaaatttgatgaaaagcattgaacataaggatccaagaggcttaatgaactccaagtagaataataactccaagtagaatagacccacatcaagagacattataatcaaactgttgacaaagacaaagagagaatcttgaaagcagcaagagagaaacaactcatcacatacaagggattctcaataaggttcataactgatttcttatctgagaccatggaggccagaatacaatgggatgacatatttaaagttctgaaagaaaaacactgtaaaacaagaattctatatccagcaaaactgcacttcaaacttgagtgaaaatgtaagacattctcagataaacaaaagctgagggagtctattaccactaatcctatcctagaagaagtactaaaaggagtccttctggttgaagtgaaaggacactagactgtaaatcgaagctatatgaaggaataaagatctccagtaaagaaatctacatgggcaaacataaaagcaagtcttattaatttttggtctgtaacttgactctttattttctgcatgattaaaaagacaaatacataaaaattataaatctatgttactgggcacacagtgtataaatatatgatctgtgacaacaacaacataaagaaagcagtggaactgaataatagcagagttttcatgtgctattaaagttggtacatgggtagagttggaagccattatcctcagcttactaatacaagaacagaaaaccaaacaccacatgttctcacttttttccccaacacgtggacacatggaggggaacaacacacactggagcctgtcgggagggggttggggaagggagagcatcaaaaagaaagctaatagattcaggcttaacacctaggtgatgggatgacctgtgcagcagaccagcatggcagacgtttacctgtgtaacaaacctccacatgtacacctgagcttaaaataaaagttgaagaaacattttaaaaattaaaaaaaaaaagttggtatcaattcaaactagattgtaataagcttaggatattgattgtaatcccatggtaaccacaaaaatatgtttaaaatgtaccaatggaaatgagaagagatccaaaatggttcactacagataattaactaaatacaaaataagacagtaatggaggaaatgagggacacaaataggtataagataaagagggaacaaaacgaaaaattgcaaaaatccatccttatcagtaaacaaattaaatgtaaatagatgaaagtgaccaatcaaaaggcagagattggcagaatgaatttaaaaaaaaaacataatccaactacatgcaatttattagagacccagtttagatccaaaggtgcaattaggttgaaagtgaaagagttggaaaaaatattttattcaagtggtaaccaaaaagaggtggggtggcttactaatatcaccctcagtcaacaaatgttataaaagtcaaagtcagacgttatgtactgatcaattgattgagacggtataacaatcataaacacatatacaccaaacaacagagccttaaaatatatgaagcaaacgctgaaaaaattgaagagagaaatagttgtacaataataggtacagagaataatagtacagagaatcaaagccaaaatttgtttctttgaaaagatcaatgaaattgacaaaccttgagctagactgacaaagaaaaaagaaagatgcaaataactaaaatcagaaattaaagtggggacattactgtcaaccttacagagataaaaattttaaaaaggtttgtaagacaatactattaacaattctatgcttacaaatgagatagcctaggtgaaatgaacaaattcctagaaacaaacaaattacccaaactgactcaggagaaatataaaatgtcaggagatctataacaaataaagagattcaatcagtaatgaaaacttcccaacaaaggaaagccaaggaccagaaactttcactggtgaattctaccagacatttaaagattaacaccaatccttctcaaactcttccaaataactgaagaagcaggaacacttcccagctcattctatgagatcagcattaccataataccaaagccagaaaaaaaatcacaagaaaattacagtgcaatgtatcttatgaatatagacacaaaaatctttcagtaaaatactagcaacccaaatctaaccatatattaacgtcattatacactatgaccaggtgggatttatcccaggaatgcaaagttcatttaacgtaataaaatcgatcaatgaaatgcatcacattaatataacaaagaaaaaaaacacatggttgtctcaaaagatgcagaaaaatatttgacaaaaatcagcaccctttcataataaataagcaatcaaaatattaggaataaagggaagttactcaacatgaaaaagggcatttatgaaaaacctacagctaatgtcatactcaatggtgaatgactgaaaacttttcctctaagatcaagacatgaatattaacttttaccactgctattctatgttgtactggaaggtctatccagagcaactagacaagaaaaatgaataaaaggcatccaaattagaaaggaagaagtaaaaccatcctgtaggttgtcttttcgttttcttgatatgtcttttatagcacaaacattttaaactttgaagtcatatttaccattggttcacactgtaaccagcagcattgcaggttacaatgtcattacacaaaatcagatgtgcttttatctaccaataatgaacaatccaaaagaaaaattttaagtaattgcatttatagtaacatctaatagaataaactcaaccaaggaggtgaaagactagtacactgaaagctacaaaacattgctgaaagaaattaagacctaaataaatggaaagacatctcatgttcattgattggaagacaatattattaaggtgtcaatactacccaaagcagcctccatattcaatgcaatccctatcaaaatcccaacagcccttttgacacgaatggaaaaaccaattctcaaattcatatggacttgcaagaaacccaataaccaaaacattcttgaaaaaggacaaaagttaggagatccaatttcaaaacgtaatacaaagctatagtaatcagaatagcatggtgttggcataaggatagacatataaaccaatggaatagagtcgtaaatcctaaaataaatctctacctctataaccaattgttttttgacaagggtatcaagtccattcaatggggaaggaatcatctcttcaacaaatggtgcttggacaacaggatatccacatgcaaaagaattaagttgcacccctacttcacaccatatacaaaaaaattaactgacaataaatcaacaatctacatataagagctaaaaccataacaatcctagaagaaaacaatgaatgcatgtgtctttatggaagaatgatttctattcctttgagtatatacccaataatgggagtgctgggttgaatggtagttctgttctaagttctttgagaaatcatcataatgctttccataatggttgagctaatttacattcccaccaacagtgtataagcattcccttttctccacaaccttgccagcatctgttattttttgactttttaataacagttattctgactggtataaaatggtatctcactgtggttttgatttgcatttctctaatgattagtgatgtggagcattttttcctatgtttgttagccattagtatgtcttcttttgaaaagtgtctgttcatgtctctgcccactttttaatgggtttgggtgttttttgcttatttgtttaagttccttatagatgcatagtttgcaaatatttcctcccattctgtaagttgtctgtttatttggttgatagtttctattgctgtgcagaaactctttggtttaattaggttccaccttgtcaattttttgttttcattgcaattgcttttggcatctttgtcatgaaatctttgtgtaggcctatgactagaagactactttctaggttctcttctaggatttttatagtgtgaatcttacatttaaatatttaatgcattttgagttaatttttgtatatggtgacagataggggtccaattttattcttctgcaagtagttttcccagcaccacttattgaataagatatgctttccccattgtttatttttgtcaactttgtaaaaaattagttggttgtagttgtgcagctgtatttcaggggtttgtattctgtttcattggtctatatgtctgtttttataccagtaccatgctgttttggttactatatccttgtagtatagtttgaagttggataatgtgatgccttcagcattgttcttttggcttaggattgctttggctattcgggctcctttttggatttacatgaattttagaacagtgtttttataattttgtgaaaaatgacattggcaatttgatagaaatagcattgaaacagtaaattgctttgggcagtatggccattttaaaaatattgagtcttcctatctgagcatggaatgtttttccatttgtttgtgtcatctctgatttctttcagtagtgttttataattctcattgtagaaatctttcacctccctggttagctgtattcctagatattttattccttttgtggctattgtgaataggattgcgtttttgatttggctgtcaacttggacctgttggtgtctagaattgctgctgatttttgtatcttgaagccttgctgacattgtttttcagatgtaggaacttttgagcagagactgtggcgttttctaggtatagaatcatatcatctgcaaacagagatagtttgatctcctttcttcctatttggatgtctcttatttctttatcttgcctgattgctctggctaggacttctagtatgacgttgaataggagcgatgagagtaagcatccttgtcttgttctggttctcaaggggaatgcttccagctttttcccatgaagtagcagaaaagttttgtaaataaatagtgatgatggttgcacagtgttgtaattgtaactaatgtcactgaattgtacacttaaaatggtcacagtagtagagtttatgttttatacattttattacaataatattaaaacaattaaaaattaaagaataaagatgggccatttcatgggtcatcaaataaacctcatcaaatttaaaagacagaaatcatacagtgtgtattttctgaccaaaataaaatcaaacaggaaatcgataaaagaaagataacaggataattgccaaacacttagaaactaaagaatgcacttctaaataatacatggatcaaagaggaaatctcaaggaaaatttttaaaatacactaaacaattaaaatgaaaagacaacgtgtcaaaatatgtaggacacacctaaaacagtgctgagagggaaatttatgacactacattcttaattttaaaaagaggatagtctcagatcaataattaaactgcaaccctaataaaatagaaaaagaagggcaaaataaaaccaaagcaagtagaaggaaggttataataatgaacagaaacaaatgagattgaaaacagaataataataaattcaatgaaacaagaagttggttcttcaaaaacatgaaaaaaatttacaaatctctagtaagagtgaccaaaaaaaaaaaaaaaaaaaaaaaaaaaaaaaaaaaacagagaagacacaaatttccaatatcaggaatgaaatgggatcttaccacagcttccacaggtatcaaagcaatactagcaaaatacagcattctatatacataaacttgaccacttagattaaatggactcattcctcaaaagccacaaactaccacaactcaccaaatacgaaataatttgaatggccccgtagctattaaggaaattgaatttgtaatttaaaaactcctcaataaatgaactctccaagcctagatgatttcactgaagaattctaccaaacatttaaagaaaaattcacaacaattctacacaatctttcagaaaatagaagaggaggaaacacttcccaactcactttattaagctagtattatcctgagaccaaaaccagacaaagatagtaccaaaaaaagaaagaccgtatttctgctctcagctttgacatctgaaagacacagcaggcagcatctcagaagcataaaaaacagaacggaagaaataaaactgtccttatctgcaaataacatgattgtgtacatagaaaatctcaaggaatgtaacaaaaaccttctagaactaataaatgagttcagcaaggttgcaggtcacaatatcaacatacaaaaatcaattctatatactatcaatgaacatatttctatgtactattaacaaacacatggaaaccaaaatttaaaatacaaagccattcacaattggattttaaaaactgaaatatttatgtgtaaatctcacaaaacatgtactggatatgtatgctgaaaactataacactgatcaaagaaatcaaataagatctaactacaaggagagacatactgtggccatagtttggaactcaacatagtaaagatttcagttctctccaaatttatacaggtctgagacaattgctatcagaatcctaacatgattttttgaagatatagacaagattatggtaaaattcatgtgggaaaacagagaaactagaatagctaaaacaattttgtaaaaaaaggataaagcaggaggactcactctaccaattttaagactatgtagctacagtaatcaaaactgtgtggtattggcaaagaaacagacacatcaaaggaacagaagagagatcccagaaatagacccacacaaatacggccaactaaattttgactaaggtccaaaagcaattcaatggaggaaagacagccttttcaataaatagtactgaagcattttgatatctatcagcaaattagtaaatttagtttaagagtaagtagaaattcattatattgtttttgtagcttttctatagatttgaaagttttcaaaataaaaacaattgggaggaaaagacatataaactatattgcagttacattaatttacaatggaagatatacctgtaaggtaaccgaacaatagtctgagctcatgtaaatgcatttctttcccaggatcaaggaacctaggaaactaaaatagaaaatcagaaagttacttgataaacatggagtcagagtgaaggaagtgcaatggtgaagcccatgcatagagaaatctgcttcataattgagcctacagccttaaggaccacaatatttgcatccatcatgtgtatggtctactgggctccttctgctctccagccactgcacaagtggacacacctccctcccccattcctccccacctctctgcacagttaggggtgggaggtgttggacaaacagtaacatatgtttacttcttaattcttctttttcaaataactcatgcaccacctttctttaacacattattcttcacacagtttacagtaaagctgattagattgcaactttcttcaagtacgttctgatcctacagatacaccctgattatcttgattacatttgagatttcctaagtctctatcagtaacacatctacaataatgcctttgtattagttatttcgctctaacaatcattctaagcctagctccaaattctggggtcaccgtactgcagcctagactccgactacacttatttcctttgagttgttttgtcaaggccccatcatagacagactttttttcaacatactgacaatattactgcttctcttggtctctttgccactgctctacaaatgtatttttacaagcagtgtgacccaaagaagatgtaatagattaaatgataaaattacataaaatacatgaaagtgctttgaaaggtaaaagcactgaacaaatgtaaggggttattattgctgtaatttaatgggtaaaaccagtggctgcttcaggccagacctcataggagagcagcacttaccaatagataacccaggccagtccactctatagttttgccactacacatttctctcccattctcagtcccatcatgagatgaggagtctctgggggatgaatccatgcttccaatgtcacagagactgacttataaagcagacctcaagaaggtgatttatcgtaagcaatatcgtattagtccattctcccactgctataaggacatacctgagactgggtaatttataaaggaaagaggtttcattgactcagttccacagggctggtgaggcctcaggaaacttacagtcatagtggaaggggaagcaaacacatccttcttcacacagcagcaggaaggagaagaatgaccaaaggtaggagaaagccccttataaagccatcagatctcgtgagaactgagtatcagaagaatagcatggaggtaaccgcccccatgattcaattacctcccaccaggtccctcccattacacgtggggattatgggaactacaattcaagatgaaatttgggtggagacacagccaaaccatatcaaatatatttggcaagacaaagctttccttatctgcataaggccttccaggctggcaggtcattccagtcaagaaaccagttacacagcttcatccatgtccctacaaaggacatgaactcatcattttttatggctgcatagtattccatggtgtatatgtgccacgtggcgcatgttctcactcataggtgggaattgaacaatgagaacacatggacacaggaaggggaacatcacacaccggggcctgttgtggggtggggggtggggggagggacagcgttaggagagatacttaatgttaaatgatgagttaatgggtgcagcacaccaacatggcacatgtatacatatgtaactaacctgcacgttgtgcacatgtaccctaaaacttaaagtataataataataaaaaaaaaaaccagttacacagaccagaaggctgcttggtaagcacacaattaaaacaaaaggaattggatgttctccagagatttttttaaaaatcaaacctaggtacccgataaacttgctctcctccatactaagaatagttctgactaaagaagtaaagaagccatcatcaagaaatagacaaccctctccatggtcattcctgaagacacactcacatattttcttttgtctacacagctcactttgcccatcatctaaagcatctgtctgtacagggttacctcaagacagtcatgttacaatttcccacatcatagtttatcttaacatttgtaacaatttagtgaggtcgtttcttgataccttaatatctccatttcccaatatataatgggtaccatggcaggcaggacccattgttctctatttcaaaatttgctcatccaacattgccaaaaataaatttatggctcatttcttaaactttttcacccattttccccatctcataaatacccaaagtacattctaagtgcactatcctaaaggccctacccaaagtgcctgtaggatattatcaaaacctagtctgttgctttagtgcagaagtgtgggtgctacctgaaggcagaaaggaatacctataagcttgtacccagtaccaattgtttgggaaccagaaatctaggctgctacatttcaaagggaagtgagaaaattggagcttatgaaagataaatgactcaataaaatggtatacatacagagcctggcacatagtagcccctcaataaccatttgtaataagaaataagcaaagtatccaaggtctcccaaatagtgagtgacagagtcaaaacttccaagtctagttgtttcccctctaacatgttacctcaaaaatcgtctttaaaaatattttgctttccgtcctactcttaagaagtatttaagaacagaagaaactgtctgtgctcttatttcattgtggactgaaatttgttgacttcagagccaaaataactttccttgaagccttccctaaacctcttcctctgaacacccagagccatttcttggagccatttgttagattaaattctgtcttttattatcatttgtacatccttatcccatatttctagtttcttgaataaaattcttaaagtataaatgtattcatcattatattccccacaatgagtgcccagcatagagcctagcatatagtaaatgctcaacaagtgtctgatgaattgaattgaattccattggcccaagctttggcgattctccctgatttggagcatgagtcctcttactgtctgcaatcactgttaatattttatactacaagctcagtgaaactagatatgctattctcaaaattcaatcaaatgctttttaaaatctattttccttctctttcttcattactccatttctagttgactctgcatccattgcccttttcattcatttattcatttatttattcataaatgtttgttgacctctcactatttgctggatactagaggtacaacagtacacagatggtccctactttttagaatttgtaatctaattggagagtaacactaaacacaataaaataattacatattgtgataagtgctaagaagacaataaacagatgatgcagaggtcagaacttccccctctgagggtgtcaactctaggtctgaagtatgaaagacgtaaagaactttgccaaacaaagagctgcattccaggcggagggaacagcatatgaaaaggtgggaaagagcagccgggagcggtggctcatgcctgcaatcccagcactttgggaggccaaggtgggaggatcacgaggtcaagagttcaagaccagactggccaacaggttgaaaccccgtctctactaaagatacaaaaattagccaggcatggtggtgtatgcctgtagtcccagctacttgggaggctgaggcaggagaattgcttgaacccagcaggcagaggttgcagtgagccgagattgcaccactgcactccagtctgggcaacagagcaagattctgtcaaaaaaaaaaaaaaaagaaagaaagaaaaggtgggaaagagctgaccacactccaggaaaagcaaaaatgccagtgtgactagagcatattgagtgagagaagagtgaggtgggaaagggtcagagaggtaggcaagagcctcatcatgtgggagccatgtaggccagagcatgattctgactttctaagttcagcagcagccagagtttttaagcagaggagtaatataatctaactgagatttttcaaagatgatgctgactgttgtgtggagaccatattgtactgggacaagagaccactatataggctaatccagtagtccagataggaacagatgtggccctggactagggtagtggcaaggaaggtggtgagagtgattcaagaaacatttttgcagtagaattgacagatctatgactcttttgaatgtggaacctctttgttttactgctgaggaaactaaggcacagagaggccaggttgataagaggtcatttttgtattataattgaatgctgatttcccaaccactgatttcatcttctttctctgcacctactctacttttcataatctttagaaattcccactacctttgtgtcttctcccatatgggatcatcagccacatccagcctggtccttttgtacagctccctaaatctgcctctgcttgccatgcccagtctgctctgggttattgtgactgctctctggctggcctcattgcctcctcccagctctcagaacaggtcatttttttatggcttcactttaacggtgtttccaatcacccttcagcaactctctactcactaaaatgaaaatccagacttggacagtggcttcatagcacttcctcagctagctccacccagaccttcctgtttgcccttgtctcccattgttcccattgtaacctagctcacaccttcaatctttagcctttgtagctcagtaaagtcagagctacccctcccatctctgaaagtttaagccagctcccttgtgcttaaaattctgtcttcttctgttctttctaattgactagcacagttagatatttgtcctgaatcattttagttattaattcattatttcaacaagtaaagattgaatacctcttttgggctaggcattgtactagccactggggatgaaaaacaatcagtaggacaaggtctctgccctcaaggagcttacagtctgatggaggagacagacctgtaaccaaataatcacaatgcattgcatgaagtgttacagggactgtacacttacagaatgctggaggtacacatagaaagtagccacaaatcctattgagcgaattgagaaagacttcacagaggaagtggcatttgaattgattagaaaggtgtctaagtgttttccagttgaagaaaggagtaagggcattcttggaagaaggaacccgttgttatataaaagtaatagttagcatatgttggtttttcaagtacatgtgatagggcagaatatgtttgaattacaatgataaattcagtatggctggagcatggagaaggtggagaagcttattagaaaaacgaggctggagggagagattgggacaagattctataagcagtagggagcctgtagagatctttaagagggagtaactcgatctgttttggacctgtggcagttacagtaaagttggtagacaggttgtaggattgcagaggtgattaaaatggtccagtgagagatgagagcttgaaccaacgtgaaggcagagggaagagagaagaagacatctataaagtaaaactgtcagtgttaggagtctaattagacatgatggagcaagagaaagcagagagatgcctctcaagatttctgacttaggataccattaactgggacagagaacagaagaggaagaaagaaaatactttagtttctgttagagcaatttgagtttgagtcacgaatatacacgtagaaaagttcaaaagcaaatgaatgtgaaagtgtggttctcagaaggaagtcagctcaccactcagcatgtagaaattcatccattctctaatacctatatttctttccctatattctgagtgttatgctaattgtactcttgtctgccctaaaaatcaggggtcctcctcaataccaggcttaagtccttgcagtggcctacaacaccctacatgatctggctcctatcacttttctaacctcatttcctactattctctcccaaccacataggcccttcttgctgtctctggaacatacctggcatacccccactttcatattttacattggatgttttctctgcttagagtgctttccccccggccaggtacagtggctcacgcctgtaatctcagcactttgggaggccaaggcgggtagatcacttgaggtcaagagttcgagaccagcctggccaacatggtgaaaccccatctgtactcaaaatacaaaaaattagccaggtgtggcagcacatacctgtaatcccagctactcgggaggctgacaagagaatcacttgaacccgggaggcagaggttgcagtgagccgagatagtgccattgcactccagcctgggcgacagaacgagacttcctctcaaaaaaaaaataaagaaagaaagaatccttttccccaagatgttcacataagtaactccctaacctccttcaagtctttgctcagttgttgctttctcaatgagacttactctaaccaccatatttaatcctacagctgactatcctcgcttccctggccactcccaatcactctttttcaatttttttcagctatagcactaatgagcgtctaaacatactgtataatttacctacttattatgttttttatttatcagttctgtccctcccctagaatgtgagattctaaagggcaggattttttctcccttattcactgatatatattaagcacctggaacagtgcttggagcatgataaacactcagtatatatttatattggtcaaacaaatgaatgaaagtgtaggttctcacatcatttgctctcctaaactttctgcttgccatgggccttgaaactcttagagccaaataaaaatataagaaggggaaatgagaagatataagaatgataactcagtaccattgggcacccatgtgtttctgatatattaaaagagtctttgttaactggtccctttcatggtctgtattagtttcttattgctactgcaacaaattaccacaaacttcgtagctcaaggcaatacacatttattctcttacagctctggaggtcagaaatctaaaatcagtcagcggactacattccttctggaggctctatttccttgccttttagaggactcttgcattccttggttcatggctccttcctccattttcaaattgcatcactccaacttcggcttctgtcactgcattgcatttctgtgtctttcctgcttccctatttcccttattgttgtgagacttttccttagttcagctaaagatggggtctttgtcacatggccatgaaagattaggctcacagacaatttgaagggtgagaataatgggatttattgggcaaaagggaaaaaaaggggaacagggactcagcagagtgagagtccttctagtataggcttcctgcctcacagattaaatctcaggttccaccaaggaagaatagggaccaggctcctccccgctgcaaacagcatgagcttctgtggcttcaccccggtgcacactcctcccagtgcgcaggccagctggagtttctctaggaccccttctcacctggctgtctcattatgagaacgcttgtgattacattgagctcgcccaagtaatccagggtaacctacccatctctagattcttaacttcatcacatctacaaagtcttttttgccatgtaaagtagcatatccacaaattctgaggattaggacttcgacatctttggagagccattattctgtctaccacatggtccttgtagaattttgacttaagacaaagattgacagaactttgttcaagggtgtaacctagctctgaagccactacataccctgggggcatatgtagtttcagatgatctagagcaacactatccagtaaaactttgtgtgataatggaactgttccatatctacactgtccaatacagtagccactagtcatatgtgacttttgagcacttgaaatgtggctagtgaaactaaagaactgaatttttaatgttgttttaattaactttaatagccacatgtgactagtggttactatgttagactgcacaggcctggggactgacagcaaggaaagtttttgtcttggctttagctttgggtagaattaaaaacaaaacaaaaaaattattactgagattttgtggcaccagcctgcaactaggtttggagtctgaatatacattatgtgaatagtccaaaaagccacaagccaagaattttaatttaaagtagacctagttgtgcagagcatagtggctcatgcctgtaatcccagcactttgggaggctgaagcaggagagtcgcttgaggtcaggagtttgagaccagcctgggcaacatggcaaaacctcatctctacaaaaaaaatacaaaacttagcccagtgtagtgacacatgcctattgtcctagctactcaggaggctgaggttggaggattgcttgggcccaggaggtggaggctgtagtgagccatgatcataccactgcactccaacttgggcaacagagatagaccctgtctcaaaaattaataaataaataaagtagacctagttgtgtaatgcctcaagcaccaagaaaaatcaaatagaaatctttcatggaagaatgtacccctcccagacctcatggaaatcccacagagggttctgacaaaaattaattcacaatgaaaaatcacaatttacacaagaaaactaactaccaggaaggagaagtcaacaggaaaaaaaagacaaaatataaccagactttagatacagaaattatatatggaatataaaacagttatgctaaatatgtttaaagtaataagggtagagagcaaagagcaagagactatcaaaaatgacctggtagatttgaaaaataactaaacagaatacatagaaatgaaaaatacagtaattgacattaaaaacctcaatgaagctttatacatcagttgaaaataaattagtaaactggaaaataggtctgaaaaaaattacacaaaatacagcacagaggtacaaagagatgaaaaaagtaagaatggttaaaagacatggaggacagaaaaagaagattcaacatttatctccttagaattctagaaagaaaaaatacacagaatggctattattaaaaagccaaaaattaacagatggtggtgaggttgcagagaaaaagaaatgcttatacactgttggtggaagtataaattagttcaaccattgtggtagacagtgtggcgattcctcaaagacctgaagacagaaataccattcaacccagcaatcccattactgggtatatacccaaaggaatgtaaatcattctaggacacatgtacgtgtatattcactgcaacattattcacaatagcaaagacatggaatcaacctaaatgcccagcaatgacagactggataaataaaatgtggtacatggaatactatgcagctataaaaaagaagagatcatgccctttgcagggacatggatggagctggaagccattatccttagcaaactaatgcagaaacagaaggccaaataccacatgttctcacttataagtgggagctaaatgataagaacacatggacacatagagagaaacaacacacactggggcttatcagaggatggagggtggagtatgggaggagggagaggatcaggaaaaataactaatgggtactaggcttaattacctcggttatgaaataatctgtacaacaaacccctatgacacaagttttcctcaataacaaacctgcacttgtaccctgaacttaaaagttcaaataacaataataataataataataggaagaatattaaagtaaaccatggctgaatcttctccagaatttctgaaaacaacaatctgcagattcaggcctaagaaattccagataaggtaaataaaaaagaaattaatatctccacacattataatcaaactacagaacaacaaagacaaagacgaaatcttaaactagaaagaaaaaaaatgatcatgaacaaaagaacaattagactgatagctgacttctcaataagcaatgatgtaagccagattacaatatgatgttgaaagtgctcagagaaaataatttcatcctaaaattatatattctttggggaataaaggcaaaataaaacattttaatataaaaaatatttaaagagtttaccaccaatacttcctcactaagtaaggaaaattatccaaaaagcaagttctgagatacaagaaagaaaagactttggctaagaaaaaaaaagttaagcatgtgggtgatattaataatttctaatttgtgggattaaaaaaagacaaaaagcatggaatttaaaggctttacaatagcaagtcatgttgtcatggattagaatcacagtattctaaaggtccccatattgtttgaaaaggggacaaatatattaactctaaactttattaaattaagtaagcatgttaaaattccaagggcaaccctaaaataataggaaaaagaatgagtatcttccaaactgatagaagagaggaaatggaatgaggaaaaataaaccttaattaatttaaaaaagtcaataaagcagcaaaaacacagcacagcaaaacatggtagaaatggaacatatagcccaaaataggacaaaaataaataaatctaaatatatagctttttctttaaaatacacttttggaaattttaaaaacatatttttaaaggtttttgtttattttattcattaaacaattttatttattcatttatattttaaatttcaatttttattttaaattcaaggggtacatgtgcaggtttgttacctggatatattgcatgatggtgaggtttggggtacaattgatcccataacccaggtactgtgttgtccaggctggtcttgaactcctgggctcaagtgatcctcccacatcagccagacagaatctggctctgtcgcccaggccggagtgcagtggcacaatctcagctcactgcaacctccatctctcgagttcaagcgattctcctgcctcagcctcccaagtagctgggattacaggtgcccaccaccacaaccaactaatttttgtatttttggtagagacggcgtttcaccatatttgccaggctggtctcaaactcctgacctcaggtgatcctcccgcctcagcctcccaaaatgctgggattacaggcatgagccaccacacctagctctctcagcctttttaaaagagatgaaattacataaaataacaattataacaatgtatttttatgttcataacctatatagatgtatatgtatgtatgacaataatatcaaaaagagagggaggcagtgaagctaggtaaagtgtctatatttcactggaactcagtataaatctgaagtagatactagtaagttaagatatatattgtaacccctagagaaaccactaagaaaataactcaaaaataagtaatttttaaattatgaattaaaatgttacagaaaaaaataaccacctaatacaaaagaagatcatcaaaaaacaaaaaaggtatatggcatatagaaaacaaaagcaaaatggaagtgcaaatccaaacatatcgataacaacattaaatgattatagattaaacaatctaatcaaaaggtaaatattgtcagatgagatttttttaaaaaagcaagatccaacaatctgctgtctacagaaaacaaactttatgttcaaagatgcaaataggttaaaagtaaaagaatgaaaaatgatatgtcatgcaaacaacaaccataaaaatctggagtggctatactaatatgaaaaaatagactttataacaaaattaattactggagatgaaacagacagttcataatggtaaaagggtcaatctgtcagaaagatataacaattttaaacatgtatgcacctcacaacagagccccaagatacatgatgcaataactgacagaatggacacagaaaaaggaagaaatagacaaacagaatattacattctccagaatgcaccataggccaggaataaaatcatataaaatatgttctctgaattgaataaaagtagaaattaataacagaaggaaatttgggaaattcacaaatatgcagaaaataaactacacatttctaaataactaatgggtcaaagaataaatcacaaaggaaattagaaaatacttcggatgaatgaaaatgaagaggcagcataccaagaagcagctaaagcagtgctcagaaggaaatttgtagctataaatgcctatgttaaaacaaagaaaaatctcaaattgataactttctactttaagaaacttaaaaaaaaaaaaaaaagaaaagaacacactaaacccaaagcaggcagaaggaggaaataacagattagagcagaaataagtgaactagaaaatagaaaatacagtaaggaaaaatcaataaaaccaaaaattgattctttgacaagatcaacaaaattaacaaaactgtaggtagattgactaagaaaaaagagagaagactcaaattgctaaaatcagaaatgaaaattaccaccgattttacagaaatagaaaggattataacagaatgcaatgaacaattgtacgtgaacaaattacactacccgcatgaaatggacaaatacctagaaacacactaaataccaaaacttaagactcaagaagaaaaagaaaatctgaatagacctacaataattaaacaaattggattagttatcaaaaaaaacctgccaccaaagaaaggcacaagactagatggcttcactgcttaattctaccaaatgtttaaagaaaaatcaaatgcaattctttcactttctttccaaaaaatgaaagaggaaggaacacttcctaataattctatgaggctgttattatttacagatttcaaaacttactacaaagctacagtaaccaaaacagaatggaagataatatttgcaaatcatatgtgatatgggacttgtatctagaacatgtaaagaactgttacaactcaaaagagagatgacccaattttaaaatgggtaaagaacctgaatgaacatttctccaaagaagatatacaaatggccaacaagggcatgaaaagatgttcaacatcattagttattggagaaatacaatcaaaaccacaataaaatacccctgcacacccaccaggatggctacaatcaaaatgacagataataacaagtggtggccgggcacagtggctcatgcctgtaatcctggcactttgggaggccaaagcagcagatcacttgagctcaggagttcgagaccagcctgggcaacatggcaaaaccccatctctacaaaaaaaattagctgggcatggtggtgtgcacctgtagtcccagctacttgaggggtggaggcaggaaaatcacttgaacccaggaggttgaggttgcagtgagccaagattgcactgctgcgtccagcctggatgacaaagtgagaccctatctcaaaaaataaaaaaataacaagtggaacaaagatgtgggaaaacgaaacactcatacactgcccatgggaatgtaaaagtacagctgctttggaaaacagtttggcagttcctcaaaaggttgaacatagagttaccttatgacccagcaattccactcctaagtatatacccaatgaaaacatatgttcacacaaaaacatgtacacaaatgttcgtagtagcattgttcatattagctaaaaggtagaaataacccaaatgtccatcaactgatcaatatgtaaataaaatgtgctatattcatacagtggaatattatttggcaataaacaggagtgaagaagctgaagaccacatattgtattattccattcatgtgaaatgtctagaataggcaaatccatagagacagaaagtagattagtagctgccgagggcaacattcaggggggtgagaggtgggtaatggagaatgactgctaataagtattggtctattttaggggaaaccaaaatattctaaaattagattgtgctgagagttgcataaccctatgaatgtactaaaaggcattgaattgtatactatgaatgggtgaattgtggggtatgtagattatatctcaataaagctattttttaaaagatggtagtggcttcaactaggataatatcagtgtagactgtgagaagtggtaggaatctgtatgtattttgaaggtaaggtgagtaggattttctcacatattgtgtgtgggatgagggaacacaaggactcaaagatttgttctgagcaactggaatgatggcgtgagcaactgagagaatgctgtgggaggtgcagtttcagatgataaagagttcagtttggacatgttgagttggaaatgtcaagtaagtagaaggaaaaaagataaatgaatgtggatggatggatagattgatcctgatggtaagttagactagcattacaaaattgggagttaatatatgggtagactttaaaactatgagtatggatgagatcaccaaagaagtatgtatagcaagagaagagaagatatctagagactgatccctaggacagtccaacattaaaatgttggagaaatgaggaagaactagcaaagaagactgagagagaataaccaatgaggtaagaggaaaattagaagagtgtgttgtcctcttgtgaagaaagtgtttcaaggaagagggagtggccaactgtgtcatatgctgctgagaaatcaagtaagatgagaactgagaattgaccattggatttagcaacagtgtagtcatgggtagccttgacaagagcagttttgatggagctaggtgaaaaggtctgattgatatacatttaagaaagaatgtaaagagataagtctcatttctatacaacagcaataaaaatcaaaaatgcagtttaaaaatataacaataaaaatataaagtgtctgggaataaaccaaacaaaaatgtgctaggaagaaattataaaactttattgaaatggagaggccaggcacagtgtcttcatgcctataatcccagcactttgggaggccaaggtgggagaatcacttgaagccaggaatctgatactagcctaggcaacaaagtgaagctatgtcttgttcacaggtagggagactcagtattgtaaagatatcctttgcaatcaatatatagtctgaatcaatcaatatagtcattgtaattccaataacaatcccacagggtgtttttatgaaatttgacaagctggttctaaaattgacatgggagtgcaagaaaagccaaggcattcttgaagagcaacaataacttattcttatcagatattaagatttatcatacagctatagtatttataacagtgtaatattggtgcacaggttgacaaataggctaatggaacagaacagaaaacctgaaaatagacctatacctatttggaaatttgatatctgacaggtagcattgcagatcggtcaaggaaagagtgaattctttaataaatcatgttggggaaaaatggttatccatacagaaaaaataaaattagattcctacctcacaccaaacacaaaactcaattctaggtatattaaatacttttagaagaaaacatagttcagtggttctcaacttgcagtaccaccatctacagaacatttgaaaatatatagagtatgttagattgttatgatgacaggaatagtgctagaggcatttagtactcagggtctagggatgctaggtgtcctgagacgtaagagccagccccatattatttgtcctgccccaaatgctagtaacttccctactcacaaagaaatactgatacaggataatttctctagtcttgggataggggataatttctgtaaaaaaaaaacataaagtaccgactataaaagaagagagtaataaattcaattaccttaaaatgaagtggctctgttcacaaaaaaaaagaaagaaaaaaaagaaaaaaaaaccctaaagtgaaaaagccacaaagtggaagaacatctttagtactcatataactcacattcagaatctacaaacttctatataccaatacataaaaagacaatcccgctagacgtggtggctcacacctataatcccaacacttagagatctcggtcgaggcaggaggattgcttgaggccaagagtttgagaccaacctggtcaacatagtgaaacctcatctctaagaaaaaaaaaaagaaaaaaaaaattatcaggacatggtggctcatgcctgtagtcccaactactcaggaggctgaggtggaaggatcacttaagcccaggagtttgcaactgcagtgagctatgattgcgccactgcactccagcctaggcaacagattggagacctcatctcaaaaaaacaaacaaaaaaaaagataatccagaagaaaagcaagtaaaagatatgaacaagcctttcacagaagaggaaacctgaatgaccaagaaacatgaaaagatgctcaacctccttggtaatcagggaaatgtaaattaaaaccacaataaatgacgaaagaaaccaacaacatgagattccattttaatccaccagattggaaaaaaaataatgtaatttaaacaacactaagtgttagtgatgatgtggagcagttagtgaagacttctgatgggagtatatattaaacaaccaacttgggaaacaatttggcattatctaataactttcaacatgtgtatactttacaactcattaattccacccctataaatagacttgagaaacttgcacaggtgtactataaagaaagtttatagcaacattgttcagaatagcaagaaaactagaaacaacagatatttgtggtatggtaacacagtgaaatactatgaaacaattaaaatgaatgaactgatgccaataacaatgtgaaagattctcagacacataattttgtgtaaaaacaacttcaaaagaagtttagtgtgataccaatatttacagttcaaaaccaagcaaaactaaaaagtatcttgttaaggatacttgtatatgtgggaagactaaagaaatgcaagggagtgatttttagaagctctcaatagtggcttcctctgggagaaaggcagggtacctctagggtggaggaagtgtgcagggagcatcaatggcactggtcatgttctattgctgaaggtcaatggtaagttcacaggtgcttattctattattagacttcataacttacgtatgtattaagtattttacatgtagaaattacatacaaatatgatttacatatattaagaattttgtatgtatcaatatcatttttaaatgaagaatggagaggaatactctctgacactttcagagtaggagctgcagaagagataaagactcttataatggaaaacatttaaaatctactctcagcaattttcaagtatacagtgtgatatagtttgaatatttgtccgcactcaaatctcagtttgaattgtaatccccagtgttgcagatggggcctagtaggaggtgattggatcatgggggcagatccctcatgttttgatgccaccctcgtgatagtgagtcatgagatctggttatttgaaagtatgtggcacttccccccatcactcttgctcctgctttcaccatgtgatgtgccagccccccatttgccctctgccatgattgtaagcttcctgaggcctcatcagaagccaagcagatgcctggcaccatacttccagtgcagcctgcaaaattgtgagctaattaaacctcttttctttataaagtacccagtctcagatatttctttgtagcaattcaagaacagcttcatacacagtacattattgttgttgttgtttttgttgttgttgttatttgagataaggtctgactatgttgtcaaggctggtctcaaacttctgagctcaagtgatcctcctacctcaacctcccaagtagctgggattaaaggcacacaccaccatgcccagccagtacattataattaaccatagtcattgtgctgtacagtacatttccaaaacttactcctctcatctaactgaactttgttccctttgaccaacatctccccactctcctccccacagccctgaaggatatgttaatttgcttgatttaatcctttcacaatgtatgtatatattaaaacatcacatcatataccataaatatatacacttttgtcaacttaaataattaactttttttgaaagaaaaaaatttttaaaaactcttttaagaggatacaacccttcacagcagcagtgttgcctttagagacacagtctccctggtttccccattacaccccattgagccaaaggcaggctgcagacagcaacatggctcttccccagctaggtcaggagtacaggaaaaagcatgccctctcttatgatcaagggtgtgctcagtcactgagcctgccaacattgtcatgggatagcaattgaaatagccaggggaaaaaccaacagactttgccacggtgggtaaattttggggtatctgaaggtgggaagtgagagggtgggcagaaaccactgggctagtagaaagatacctagtttctttctaatggcatcttctactagctcgtgtgaccttgggcaattgacttcccttctccacactcaaatttctcctcagtcctcttcaaggtttaactagaacacacattaagatcatttccagcctgaacaccctaggattctgattttaagtctgcttaaggggaaaacagtttgcatatttacactcctagtctccaagttagtgagtaactaagctcctctctattgttcagagcctttgaaagtattgctgaattggctctctggaagtatagaaaaacaaacccacgtgcatctacaaatggccattcttgaataagaaactcccattcacacaattagccttgagaatgtagatagaagtttaagcaaaactgtccttcaagtctgtgcagtctgtccttcctcctccagactgcctttgattacagtgcttcctgtctctctgtatgtagccctcatgagttcttccttgcgtacgcattttgagggggaaaaaactttccttgtcaagttttcctcacataacctcccttacctctgcattttccctgtgctttaaaacagccacagtagctaagaagagacttcagtatgcaaaatgagctttgtccctgggagatggactaagggttaaattaaagggacagctgtctatacagctggctagaatgagaagagtgctaggcagcatttgggctggctgcctctcacttttattccttcccaatttttgtctcccttccacccctctggccaggggtgctgagcagcaaactgctcagacagagctcctgggcattttccaataggaagctggagctgaggtgacctaacttccttatgtcctaacttcccccagacaaaagatgtttaagcctcaaatttggaactggaaaggaaatctaaaatgtacaaactactttttcacttgcagataatcaccctttccttcttccaaatcttctgaccttgtttaaaattaatcttttgctcttagcacttttttccccccttgaactatagttgttttgttttgttttttagcagcacttttgaggaactccttttttaaaggcaagagggactatgtgttactctgggtgagtcactgttctttagtcgatgctggtgagaatctcaagggttgacaaagattgccaagggtggctgcagtccagcacccaaatgctcacataatttgcccctgtttccattttatggtgaaaataatcaaggacaagaggaggaggggatttatgagaataaataagatactgtcttacagccaaagcaacattcagattctcagctggcagaggaattcttgagactgatctgtagtgaaagcatgagcaaactgctaaatggaatgcaaagagaaccctgggcttaatcttcgttccaggcagtctacagaggcgtctcagagcagtactattcctggaaggcaaagtgcttacccacgcactgccccgcccccagcgtgagaaattcagggctccataactgtgccagcaccctggctcttatttccgcagtccagttgctttggtgaaataggagtgtacgctgcctatccatgaaagggcaactctgaaagcgatttataaactgtaaagtactaggagacgtcaggtggccctgtcactcacccatttctattgtacgctgcactctttcagttgtcttttaccattattggacaaaaaccacagaattttgtggtgagaggtcaggccctgcatataatcaatcatgcacaagtcccaagggatagaagcataaatcggccttaattctggatttccccgtctacacatggagagaatttgccagtcagcgacctcacaaagacatcatagaatggtcaagaaatgaccctaagaaagctcttggtggggggattgctttaaagccttttgaaggaaagactctcaattccaaaatgccattattatttctgcattgaagtaaaaacccttgtgtttatatagcctttgattctgatgtcagatatctgatgactccccacaactctgctctgaagtgaggagaaggcagtcatactggagtctctgtatccagtggcggggctctgcacagagtaactggactaggaagatcaaagagccaagccccatccactttgcagggtgggtcaaccttgggccatattaaaggacttctacctctggttagtacctcccctaggctctacatttagtaaacaaaggaactcgaaatttgtgatgaaattaaataaaaaaacaagaacttcatcattacattcatccatctgcccattgtttattttgagtgtgtgcttaacagcactttccagaacaaagtaatccctaagtagagacaaagacgcctctaataccagggcatcggggagtggggggtgttacattccttccctccccatcctccttttcccaaagcccatccagctgacaggtgccagaagcgaagaaatgttagcaaatgttagtttccagccccaaagaagctgtcacaaaagggagacagaacaaggcagctcataaaatccttcaactgagggacgtagcgagacctatctaattacataagattagaaacggtttaacgagttgagaatgtgctacatgtggaatgaaagaaaatgacacctctggcaccctgtaatgatactgtattgggaggaaagcacaaagggtttgttcacgctatcagtaacaccagtttttcctcatccaacattttagacacatctggttttaatatggtggtctaagtgaagtaagttaacttttcacccactgttctggccctccttttctttcttcactgtacaattccgtttgtgttggcattgtccctctctcacccatgcctcccaagctaacagaggcagaagaggattacactgagaaactttgcttacctctgggctctccagtattttactgctcaaattatactaacaatgatttggaagcaagactagtctttgtttcagctaaattcaacggattttagctttgaccttctgcctaatttattaaactaccaacgctgaataagaactccctaagcaatcaatgagtcacagaacattcctggattttgaaaatttgggaaagatcatctccattactcttaagtagaatgcccaggaaatctggtatttgcccaactggtttctagctaacatagtattaattgacaattttgtgcctgtgttagccaaaataataataattttttaaagtctttggtgattatatgctgaagaactacaagataggtgtatttccagtaaaagtagaactttcaaactacaaaatgagttcccttctacacatctcttttcagaacagaaaaagggttttattctcccacacccagagaaaagatagtagaatttttcaaatggctactattaaatgccaaagtttggaatttttttagtgctttgatataaataatgtttactcattttttaccctctttagatttgtgcctcacagcacttttacaaacagcaagtgtataattctaagctagtaggtactgtcgactctgaatacagggtaccatttgaattgtgctcaacactgactctttgggatcctttcctgtgttctgagttctctctggagtacagattttagttggaaggagaggggcatgaatgatctccaggtcctctgaaagatgtgaagtctttcaggtggcttctggtgtattttttcctccatctgaaagcagtccagtagggcacttctgtagctaatgccttaaccccaagaagtgactaatagtgagacatttgtgccacctggtaagctggcaggggtggatggtttaaggcaagtgtaatattcagtgcctgaaacatcacagggatgtctgtctgtgtagagttggtacctactattgtggcatgaagggactagcaagaattgctatatatagacttgacctaagagatgtaccatttttactacattcagagtcagcagccctttattaagcacatactatgtgcaaagccttgttaagtttctgtgaagttctctgtaatgtattaatagatttctttttcaaagtggtcagggaatttcagcaatcatttactgactaccgctatatgcaggcattgtgctggggataccaatatgaatcagaggtgtgccctgatttatggagctcagggtaaagtgtgagaaagaaaaaattatggtacagtgtgagagtagaggttccttgcaaagagctttgcgaatgtatagaggggaatgattaattcgctcaggaggtgtcagaagggttcacaaaggagatgatatttgagctgtttcttaaagagagggtagaatttcaccaggcagacaggagagggggaagagaattccaagcagagggaacagtgtgtgcaaaagctcattaaagcatttagagagttctttttaccatcacttgagagggcaaatataagttgtactaatgttgagtttggattttttcctcatgattacattgccatttttaaatacaggacatgatattttaaggcaatgacaagaaaaggcctgatacatttgaaagctctccttattaagctgtgatgctttatctagttagtgccttgcacatatagcaggccctcaataaatgcttactgaatgatgagttccctatctctttccatttataaattactgcactgtcaaggatcagcttacaaagcaaaacttctgcctgtgagttaggaatgggtattcacagttctgctttctgtcaccccagcctcccctactcttgtgaagagtgactctgccactgggccttaactgtgtttctgagaagtggggaaaactgctcttgctttgagtcctcagtaacacagattcctacatggagggcctctacatcactgaaacccagataagtgccatttgaatgggacagtcctcatgttgatgacataggagttgatgtccaaggaactttagtgatactggctaatacaggtacacctcacattttaaattttatagtacagcctaaatgtgattgatcaaacattttctatggcaataataaagatatgagttgtctgtgctgaacagccttgacagcaaaatatggtactgcctgttctgtttttttaaggaagagaagataaacttttattatttttataaattatgcaataacctttagggtaacgataaatttttgccttgaaaatcaccagggaatagatgacagagaatgcagttagacataaaccatttgcaaattatatgcaagtacacttgtaacccttttattgggtgtctggatccagtctttgggaaaattcccatcagggaatcttgtttcattgtgactctaaaacatattaaagatatacttcttcagttccaaatcttggcagctatgtgactggctctttcaggcctaatctctatagctacacttttctggtggccactataccaggccacagaatgtaatgtctttcatcctctgagctacactgtgaaattatcattccacaaatagtcattgagtgcttccttgagccaagcacaatgctaggttcagtgtgcctgaagtaaataaaatagctatacactatagggtgactataattaacaacaatttcttatatattttcaaatagctagaagagtgaattttgaatgttcccaacagaaagaaatataataaatgtttgatatgatggatatgctaattatcctgatttgatctttatacattatatacatgtatcaaaatatcacactgttaatgggtacaaaaatatagttagaggcaatgaataagatctggctatcaaattagccaacagggtgactatagtcagcaatgatttgttgtacattttagaacaactgagggagtacaactggaatgttcataacacaaagacatgatgaatgtttgaggtgatggataccccatttaccctaatgtgatattacacatgtatgcctgtatcaaaatatctcatgtactccacaaatatgtgtatgtgctatatacccacaaaaattaaaaattaaaaaaaattaagggaaaaaagaaatatcacactgtacccataaatatgtatagttattgtcaactaaaaaaataataaaaaataaggcatccacatccctgccccccatggtaccctcagcctggtaaaatagctcataatctcctttgggatcatggtcccttttgaaaatctgattccgactgttcttatattacttaaatattagggtggcagcttcctgtctccctaaagaaagccaagaacttttgtccctagaacatgggatcttgttaaatccagtataggaagtcattcttcctagaggttaagctttgttttcttttggagcctgtggctgggtaaaaagaacatgagcttttgagccaaacaatttggggttctgatcctttaactagaagtgtgatcttgagtaatttccccagtctctcagaagctcagtttcttcatccctaaaatggcgatcctcattatccaccttgcagggtggctgtgaagattgaatgcttctgtgtgtacaaagcacctctcataaggtcagtgctcttatcagggctagtaagtgagaaagccatattttgaacccagatcttgctgactcaaaacctaggctctctgcttcctcacaaagcctttgaaaataccggatcatatttaagcctcacaaaactccataatggagggaagaaacaaaacagctgaagatgctaatttgtttcgagacacttaggatatctgtgacaaagctaacaccaactccagagactcagtatccttttttagctatgaatgctcagcgtgtctccctgtgcagttgtgtccattcctttcataagcatttattgcctaccactgtgtgcctgacttggtttaggtgcttctggtgatttaagaggcatgatccatgacttctaggaagttatagactagtggaaaggcaaaagctgcacctgacaaccaattagagaaaaattacacaagacagtgcataaacaagtattaataatgtagctaaaactaattgtattagtcagctcaggcagccataacaaaataccataaacttgatggtttaaacaacagaaatttattttctcacaattctggaggctggaagtccaagatcaaggcaccagcatggtcagtttcttgtgaaggtgcacctcatggcttgcagtcagccaccttcctgccacattctcacatggcctttccttggtgtgtttgcagagagaaaactcataaggacactaattttatcagatcagctacccccttcaccatgaccttatttaaccttaattacttccttgctccaaatgcagccacattaggggttagggcttcaacgtgtgaattggggtaggaagacacacaattcattccatagcagtgtgtgtgtgtgtgtgtgtgtgtgtgtgtgtgtgtgtgtgtaatcactgtggcatttgtatagacaaaggattacagagagataccaagagaactagaaaggccagttaggaggcctttgtggtcctctagattccagatccattttggaggtagaccaacaagacttgatgaagtagatataggagtgaaggagagcaaaggcttaccaaagaccccaaggctctttcttgggcaagtgggtgaatggttgattaataaagggaacactgagggaggagttgtggggtgggacttgggggatcagcgcatctagactggtatccctccagtcttccacccataatccatccttcatatcagttattttgtaacagttcaactttaatcatgttatctacctgcttcaaatacacaaacacacacacacacaccctcccagaacttataagtctgaaattcttagcggagaacacaagatcgttctagattgggccctaatctatttttcccactatgctatccctactcctgccctaaactctgattccactatgcctttgaccaaggtacttcttctactaggaatatccttcctcctacttgcctgctggatgaagtcctactcttccttcaaattccaatccccatgtcatctgtctgtgaagtcctccctggccacccctcccctccatagtttatcactcctttccctgcgatcctataatatctgacacacatagttaacttgagaccttattatattgtattgtaattcatttactcatctgtctcctcaactatactaaattcaagggcaaaaactgtctgatcctcccctgcatccctaattcctaccacagtccctggaaacaagcaggtactcagaaagaagaagtacaacaagcactcatggagtgattactatgtgcctggcactgttttaagtgctttagatgcgttatttatctgtatcctcacaacacaacaactattattatccccatttcatagatggcttgcccaagttgacagaattagtaagtggcagggctaggattcagacccaggcagggtggctctggagtctgagctcttcaccactaccctacacaacctctcttgccaccccactgttttcctgtctgttatttacttggagcctgggagctgctttgatgatgacggcagggagtgagggaattactctactaaaaccagaggctatagcaggaagagagctacagaaacccgccctgctggcctccatctttccctttcctcctgctactaaactccttaagcacgagatagcacatccttctgcagggagaggagcagccactggaggaagccaaaggatttccctcttccctccaagtctcacttttctaccctacatggctcccagcttctccctgccccaaccatttgtagccaaggaactaggcttagctaacccatgggaactccagttcacacgcaggcttaaattgagtgtgtgccctctaatatccccagtggggcctagctcattgtgctctgcctatgattttgttttgttttcttttgtttttgaggaagagtagagttttcggttttgattccctcaagaaagagaggtccctgctgttctactctgaactagagctagttcagctccagagtggagcccctcaggctaatatagcaaatagaaagagaaggtggcaatcagggcaacaactgcacagttgtgtccattcctccacttcgcattccctcagcatttagggacttggctttgtgctgttttgtttagattttgagaatgttctgaagagtagagatgacacagggtaaagatagggttcctgaagccggatacacccaggtttggagtccagcttcaccacttactagctgtgtgaggcaaggaagttatttaacctgtgtcttatctgttaggttcctcatctgtcatggagctagtatagtacctgcctcataggatgcttgttaggatttaatgaattgatccacatgaaatgcttagaactgtaccgggttcataagtgctctgtaaacattagctgatactattttttaaatatagtatagtaacagagaatataacaaacacacttattcccaccattcagaattaaaatgtgttaagattttatcttatctttaaatccttaaaaaaaaaatcatacataagttgaatatcctgtgtccttcattcccagtcctattcctctcccaatgcccccaaggcatccattgtcataaatttgatgtgtatctttccagttcattttcaccatgatcataaacaagatttggaatttgggggaaatgattttttttaattgggacaaatagtaccatactgtacatattgttttgcaatctgcttttttcattcaatattttttctccttttattgttttattcagtgaagagacattcaatgttgtttctaagatctacccacatacatccatttcaggccattaaactgctttatagtatctcatcctgtggatattctgtgttttatttaaccatccacatctttatggacatttggattggtcctaattttttaccaccacagtccattgcaatgagcattcttacacttggtccttgggcacatgtgcaagtttctgtagaacacagacctgcaaatggaattgctggatcatgaggtctgtgccttttcaattttactagacactgtggacctggcagaggcggtagagtacagtgagtaagagtgtgacttgaggtctgatatatctaacttcaaatcccagctgtgttactccccaaactgtgtgactcagcaattctttgtgcctcagtttctctatctgtaaaatgaggagaacagtatatatttcatagggttgttgtgtggattaaatgggataatgcatttaaggtaggctactgagcaaaacatggtaagctattattcttttttattatgtcttatcacatatttccccctcaaatttgagagtagaccttttgtaaagtgtagatatgtgaatataaaaaatactagaaagacattcatcaaaatgttaaccagtgttggaaataggagtgatcttttttctttgtgcttttttattttccaagttttttgtttgcttgttttttcgttttggttttggttttgagatgaggtcttactctgcagacaggctggggtgcagtggcgtgatcatagctcactgtagcctcgacctcctatgctcaagttatcctcttgcctcagcctcccaagcagatgagactacaggcatgtaccaccatgcctggttaattttttaatttttttgtagagacaagatcttgctatggtgcccaggtgatctaaaactggtggcctcaagtgatcctcctgcctcggcctcccaaagtgctgggattacaggcatgagccactgcacccagccttttccaagtttcctacaaatgaaatgtattaactttgtaagtaaaaaacaaaatcacaataaatgcaatttttaatggaaaagaatgtaaagtaactgagatttttggaaaaaaaaaaagaattttctttctggtgagcaggagctctgcaagaatagtaaaagaggtcctaagaaatagctttgtaaaagttgaaaaacaatgtaaatgtttaccagtagaagattggcaacatatgatacatgtgaaagaatctccaagataaggtatctaaatgaaaagggaattacaggacaccgtgtacaatgtgttttcttattgtatcaaaatgatatttttatgcttacatatgcagtctgtctcttgaaagagttacaaaaacactggtaagggaactgggtatctaggacacagcaaggacttattcttttacaaaatatccttttctgcctttggaatttttaactaaatacatatattacttactcaaactttttcaatacaatggttttaaagtagtttatgctagaatgtaacagactttttgcaattattgtcagtatctcctcaactacctttaatctagcctccaaagttagggcgggcaggctaaattggggcccttgtttgccctggtgtctggctctagagtctatcctcttaccagctggttgtaccccccaccccaatgcaagaatgattcaaaagttaaccaggcacagaagggtggaaagtgattccagcagagcataacagcctgagtagagtggatgcatgtgggtttctgtctgtgtgcaactacaaacaattgtgtaaaaattgtaaggtggaaaatggtaagagatgcagctagagaggtgtttggaggccaagctgtggagccaactctttattagtcatgctaaatagcttagaccctcctaccaaagttgtggtgtccctaaaacttttacagtaagggagtaacaagatccattttgtatttttgaatttacttaggctgctgtgtaaaggatgaatttgagagggacatgactggagataggaagagcaactcagaagctgttaagagatgatgcaggcctgaatttaaaatgtgagctaggatttgaactcaggcctgcctgactccaaaaatcaaatgttattatatttctccatctaacacactgcctgaagaaatgaacaattgagtttctttgtgccagctttccccacactgatgccagaagtacaccagcagatatatgtctttatctacactgagacaaaggggaaaaggctacctcttttttttttttttttttttttgagatggcatctcactctgtcacccaggctggagtgcagtggcgtgatcttggctcactgcaagctccgcctcccgggttcacaccattctcctgcctcagcctcccgactagctggaactacaggtgcccgccaccatgcccggctaattttttgtgtttttagtagagacggggtttcactgtgttagccagggtggtctcgatctcctgacctcgtgatccgcccgcctcggcctcccaaagtgctgagatcacaggcgtgagccaccgtgcccggccaaaactacctgttaataaagcctgtggattcacaaaagcaattctttgtgaagaacgaaacctcaaagtacatggtttggctatttttgtcaagaattcttgcttacaacatcttggggaaacttccttggggaaagagtaagtttgtatcctgccttgttctttaaatattttgctttactattagtgtaaattatccaatatagtttatacctcaggtatagaaacttttagagaggtgtatcatccataaatccatgaattcccaatttcaaaaaaccagaatacaaatagcactgtacaattaatgcaattatacattttaatctttgattattcagaagggaattcatgaatctggggatctcaaggtcaatgttagaaacatcattatcataagctcctaatagggcagagtttcttaatgctgtatccccagtgcctagtacatagcagactttcgatgaatgaataagtgaatgaatgatagaggactgtagcagtagactgggtagacccttctgatcctatagctttcctaggaccagtttgtatgcttttcttttacatccttctcctataagtagaatacgaaatagcaaggctgagaagattgatctatgggagcttttttagggggagagggaaaaatcatctaataactcaatcgcttttaaacagctttagcaagatataattctcatatcacaaaattcacccatttaaagagtgcaattcagtgggttttagtatattcacaaagttatgcaaccattaccactacctaattctggtatgttattatcccccctaaaagaaatcccatgctcactagcaatcaatctcctctcccccgaccccctggaaacaaccaatctactttctgtctctatagatttgctattctgaacatttcatatgaatggaatcctgcaatatgtggtcttttatcactggcttctttcatttaaccgaatgttttaaagggtcatccatgttgcagcatgtatcagtacttcctttatttttattaccgcataggagctttctgagccagtaatttgtggtttgggttatcacagcgtttcctacatttggacaactgagggaactcatctgaaactgaaaggaagccagcatgaatacaacctagagtgaatgagattacagccaccctcatctttggcagtggcatatttgtgctgagccaaagatctgtcttaataggatggcaggcccaagttatgcgttgtgacctcctggtggcactggtctagtctaggaagggctcataggtgctggtataacaggatgaggcaagtgcctcatagcttgtgtttctggcttgggcagagcttgggtgcaattcctcgtcttcagacatctgagaaaagtatgtcgggatctcctggttgcatttgttctgtttgccagtgggcagagtacactgcactgtgcagacaggttagacagtttattgtaggctgatgaaagcagattaaaaaaccatcagcttggtgggaaactagctcagaatccaatccaaatgtcagatgaaatatttacacagccaggagataaaccaagggaaacagtgtgccctttgtgtgtgcttctgagtgtgcaggcacacacagagctgctgaccatttgtcaacttccaagatttattctgttgcttctggcaagggacagcctaatgatttaatagcttgtcaacacctacacagagaaacaaggactggcacttcctcatttcttattttctttgctttaaataggaatttctattccaagtcactggaacctggaaatcagactgtcagatttctcttgacttgagtgcacagttcctgaatctgagcatgatgaatgttataactttcctattatacaaacacagggttgctaccctttcagaatgacccattgagttcatatcctaaagcttgagtgtttgcttcagaccattgccatgagccaatttcaaatggagtgaaactgttttgtttctgtcccatgaacctcttgagttgaatgcctgcttgagcaatccagtgcctggttgccacatttacatttgagatggagaagttgtttagaggattttagtgcagaagattggatttcgtatgcagagtattattctccaggcatccttgggcagttgtgagttccctgaaagaagagaccatgtcctcttcaactcagcaaaccccacagtgcctagcacagcacctagcacactgtcatcttggttaattcattttcaaacaattccaccaagatctatgatagaatgacaaccagagggttatattttatattagaataatgccttctgtatactgggtctttatcccaaagacaggtagtatagcaaaatggtatagagctctacttctcaaagtttaatatgcatatgaattacctagggcttgttaaatgcaaattctgattcagttcctccaggctgaagcttgagattttgccattcttgcaagctcctgcacgatataatgttgccaaaccaggtaccacattttgagcaccaagaatctagagctatgctatccaatatggtaaccagtagccactagtgattagtaagcatttgaaatgtggctagtccaaattgagatgtgctgtaaatgttcagtacacaccagattttaaagacttagtaagaagaaaatgtgaaatatcttattagtaattttatattggttatatgtcaaattgataatattttgaatatgttaggttaaataaaacattcttaaaaataatttcacttgttttttttttatttttattgtggctactcagaacatttttaattatatattggctcacattatatttctactaaacagcactggtctagagtaggagtagcaaacttttagaataaagggctgggccataaatattttacgcttttcagaccatatgatttctgtcccaactactcaattctgctgttgtacacaaaagcagccatagacagtatgtaaatgaatgagtattggttgtgttccaataaaactttacttacaaaaacaagtagaaatggtagccttgaaaaccaacagcctacaatcatggtgaaaaccagcagcctggcagccaccagagggaacagaatatggactagaatgttggagctccttccaagcctcatttctgaacaattaatatttggcctgtctagtggttccttgaaagaccccacttgcaaggctttttttattaggcatgattcaagagtgtgctcagtgtgaaaaactttttccttggggtatttgtcaaaaataattagagacaaatgattaactttacagctgcctatggtaataggtaacagttgtggtgaacattaagctaaccaaaaagcttaaaagtaaatgctggggaatgagatgtccatatggagcttagaaaacctccaacaaatacctgggaatctaaaaggctatgcatatgcacaggatgataggcattcccaaggctgtgcacatgctcagaaaacacctaagaaaggccaaagttctcacctatggctgaacttcaagctctgtacaagtgaagtgctaaggcaaagttgcccccaacatacacacagagcatcttggtaaagactgggagacttactggctccatgaatttaagcaattctctgtacaatcattagctgacgactaacctaaccaagcagagacttctgtgaccccacgtgacaaagaatccagactttgcagaattaatttagaaaagccactaaacaggccaggtgtggtggctcatggttgtaatcccagcactttgagaggccgaggcaggtggatcacctgaggtcaggagtttgagaccagcctagccaacgtggcgaaaccccatctctactgaaaatacaaaagaaaattagccgggcgtcatggcgcatgcctgtaatcctagctacttgggaggctgaggcaggagaatcacttgaacccagaaagtggaggttgtgatgagccgagatcacgccactgcactccagcctgggtgacagagtaagactccgtctccaaaaaaaaaaaaaaaaaaaaaaaacactaaacaaataaacaccagcagcaacaacaacaaaactctggggagagggagaatttgttttccagagttaccgcatgatataattttaaacgttcaatttttaacaaaagttgtaagatatacaaagaaacaagaaaaggtgaatacataggaaaaaatatcaatcaacataaactgtcactgaggacatccaaacattggaattactagacaaagactttaaattaggtattttaaatatgtaccaaaatttaaaggaatgtatgacatgtctcaccaatatcaataaatatcaataaatagaaattatattaaaaataactaaatggtggccgggcatagtggctcacacctgtaaaaacaacactttgggaggccaaggcgggtggatcacctgaggtcaggagttcaaaaccagcctggccaacatggcgaaaccctgtctctactaaaaatacaaaaattagccaggcgtggtggtgggtgcctgtaatcccagctactcgggaggctcaggcaggagaattgcttgaaccttggaggtggaggttgcaatgatccaatattgcaccattgcactccagccttggcgacaagactgatctcaaaaaaaaaaaaagtactgaagggaatccttcaggctgaaatgaaaggatactagacagcaacttgaatccacataaagaaataaagaccaccagtaagggtcactacataagtaaatatcaaagtacaaatatatttttctttggaactcttttcttctatatatgatttaaaacacaactgcataaagcaataaatccactttgataagtgcacaatgtgtgaagatataatttgtgtgacaataacaacacaaaggagaggcatgaaaatggagctatatgggaaaaaagtatttatgtacttaggccattttgtgttgctataacagaatacctcaggctgggtaatttataaataagaggtttatttagctcatggttctggaagctaggaagttcaagaagcacggtgctggctttaacttggcctctggtaaggggttttgtcctgtgtcacaacacggcaaaaggtcaaagagtaggaaggcacatgcaaagaggcaaaatctgaggggctttataacaacccactcttgcaggaactaatccatttctgcaagaactaatccagttttgccagagtgagaactcactaccatgagaatggcatcaagccattcatgaggaatcttctctcatgacccaaacaactccaactaggcccacctcccaacactgccacattatggatcaagttttaaatgagttttggtggggatgaacaaaccatatccaaaccataacatatactattgaaattaagttgatattaatccaaactgtattgttaaaagttaagatgttaattataatactcaggcaaccactaaaaaaaaaaatatacatatacatatatatacacacacatacatatatatacacatatttatacatgtatataatacatttttatatatgtaaactaacaagaaaattaaaatggtacagtggaagatatctatttaataaaaaaagaatgcagtaatggaggaatcgagcaacaaaaaagcctaagacatggagaacaagtagcattgtggcatacatagactatgccttatcagtaattatattaaatgtaaatgattaaacattccaattaaaaattagagattggtcaaatggattttaaaaacataattcaactatatgttgttcataaaagaaatactttaaattcaaaggcacacgtaggttggaagtaaaaggatggcaaaagatatagcatgcatacggtaacaaaaagagagctggtgtggctatactaatagacaaaattataaatatatgtcacctaacaacagagcaccaaaacatatgcaacaaaaactaaagaagtgaaaaagagaaataagaaatttaacaataatagttggagatgtcaatactccattttcaataataaatagaacagctagggagaagatcaacaaggaaatagatttggacaacgtgataaaccaactagagcagaatatacattcttttcaagtgcacgtggaacattttctaggacagaacataagttaaatcacaaaagaagtctcagtaaatttaaaaggattgaaatcatacaaagtactttggaattaaattagatggaaaggaatgaaattagaaatcaataaaagaaggagatttgggtaattcataaatatgtggaaattaaacagcacactcctaatacaaataggttgaagaagaaatcacgttgcttcatggccttttggctaagttcaagtgtagtatctgtccttatcagtttaatatctgatacatcctctatctgaggacaatacattaaagggatttttggagcagggagatggaataaggactagtttcctccactccatgcatcaacctggtattgcagtacctccagaaatggtgcacccctcccaataagaaaaaaaaattaaaagaaaagaaatcacaaataaagttataaaatactccaagatgaatgaaaacaaaaacaaaacatgccaaaacttatggagtgcaatgaatgcagtactcagagggaaatttgtaactgcaaaggtctgcttaaaaataagaaagattacaaattaataacttaatctttcatcttaagaaaatagagaagagcaaactaaacccaaagcaagcagaggaaaagaaataataaaaattaggtggggcatggtggctcacacctgtaatcccagcactttgggaggccaaggcgggtggatcacctgaagtcaggagttcaagaccagcctggccaacatggtgaaaccctgtctctgctaaaaatacaaaaatcagccagacatggtggcatgctcctgtagtcccagctactcaggaggctgaggcaggagaatcacttgaacctgggagatggaggttgcagtgatccaagattgcgccaccgcactccagctctgggcgacagagtgagactctgtctcaaaaaactaaataaactaaaaataaaaattacagcaagaagaactgaaataaagaatagaaaaacagtagagaaatttggtgaaatcgaaagttggttctttgcaaagctcagcaaaattacaaaactttaggtagacttaagaaaaaaatgtctcaaattatgaaaatcaggaacgacagtggagatattactacccaccttagagaaataaaaaggagtataaagagccaggcacagcgtctcacgcctgtgatcccagaactttgggaggccaaggcgtgaggatcgcttgagctcaggagttcaagactagcctgggcaacatggtgagacctcgtctcaaaaaaaaaaagagcataaaggaatactatgagcaactgtatgccaacaaattttataacctagatgtaatgaaaatattcctagaaagacacacaataccaaaactaacaagaaaaaatggaatggagtatctgaatagacctaaaccaagtaaaatagattgaattaataattttttgaattcccacaaagaaaaccccaggcacatatggtttcactagtcaattctactgattgataccaataatggttgattttatttgtcaactttattgggccacagaaatgctcagatacctggttaaacattatttctggttgtatgtgtgagggtgtttccagaagagattaccatttggattagtagactaaatcaagaagattttccttcttagtatgggttggcatcatccaatctgttgagggcctgaatagaacaaaaggtgaaggaagaattatctctctctcttcctcccttcccttctcttccctcccttcccttccctccccaatcctcccctcccgtctctcaatgactgcttgagctaagatttcagttttctcctgccctaggactgagatttacaccatcagccctctggttctcaggcctttggacttggactagaacttacaccatcatttctcctggttctcaagccctcagactcagactagagctatacaaccagctgtccttggactccggtttgcagatggcaggtcaaaagtcttctcagcctccataagtgcatgagccagttcctcacaataaatctattttatgtagataaatgatagatttattcatctagatatttatttttacatatatttctagagagtgagagagagagagagagatatcctatttgttctctttctctggagaaccctgacaaataaaacttcccaactatgaagccagttctacatttataccaaaaccagataaagaaatcacaacaggctgggcacagtggctcacgcctataatcccagcactttgggaggccaaggcaggaggatcacttgagcccaggagttcaattgagaccaacctgggcaacttaatgggacccccgtctctacaaaaaatttaaaaattagctgggtgtggtggtgcatgcctgtggtccagctacttgggaggcagtaggtggagagggtgggatgggaactgtttgagcccaggaggtcaaggctgcaacaagctgtgatcacaccactgcttccagcccaggtgacaaagtgagaccctgtctccaaaaaaaaaaaaaagaaagaaagaaagaaaagaaaaagaaaacaaaagaaagtaaaagacaactcacagaatggggaaaaaaaatttgtgaatcaaaatatttgcaaatcatatataaaggacttgtatccagaatacatttttttttttttgagacagggtttcactcccatcacccaggctgtagtgcaatgacgtgatctcagctcactgcaacctctgcctcccgggctcaagcgattctcctgcctcagtctcctaagtagttgggactacaggcgtgtgctaccgcacccagctaatttttgtattttttgtagagatggggtttcaccatgttgcccaggttggtcttgaactcctgaccttaagtgatccacccacctcagcctcccaaagtgctgggattgcagacatgagacatggcacccaggctcagaatacatttttaaaacccttagtactcacctagcaggccaggtgcagtggctcatgcctgtaatcccagtgctttgggaggccaaggcaggaggatcacttgagcccaggagttcaagaccagcctgggcaacatagcaagacccccatctctacaaaaacttttttaaaaaattaggtgggcatgttggtgtgcacctgtagttttagttacttgggaggctgaggcggggaggattgcttgagcccagcagtttgaggctgcagtgagctatgattgtaccactgcactccagcctgggtgacagagtgaaaccctacctctaaataacaagagcaaaataacccagttttaatatgggcaaaggatacacatagacattgctccaaagaagatatacaactggtcaataaatacatgaggaaatgcctgacatcattagtcattagggaaatgcaaatcccaaaccactatgaaatatcacttcactcctactaggatgacaataatcaaaaagatggataatagcaaatgttggcaacaatgcagagaaattggaaccctcatacattgctggtggaaatatcaaatggtgcagccactttggaaaacagcacggcagttccctaaaaagttaaatagagttgccaaatgacccagaaattctattcctaggtatataaccacatatcttcacacaagaatgtgtacatagattttcatagcagcactattcataacagccaaaaacttggaatcaacccaaatgtccatcaactgataaatggataaacaaaatgtgtatctatacaatggaattcagccataaaaagaacaaattactgatacgtactacaatatggatgaactttgaaaacattatgctaagtgaaagaaagacacaaaaggccacatattctattattccatttgtatgaaatgtccagaatatgaaaatccataaagacagaaagtagattactggttgccaggggataggggaacaagaagtgaatgctcagtggatatgaggtttccttcatgggtgatgaaaatgttctggaattagatagtggttgcacaactttgtaaatatgctacttgtgaatatactaaacaatgcactctaaaagggtaaattatatctcaaggaaaaaaaaggcggagggacagatttggctcatgggccatagtttgtcaactcctggtctaaagcaatgatttttggagtcacacagaccagagttagaatcctaattttcaacttatgagctctatgaccttggacaagtcacttaatagctttaagcctcacttttttatatgttggggatatgtatagtatctcccttgtattgtgtgagggtggagttaggtcaaatgtaagctccatgaaggcactcaatctccagggcctagaactggcaggctctcaatatacatgaatgaataactaaaggatttaacacagtcgctgactcatcgtaataaataatagcaaatccttatacagtatttactgtattacaggtactattctaagtgctttgcagaactttatttcatttaatacatagtattattatcatcctcattttccagatgaggaaactaaggtacaaaaaaaattatgtaacttgccccaaattatacagctagcaaatggtacaactaaaattaaaacccaggcagttgtgctcataagtctatgcaataaatattgaatgtcaattatcatcatcatcatcatagagtttaaaacatatccaaggatacagatctcctttctccttttggtatctaagcacatactaacaactctacttcctcagtgtttgatttagggtgaggatgcttcccaagtctctgatgttctgctagagaacatgttcattctttcatccatccgttcattcatgtatttatcaagcatgtacaggatccctactgtgttctaggccccgtgctatatagagataaaaaagacatactctctatcctgaaagagctcaatgtctagtcgggaagacaattataatccacagtgaaaagtgctgtagtagagattatgcaagagtgctatggaagcagagaagacccaagcagggaatagtgtggaggtaggaagaaggaaggacctgtgaacacttcctggaggaagtggtacctggagaatgttcccaaaaaggaatgtggattagttgggtgtaggaagggagaaataagtcaagattaggttaaaatatgcatatatatatagactgaaaggcccaggagcccttggtgaaacccagggaacaaacggcacagagtccaacatgaccaaaagccaggtggcagaggggacctgaaaaagctcctaagggcccaagtgccattcaagtttggtcctgagcaactaattacccagcattccccaaccccttaccctactttattttcctctgcagcacttatcaccatctgacatgtacatgcttgtttatttactatctgtcccctcccactaaaatgtgagctccctgaaggcagagactttgttttgttcactgctatatctcctttgactactgcatacacatgtttggattgcctgcattcataggcactcaataagtattcttaaataaatgaatgaatgaaataaaatcaataaactaatgtcctgagagctctagggaagacagtgatgattaagatacaggacccaacttccaggaacttataggcttagcgagagacctaatacatgaacatgagtgcctattgcactctgtctcctctcttctttcacttcctgctttctctcctagaactttcagactgttgtctgaccattcaaaattccccatccctcacaaatatttctccaccgcatccaggacttcctagttcccaaaagtggctcatgttccaacatacacctgccctccttcctggctctgcccatccaaaatctcattcctggtagctgtccgagtctactagatgttgttagcatgctcaaactaattttcactaatgtatgactcacttccagagtaatctagggtatattacttttttaacttttcattacgggaactttcaaacataaataaagcagagagaagagtataatgaacccccatgtacccatcacccagcttcaacaattgccaatattactattcctatttattctatcccccattttttttctgaagaattttaaagctgatcccaggtatcataccatttcatagctgataaatattttagtatgtatctctaacagataaggaccttttcttaacataaacacaataccattatcaaactcaacaaaattaataatcccttatcatctgtggtggttaatactgagtgtcaacctgattggattgaaacatacaaagtattgatcttgggcatgtctgtgagagtgttgccaaaggagattaacatttgagtcagcgggctgggaaaggcagacccacccttaatctgggtggacacaatctaatcagctgccagcgcagctagaatataagcaggcagaaaaatgtgaaaggagagactggcctagcgtcccagcctacatctttctctcatgctggatgcttcctgccctcgaacatcagactccaggtttttcagttttggaactccgactggctctccttgctcctcagcctattgtgggaccttgtgatcatgtgagttaatacttaataaactcccctttggccgggcacagtggctcacgcctgtaatcccagcactttgggagcccaaggcaggtggatcatgaggtcaggaattcgagaccagccaggccaacatggtgaaaccccatctcttctaaaaatacaaaaattagccaggtgtggtgccacatgcctgtagtcccagctactcaggaggctgacgcaggagaatggcttgaacctgggaggtggaggttgcagtgaaccgagatcgtgccactgcattccagcctgagcgacagaatgaaacttcgtctcaaaaaaccatgtagttctgtttctctagagaaccctaatacatcagctaataccaatctctgttaaattttacctagttgtccccaaaatatcccttacatggatttgttcaaatcaggctccaaagaaggcccatacattaggcatatacttttaggtttaagtctacttgataaaatttcaggccttatggaaaagtggggactaatcagcttgaagcccctctggacatcccagattccctaaccctaggagcttcaggatagcctctccctggctggagaaaggagctagccattcaggccccaggttcctcatcagatcctttttctgttccccaataaggggtggagggactgtcaccttgcggtggagtggggagacaaggagaaccaaagaaatgccttgcaagcaagtttttggtctgtctcctgtccaaccacccctaatccccacctccatcctagctgacctcagaaatatttggttcagctgcgtaaatgtcatcgtaattacagtcattctttggagctgcttatcattatgcctaattacagtacagcacaataatcattatgtgtatcattaaagatgtgtcagattgactttgccatgagttttattttatttcaatactaaattgctccagtaggcacagcctttagagcttgttgctcctggtccctactggggagcaggagaccagctgttggccagcctgcatctgagcatcccatcctgtcccatccagtcctgtacactgccacctgcactggctctgctgcagcccagttcggaggtgcctgcctgcctgcttgtctgcccttctgctgcatggactgcacacctgggcttaaggcagagtgatttgcacttaacaaacaacagaaacaaacaaaacaacaaaacccttcaggctctgccagcatcaaccactgcttcccctgtccaccaggatctcagtcaagcttctcattgattcaatccatgcaacatcttcattattctccctatatgatagggaatgtgaaatgagctgatatgtccaaagtcatcgggttcatcattagcagaaccggaaaaagaactagaagctatgatgctgagccagagcttctgtgggagccctggccaggtcaggctccatgcgttaggcattcgtctctggtagtggatgcattttcagttttcaaatgtactaaacgatgctatctgtgctgctgggcaacttcctgagaagcaagcacaggagagttgaggggtgtgggggcggggagcagtacttttccaactcgtgttttcgtgctgtgagaaccaaactgagagcctggacgaggtcaccctacaccttgcctcactggtacattgtcaggctgcctctgccagcagacttcttgcagcttgccagaaccaaggtcgtcacgaatcagataaaccagtgttgaagaagcatgtgtaacatatcaaatcattgcctaatgagcctttcctctgggtcctgtgcagacctaacaagtgagttcagtgcatgtttgctcaaatgctcatttattcagccagccttgagtgagggccgtctttgtgccctgcgttgtgctaagaaagcatctttgtgctaatgtagttcttgctcctaagagctgcactcacggcccaatggggaaggacagcatgtaaacaaagatgccagagtaggccagagggctgtaaaaggccttatggatggccaggcgtggtggcttatgcctgtaatcccagcactttgggaggccgaggcaggcagatcacaaggtcaggagatcgagaccatcctggccaaaatggtgaaaccccatctctactaaaaatacaaaaattagctgcatgtggtggtgcgtgcctgtaatcccagctactcgggaggctgaggcagaagaattgcttgagccagggagtcagaggttgcagtgagccgagatcgcgccactgcactccagcctggcgacagagtgagactccatctcaaaaaaaaaaaaaaaaagccttgtggaaacacacgggagggaatgaggaactctgactttggggagttagcaaagacttcaaagaggttacatttgagctgggtcttgaaagctgagtaggaatggtctaggctgagaagggagggctgggcattctctgcaaagggaatggtgaacggaaaggcaggcaggtgtgacagagcatgaaggaacccaggatccttttgcagataaagaggaaacgagtttccattaatgtatctcatggccttaataatttaaggtcagacctggttgactggttttccatgacctttgcttccctgccccgcttttgtgccagccttttggcctttttgcagtagctctgaatttagctcaaaagcttatgctgaaatatgccatttcattttgttcattctatattttgtgccaatcacactggcccattgaatggcttagctatatgttattctaggttttgtggagcagcaaaaggaagcctttttctccctagagtcaaactcaaggaagcagagcctgctgtgagaaaggatggcacaaaatctttgaggacacctgaactccatgggctaggcatttgccgcccatgtctgttgtcagctgaatggtgtgtttgtttagctgtgactgctctcttcattagaggggcattaaaatgctgttggtttgagtgtggcaaggtgataaatcatccttgtgtggactcttaaataaactattaggggacaaacctaagtatgcctttgctaatctgttggtgagcattagccacatctagagccttggaggggcccaacagccataagttagagtttttgtaatgaaaatgaaacccccttcatttatctagcctcagaccttttcacacaatttcttcctgtgagcctcatagacaaccctttaaggttggtggggtgggaactcatgccccatttgaccaacgtggcgacagagccttgaagaattaagtgttggtggaaaccaggcccctgatcgcagtgctggggacctttcctactactccgtgctgcctgctgctgagccagcctttcccctgtgccatgtgggcctgggcagaggaggcactcacacatttacaggacagctggctgccgggaagcaccaagtctacaactgtggaacaggctccccgctatgttcacagtacccttgccttaagaaacacctctggatgcttgccatgttagcaccaaactagtgtaaggtagataaagaatgacaaaaagcaaccttggagagcaaatacccctccaagatctatgtcatttactcccttcttaccagcaggatcaggttcaacctacataaatctattttagtgtattttaattgcttgtaaactaagtgtttcctgtatatgccactgaccatgaataattagaatcatttcaatgactgggttttgggaagtgaatgggagagcagacaaaaaggggctgctcagaaacgagagtcatttgttaaagcgtgagtggaagcgttgtctcagccttccccagttttggtttgtttttttcatgatgtcactagagccgcctgtttttcagctactctggctgcccttcattttgtatgcatctctcatgttaagtaatgccagctgctgacaatgaccaggcctgactggccacatgtcagagtcattcattcactcagcaaagatgtatggagcgcctactatgtgccaggcccataccaaatcttagggacaaagaaaagaataaggcccagttcccacccttgaggagaacactgcccagtggaggagacaagcacaaaaacagttacactagaatgtgtaagtgatagaatcaagaggcagtgagctgtgggaacacagaggaggaacttactccatctgggggagctgggaatggcacagtagagaggcaacatttagcaagggctcaaaggaaacagaagaattgaccagataaagaggagtggggagagacacttcaggtcaatgtggctacagtttaggggccgtagcccaggtcgtggtgtgcgataaggctggagaagtcagctgagccagactgtgaaggcctttgtatgtcctgctttcaagtttggactcagtcctgcagtcagtggggagccgaccatggtttttaagcaagggaatgacatgatcagatctgaatttctgatggaaagctcaggaagggaggggagacagggaaatcagttagaggctgactaggattttgctttgtcttccgtctggattgcaggagctccttgcctgcacctctattatggttcttcccacagtgcattataattgatcatttgcatagctgtatctccattcactccttgagggcaggggccaagtcttgtgcatctcttcatgaccagagcctggcacacaggagtgctcaagaaacattggtatcatgtgaatgagtgaataaatgaatcaataggtgctgagcaagtgcaactccagtttgccccaagtaacctctctgatgggtatatcagagataaatcctactctgatggagtagcaattccatccatggcttttcccctctctgccaagcccatcattctatcgtggtccatcacaaaagaaagatgcattattcaaagcagacaagaaagttgcttacagagctgtgttggtgctggttttgacccagtactctgttctttctctacaaattaatttttgatgacttgtttacagtatatcttcattgtccttattccacttcttgtgcatttcataccttctcttccttcttacttaaatcttgctcatccttcaaggccagttcaattgcctcccatctcctccatgaagccttattcattactcagcccccatactcagaattaagaattcccacttcagaatttcccttgagaaatgacttacctctgacattcttctcattatagttattcctgtacttgtctgcattctctactagactgtaagctcctcaagaccagagattatatctgtgtcattatcatctccccagcacctaccacactgaatcctgccccagcagataaccagtgagtgttttcaaatataggttgagcatcccaaatttgaaaatctgaactttaaaacgctccaaaatccagaactttttgagaaccaacatggtgtgcaaaggaaatgctcactggagcatttcagatttcggattttgggattaggcatgctcaactagtacatataatgcaaatagtccaaaatctgaaaaaaaattcaaaatacaaaatacttctggtcccaagtatttcggaaaagggatattcaacctgtaatacccaaagcatagtgctttctatcgggctctcccctgagagataatgccagtcttgggagtactctatgcctctttctatcttcttgcacacggttagatatagttttctttgtttaacaagtaatgaggaaaaaaaatcattgctcatcaaacaatgggaatatcacagagatagagatctcctaaaccatattatttcgggggtctttttttgtacatatttagagggtacaagtgcaggcttcttatatgcatatattgcatggtggtgaagtctgggcttttactgggcccatcacccattatttcgggtattttgatgaaatcaggaacgttcaggatggtattatttcaggtattttgaatgcacaaaattcaatgcctctaaacaaagcataaacacactaacccattcagggtcataagtacaaatctttcttgaagagcttattgtatggtgggactttttgagtaaacaaaaaaaagatgatgagcattctctttggaaggacttacaattagctctacttggaacacattatgcaaaataccaagaattcaaattttccaggtagaaatgtccagcagatgattataaatgcacgtcagaggctggtgacaaacactgacaggacccagagatgtaggatctccacataggcgtgattacaacaccaacagagggcgcgaactcctgcaaagagaaagaagagaggctgaggatataacctgagggcacctacatttcagagacagatgaaagaagaggatccagggaaggagactgagaaggaacagggagagcagtggttatgagagagaagatagtgtgatgacatgtgctggagagagatcaaataggatgagtgataactgaaaagaagaccttagttgggcaattaggaggtcactcttgatgtcctaaagcaggaatagcaaatgtagggcacatatgactacgtgccctcagaccccaccctgccggggtctatgtactcctatggatacattacaaattgatcatggcctgcttccctgttgaaccaaggcacagcttcagaatctttctcaacacagtaccccaagcagctactaccaattgatccgagttgtcaagaagctgaaatctctttgccatctctcttctaaaaaacagttcaaggctgggcacggtggctcatgcctgtaatcccagcactttgggaggccaaggcgggtggatcacctgaggtcaggagttcaagaccagcctggccaacatggtaaaaccctgtctctgctaaaaatacaaaaaatttagctgggtgtggtggtccacgcctgtaatcccagctactcgggaggctgaggcaggagaatcgcttgaacctgggaggcggaggttgtagtgagccaagattgctccattgcactccagcatgggtgacagagtaagactccatctcaaaaagaaaaaaaaaaagttcattggaggtgtgggttgcagtgagttgaagtgtctgagaaatgaggaggtcaaggtgttgaagaaaagagaaattttaagaggttcagaagtgaagggatagagagagggcagttgtttggagtagtgtaaggatcaattcttattaatcctccagtagaagcagttttcaaagtcatcttagtacttgtccagcaacaagccaggtaaagcaatatccctatacccttccttcttccatccccacccttggcttaaggaaaatttgatgtaaaaaaccttcgtgtgtaggcttgtttccaaaatattcatttgattaacagagacatatggtataaccagagttggctctgcacacagtatgaagaaggaattgtctctaatcgtggaaatttgaggatcagcagtgatggggcaaggtattagtcttggccagggctcttccctaaaactcttgaaaccataccctgaaggaaaattctggcctgcagggagacccctgccaccctgcccttgtctttcctgtctcctcctctagacctccttcttccccttcccaatctaagccccttctcatttttatctcttctactcctttctgtcacctctgtcctgtgcctctctctcctaccacttcaagtttctcattccctcctcttcttttccatctttcttaatagtcattttcacttggaatccttctcttcttgatctctctgccactctttctggcttcagggttttgggatacagggtaagctcttaagaattcaccctcattcagtctaaatggacatttgtaaagaaatccaattttactactgcccattacattcagagctctgtttctttgtacagttgataaagcacaagaaaaagaatgataatattcagcatttaatagtatttactgagcatttataataagccaagcacactgttctaagttctttacatgaattcactcatttattgtcacaacaatcctaaaaggtaggttctgttattattcccattttacaaacaagaataccaaaatacagaacagttaagtcacttgcctaaggtcacacagctagtaggtggttgtgttagtccatctgcattgctatgaaggaatacctgaggctgggtaatctataaagaaaaaagacttaattggctcacagttttgcaggctgtacaagcatgacaccaacatcttctggcgaggcctcaggaaactttcaatcatggtggaaggcaaaggggagccagcatgtcacatggccagagaggaagcaagagagagacgggggaggttcctgactcttttaacaacaaatgtgacatgaactctcagagcaagaatgcactgattaccatggggagagcaccaagccattcatgaggatccgcacccatgacccaaacacatcccaccaggccccacctccaacattggggatcacatttcaatgtgaaatttggagaggacacacatccaaactacatcagtgtagagcaaagatgtagggctcatcccatatgactccagaaatctcagtctttaactgctgtgcgtattgcttcatgacatagtggaagcctataaaatgggaagttcaaagtcattggttcaagttcatatctcttaactgtattacatagtgttaaggttatgatcttggataagtcacctaatttgtccagtgccccccacatgtgagggcattttattgtacactaaccaataccacatactttagcttggatttattcctctgcttttgctataattatatcttccctctctatttgattgtcatctccttgagagcagtcaccagaccttatttttttttttttttggtactcagcttgcccccagggcctagaatgatgcttagcacctagtacaatgcattcatgtgcacacatgcaaacatatacacgcacacacacactactgtggattgactaacataagaacctactaattagatgacatgcaaatgggctatatatatgtgttcatgaaagcctctaagtactttagctaatgaaataagatgttaatattgagcatattctttgcttaaatgtaattagtgctcaagttacagtgagctatgattgcatcactgcacaccagcctgggtgacagagtgagatcttgcctctaaataataataataattataataattagtgctccattaagataacatttcccaggtttacttgattattttgcttaataaacttttttataccaataggtaaaaccattaaaatatctgaaaaataaaaccatttccatgccctcttcattcactcaaacaattcttggcacgaccatgcactggtgtataagcctcaccaccaagcagttcttaagtgccaactctgtgttcagaggtaaaatgagtaccacaggtaggatacagatgtagtctagacaggacaccaggtttctattccagcaactaagaattcactttttttccatccccatcttcacctccacatgtagcatcttatcttcaatagcccctatctccctgaccttttggttgtgctctggacactcccaatcccccatcctcctgcctgctcacaagcgcttttgatgtgctgcttcctgccagttcaattcaacaactaatggagttattatttttgtttgtctgtgttgtaaagccatggcaataaaatctactcccaataatatcactgcaattttatgtccttaaaatgtaccataaatgccatatgtattcactgaatttcctgtaaacagaaatgtttttctgggaaaaaagagggcttttttgtttccatcatggttgagcctaagttctttgatggagtaattggtgatataggaaagattgagaagcatcattcaagaccatgttatggttcaaagtgctggtgccgtgttattctggtcatgatgagttcttttcaaacagtgattcaggacaagaaatgctcttcctgaccagaacccacattaccgtcacaggcatgacttccccaactaaaaacagtaaagcctcaggggtctgcaagagagattggcattgaccttgggcttgccctgatagaagcaagtataatttttaggaaaaagtagactgtgagttaacaataaaaaatgtgagagctgcttggatttttatagaaagggatttggacagaagctctttctttcttcttcttttttttttttgacggagtctcgctctgtcacccagattggaatgcagtggtgcaatctcggctcactgcaacctccgcctcctgggttcaagagattctcctgcctcagcctccctaggagctgggattacaggtgtgcggcaccacacctggctaatttttgtatttttagtagagacagggtttcaccactttgggcaggctggtcttgaactcctgacctcgtgacctgcccgcctcaccctcctaaagtgatgggattacaggcgtgagccaccacgcccagactttttttttttttctttttttgagacagggtcccactgtatcaccctggctagagtgcagtggtgcaatcttgactcactgcaacctctgcctcctgggttcaaggattctcatgcctcagcctcccaagtagctggaactacaggcatgcaccaccatgcccagttaatttttgtatttttagtagagatgggagttcatcatgttggccaggctggtctcgaactcctggcctcatgagatccacctgcctcagcctcccaaagtgctaggattacaggagagagccaccacgctcagccccatcacagtatctctttcccatccactccatccccacagcaatcactctggttcaagccttttttgtcccccaccttgtactattgcaggtgcctctacatcagtcacccagctttgcatttgctgctctcagttcccataaggcacagcttcagtcctgaccctgcctcattgcctgtcacatcatgtcctgtctcctcaacatgggaatcaaggcttcctgtgctctctttttccaacattagcccactaacagcacttgctcttccccaaacttgtcctgcattctcttgcctcctctaactatcccccgacacacactccatgcctgcctgtctagaatcaccccatccttcaagaacctaattcgccctactggatgtgaatctgttcagaatcccaatcattttatttcattcattcagcaaacatgaattgggtgccttttattttccaggccttatgttaggagctgtggataatatagagatttaaaaaaaaaaacagtattcttcccttgtggatctctgtctaatgggccagaaatacagacataactaactcgaaatacctattatgctgcccctgactcccatcctatagattcttttccctcagcccataaacatacttaatatcctcccatcttaaaacacccacctaccccagccctacccccgtatcaaactcctgaaaaaaaagaaaaaaaaaaaacagtatacagcaggggtccccaacccccctggggccacggggctggtggcctgttaggaaccgggacacacagcaagaggtgagcagcaggcaagtgagcattaccatctgagctccacctcctgtcagatcaggggcagcattagattctcataggagtgtgaaccctattgtgaactgcatgtgcaagggatctaggttgtgcactccttatgaaaatctaactaatgcctaatgatctgaggtgggacagtttcatcctgaaaccatccccacctccctggtccgtggaaaaattatcttccacaaaaccggttcctgatgccaaaaaggttggggactgctggtatacactagtctccttcttaaccgcccttttcttagtttcagttacctgctgtgtcaactgtggtccaaaaatattaaatggaaaattccagaaataaacaattctcaagttttaaattgcatactgttccgaatagcatgataaaacctcacactgtcctgctccctcccacccaggatgtgaatcatccctttgtccagagtatccatgccatctatgctacccgccattagtcacttagtagctgtcttgattatcagaccaactgtcacagtatcacagtgcttgtgttcaaattacccttattttgcttaataatggccccacagcacaagagtagtgatgcaggcagttcggatatgccaaagagaaaccataaagtacttcctttagtgaaaaggtgaaagttcttaacttaaggaaggaaaaaaatcatatgctgaggttactaagatctacaataagaacaaatctatccatgaaatcctgaagagccgggcatggtggctcacacctgtaatcccagcaatttgggaggctgaggcgagcggatcacttaaggtcaggagttggagaccaggcgagaccagcctggccaacatggtgaaaccctgtctctactgaaaatacaaaaaaattagccagacgtggtggtgcgcgcctataatcccagctactcgggaggctgaggcaggagaatcgcctgaacctgggtggtggaggttgcagtgatccgagatcatgccaccgcactccagcctgggcaaaagagcgagactccgtctaaaaaaaaaaagaaagaaagaaaagaaatctgtgctctgtgctaggtttgctttcgcgcctcaaactgcaaaagttaagccacagtaaaggataaatgcctagttaagaaggaaaaggcattaaatctgtgggtggaagacaagagaaacctgttctgattgacagcaatcaggctcggtactatctgcagttttaggcatccgctgggagtcttagaatctatcccacgggaataaggtggggactactgtattcccgtcatcactctcatctctgcctcctcactcccattaggcctctgcccaccctccactgactttgctgcagcaaaggtctctttccaatggacaaatcagaagacacctttcagcctccctcttttttaccctctcagcaagatttcaaattgtcgccagaactgtttccactcctgtgcccacctctgaagtattgctgttccccatgatttttccttgcctctcccctcttcttactctgtagtaagctccccccacccccagcaaccatggcaatcttgtccaattccttgattttacgttgctggtaactcctaaatctatgacatgcattgtgtcgtaggcccaacctctctcctaaactaagagaccactctgtcatcagcatcctgaccctcaacatgctcctaactgaactcccctctcacacacgtacaccctaccaccgaaccttctcctctgcttgtatccttcatcccgttcatgctcctcccacacagccagaaatccttgccattcccctcttccttattccccacatgcaatttactgtttaaccctattgatgctatctttgaagtttttctatcattctattccttccaccctctcctggttcaagccctattaccattccacagggctacagcagcagccttctaactggtgtccctacttgcattcctctcctcaaattccgataccttctccacgctgtagcctctgagccctctaaaatgcacagctgatctcttcattccctcatttaaaagcttgcagaaggctgggcatggtggctcgtgcctctaatcccagcactctgggaggccaaggcaggcagattacctgaggtcaggcattcaatcaagactatcctggccaacatggtgaaaccccgtctctactaaaaatacaaaaattagctgggcatggtggtgtgctcctgtagtcccagttactcgggtggctgaggcaggagaatcacttgaacccgggaggggaggtggaagctgcagtgagtcgagatcacgacactgaactccagcctgggcgacagagtgagactccatccccaaaaaaaaaaaagcttgcagtatctcccacaagcttctactcacttatcccacaaatatctaccacctactaggtgcacacactgttttggaaactggcaatgcagcagggaacaaaacaatgtcctgccttcacggaccttctagtcggggataaagccaaatgccttagcagggcccatcatgaaatgcatgcctgcctccctagccttgtgtccttcttctccttgtccgtgccccctagtcatatctaattcacttcaatacctgaaatgtgccccttatgtttcatactctctgcctccctcccatcctctataccccctttgcagactctactccacagtcactttttctgggtagtgtataggctaccatagctagtgctgatcttcagaatgacgtgagttcaaatctccgctccacacataccagctgcatgacttctgtcaagttatcctactgtcctgggcttcagatcctcagcttcaaatggaaacaatagtagtacctactgcatgggttggttgtgagaattaagttagtcaatctattaaaaatgcttagacactttaggtgcctgacacataataagcttgtaatacgtgtagtattgttaatattataccactcatcacactgctctataataatccctcctatgaaacgtgtcttattgtctttgtaccccaatgactaacctagctgggcacatagtagatacttactaaatgttgaagcaaggataaaaggattggtggattcaggttcgttgcttggtttcctctaatcaaacatgattatggaggaataacagcaaccttagggcttcttctgaatatctttttgaccaactatctaattgtatgccgctttcactgtgtgagtaagacctggagagacatgaacaagaaaagagcattgaggtgggctgaactgaactcaagcttgggctgatctgaactcaagctgagctatttacatttctttcttcattgactctagggttgagaagggaccaactaccctagaatagccactacctttcacttccatccctctgccccatctcatactttccatttgcccccttttcagtaccatgttccccctcaaaagtgcataaactgaagcccagaaagcaaaagaagtgctgagggggaaaggggaaggggtggagagaggttagcacctccctctttccttcagtgagatcaaagccagcattttcccttgaaggtcagctggcctctttcatcccctgctccacctgtctgggaatgggattgctgcttgcccatttcctttcctcttcggggctggaggggcctcaagctatttctagttctagccaaatccctccactccaacatctcttttgccttacgtgatcatatttcctttccacctcgccagtaagtaacaagtggcaggaccatagggcagaaaactatgagagaagtcagtttctccacaggctagtcagtttctcctaggctaagctaatggcttaagcaagcggggagggacactgaggctgctgggcttggtctggcaggaagaacagactcatctttctacatctcggccctaagcgcttcacctgacatccttcagggtgtggatgaggcttggttaggcaagggcctcttgccccaggagaagggaattcacatttattgaagtcctagtatgtgctgggccctatgctaggcccttttatagatattatctcattggctcctaacagcccaaccaggtcagcatttgtcatcgtcaggtggaaatgatgaaacagagattaaaaagcttacctgatgacaggtacactaaaatctcagaattcaccactatataattcatccatgtaaccaaaaactacttgtacccccaaaagctattgacatttaaaaaattttttttaaatgaagcttacctgagacacacaagctaaatccaggcaccaaaatctagctcccccaactctaaagccagtgctctttccacttcatcatgctgcctcaagagtctagaaaaactgttaatgctatgaattgattctttgaattatttcacacaattagctatatggctagctaaacccttggtgagttaatttaattcaacatacatttaagggaaacccgtgatgacttgagttggacactgcagggtatgcaaacagaacatgacagaagtttctacctttgcaggccagccagctgccatgtagaactggctcacaacacaaggactttcttaaacaatctgagtcccctaacctaagaacagtgcaaataagcaggacctgggaataacatctgattggcaaaggtggggagaacttgaggaacccagactttgctattattaccagcagccagcctgcttcagcaaagaatgggttatgtatgactgtgcctaccgtgtcgctcagttagttaaaaccaggtgctaatgaaaccaggacaacaggcttaatcccagtagaattgagttctgtcacatagcagccagtcctggtcccagctgaccatcttgcaaccatatgctcttggtcaaagagggagctaaagtaggagagtgagggtaagtgcataataggcacacataagtgaggacgtgttgttccaaacactcagccctaatcaagcagctcatgatgtgtcactgacagagaatcagcagtgtcatcttcgcacctggaggcagaacattccctcctcctatacctcagctaggtaccctgcacctgatctttatagcacgttgatgccagggcttcaggtctccaagaggagcttcttcattgcagctgcctttcttctgttgcgctatctaagcctgtctttccatacccatgaaatgagtgtaccacttgacacactctggggaagaggctgcctaaggagagagtgtcacacctgtttaaaaccttctcttccatagccaagcccacaaattcctcaaacttggactgaggggccctccttagctaaaaatacaagcctctcaagtttcttcaaccatgatacaggggaaagggggtaatggttctggatgtgtcccccaggtaacctctcttgtctgttccacatatgggtttggtaaagccaatctctactcaaagccttttctatctctggaactcagggcttcaggtatcagagagtaataactccagcaggaaggacctaagcccctctctctttctagatcagtccatacacacatatacacacacaaagggcattataaacattggcacagtcttggccatttttcttttaattaaatgtgtagagttttctgtcatggatatgcaaaaccatctcccaatcaagttacttccatggaatctacaaagacactgttagaatccctagagattgttccacaacatctcccacggtgccagatgtacattcagactcttaacaaggataatttggtgacaatggcaataactctggattatttttaagaagctctttgaatggcatcaaagtcatgacgtatatcaagatccttttttcatgccctctgtaccattttgttttcatggaatttgaatttccctggtttacttaccacctaacaatatcactattgaaagcacataatgttaaggaccatatgctctccctctggagagtgtgcacaaatactatttctgttaaaaactaaacagaaatagtagctttgcatatttcccattcaaagacttatcccaattgaatgattccctttgtcgtggagtggttttccccaagtcagccctaccagagaagctgaatcagatattgtgactccccagtggtcacaaggagtcatctaccaagctagaaatagaatccacaaacatttattttgattctttgaattaaaaaacaaataaactctactatagagaaagaaaaattaaagtagagaaactagacttctttgccattcctgggccagggaattcaaggcaaccaaaactaacaaagcagctgccatggtctgtggggaccaaggaaatgaataagacacaggtgctgcctgccttcggggagctgacagtccagtgtggggcgattgggtcactgttgaaaaatctctacccaatgcagaatatgcctgtgaacacctagaggaccccagaggaggtctcatccatctttatagtccctctgcaacaagcacaatgacctgcatgtgatgtgcaggcaagtactgtgtatttaagggccctgaaagaagtaccaacagaatgctcttggggttggtggagaaggagggacagctttgtgaaggaggtgacatttgagctgtgcctggaaggatggggaggtttttcacaggcagtggggactgggggagggcctttgcagtccccaggaaagagcaatggcaaagatcctaaggaaagagaaagcacggtgtgatttggaagagcaccaagcagtctagtgtggccagaggacaaggaagcagtaagagctgaagttggagagaaaagttgagacctaagcagagagaccgttggacagcaagctaaataatttcacaggggaatatcattgaaggtctgagcaaggggagtagtgataccaccaaggcagggcttcctgctgcatcatcctgttctgcccaaggaggcctcccttgccttgttggtagtatgagtttcttttgattgtttgtatgtggttggtttggaggttttatgtggcttaatttgttttttggcctttcccttttccttacagtttttcacagcatatggtcctgattatgtgctggaaatcacgccaagctgccggccagaccgcaatgagccccaccgaatccaacaaatcctcaactacatcaaaggtgagcaccgcccctcgaggcctgccctccttgttccacccagtttgtggtggcccatcagtgggggcttccttaaataccatttgccttttggtaagctaatcatttcactgacttggaaaggaaacctcttcttggcctgacagcttgtagctggaattctacactggccactctggttgggattgtcatttggctggctaatgtcacctcagaaggacaaagggttcagcttttggcactgccaggggaaaatcagctctaaagtgttccctgagaccctttttctttcaaaaggccaatagtaaagcactctttaagatgagaaaagttggccgggcaccgtggcttacgcctgtcatcccagcactttgggtggctgaggcgggaggattgcttgagcccaggagttcaaaaccaacctgagcaacacagcgagattccatctctacagaaaatttaaaaattagccaggcatagtggcatatgcctgtggtcccaaatacttgagaggctgaggcaggaggatcccttgagcccaagaggttgaggctgcagtgagccatgcccacaccactgcattccagcctgggcgagaccctgtcccaaaaaaaaaaaagaggaaaattcaagtcaattcagacttagcaggggtggggagggggctcacaggcattctcttccagtatgtatgagtccttgatccagtagagccttgaaagaatgtggaactacaatgagtagtcagggattctgatgccctgggagtgggttacctggactcagccagagtgctgcagatgggctgctggcctagcctccttgctggcctagcctccttcccggcctagcctccttcccttccccaaggctggcctggaatcattctggcctcggggtagaggggaagtggcagccatcagggcatttccctcctgatcccactgtccactggctgtttggggtcactgtcctcagcattctagtagcgccccctctgaactccagctgcttcttcacaactcactttatccaccattcgcattacgtatttttggcacccattttcctgtttaattaaatgtacatatacatatgtgtattttttagatcctaattatttgccagagttaagaggccaagggtatctttttgcctaacctggacagggaaattctcatgtttattcataaaatgaccaagatagcaccagttctcctacctttgagtccctcgctggaatataatccaacacaaaaaggaggcctgttctatgctggagttagtctgaggaaacactacactcggagagtctttgctgtgagttacattaatgcccctatccactagcagagcccagtaaatgacagcagcaaagtcttcatgtcctgagctcatttagccagagaaaagtttttaagctaagaagtcatagactctcaaggttattctcacagcattgctgattgtcccctctgaggcgtcccttagccctcagccttctcgcgaccctatagtttcaagctaactccctctcacctctcagtggctactgaccccacaagtccttgcttcctaacaaaatcctcctcccttatccaacttttaaggccttcaaaatccttccactcctggcccttctccagttcttctcatggtgttgcagccttgatgaacactagccatccagcccgttttccctgctcccctcaaacctggtacgcatgtcctgtgttcctcagaactgatcctggaccggcttctcttacccttcttccttcaactctgccattttcccccatccaggctctaaatcctggtagagcacagacaaagcaatagaaacagggaaaccaagcaagccttgcagctactcgctcacacctccatatgtgcagatatgtgtatgcccttgcttccctgcacacatacccagggacatagctccagagagtggtggcatcttgctattgaggaaatggaaatgacaagtgagagaagacataaggaaggtaatgcaaagggaagagaacgaggaaaggtaagaaccctaaaagagcagaaaatcaaaaagagatttgagataaaaggctaggacgagggttggtgaaaaaaataacagatctcaaaggacatgaaaattacatggaagtcaagctttttaaagatcctaacaggttaaagcaatattctgattgtaacccaatgaaatcaaactggaggaaaacatatggaccagaaattgggtcctacaaaagcaactacatgcatgcaaactggggcaacatggcttagcagcattttgctaaaagagaattagggatttgagtcaactcggagctcagtatgagtcaccagggcaaggtggcctccagagatgctaatgcagtatcgacctcattttaaagggctctagacaaataggagcatgttcctggaggtcagtcaggctggggagaggactggagcccaggctccaaaaggtctggttggaggtgctggaaccttttggagaagacctcggggatgtggtctctacttcatatatctgtcacagtgcaaagggcatagacagggtctatgtggccacaaggcatagagctggacccatggatggatattttaaaaaggcagattttcattcaatagaaggaagacattttctaacaattagaactatccaaagtggaacagactgcctagaaaggcatgaggtctctgtcactggagatatacaaatagaagctagacaatccctaggctgtcatattgtagaagggccccttccttgggggagggtgattggactaaattgctgttaaggctccttccaaccctaagattctaggatgctgtatattacaatgagaaaatagaaaaagaaagaatatggtgagagtgcaggggttggcagatgagtcacagttgttgggtgtggggaggtgatgccgtgtataggaaagaattgaggcagagaagaagagaaactacatggctaagagtgggtgaggaggagccagagagggtagacagcaagtggagtggctacagaatactaggaatgttcagactttccatttagccatccctttcatattgacaaagtcttgttttctagccatgcaaatttagcggaacacacaagctcagaaccaaagagaaattcagctaaacctttaagaaacaaggctagaaagaagtccaaatgttgctaaaaatggccaggctaacctgctatactgatactgtgccccttcagcatggtgacgcatgctgccatcagatagtgcgttgccatgacaatggtcagcgtggaaaggctgctgaattttctgaattctgaaaaattttcctgaacctgtctacaagactgttatttgttcttgcttataaaaacctcagtgaagctggtcatttctctctgtacctcccctccacctcccctcaccccatgaaaaacaaagagtaggatgtgacacagattgctttggagaggtaagatggcaatgagggaatgaatggattcagctccactctatgtgtgggagttcagccagcatatctggttgaatttgttcagcctttaagcttgggctttttctctttcttgccacatcccttagaggcacaaaagatgagactgtagcctattggaaaccaaacctgagaagattcatcttacagagatgtgttccgcatgctacaggatgactgaagggacaggcaaatttagacctcaacttatcccatctttactgcccattagtctttctgagaggaaaaagacccacaaaaccatggagagtccattcaagctcttagcttcacacagagaaaagctcctctcgtgccaatgagctgtcttgaaggcatgtgtcgttgttcataagaaagtacaggttagagagcagatggcttagtccagctcatgactactattgtaaaatcatccttgcaccatgttcatttgcttaaagctggttgcctttcctctggtgaatgtactccagaggaactggctcacggtgaaccttccagagttggaataatgctgatatgattaatccccagggagggctagctcctcaagcctggctagctctgcatggggaaatgcagatagaggtaggaggctttctggtctctggtactgatgacattcgaatcaagtggaggtccctaggagactcagagctccacattgcagcccaggcccaatcctcttggggagcaggagtgggggagttgtgcatttgtgagaatgtgttacagttgtaactggaggtttcaacacttgctctgtgttcccagaactattccccaggtttgactgggagagaaaaagaaacaaacaaggtcaggaagtaaggaggaggaggagggaagggggaggcagaagacacaagggaagaaaaaggccttgcatgcatctgccctttcttccccttactgaaggagccttaggatggcaacctaacaaactgatacgggtgtggacagaaacaacacagatgaaataataagaagaatagctactatttatcttacagataaggaaactgaggctcagggaggataggtgacttggccaagatcgcctttattcattcagcaggtggtaattactgaggacctactgtgtgccacacactgtgctaataagcagtggagtggacattggaacacaggcctggagtggagcttcagagtcaggctgtttgacctttatttccctcctctccttggcagcattgctctgtcaaatctgctcatcatcccgtctgctctttccgatcgcccctagtaaaccctcctacctcacactacatgcccagcttcttccatgtggctaatcctaaacactaaactccctggaaatgggaagaagacagccttgggcaacctttgaaattctggcccctgacataggctttgtagccctccctaggccccgccccctcccccaccatagtgtaatctgaagcttctagctccctttccctagtagagaaggaaaagaaatggacagaaggtaggagaagccagctcacccagctcctgctgcctgaaatgtgctgtagccaccagacccagtctgccatttgcagttccacagccccaatctgagaccctttgcacatctactggtaatattcttaggagaaccattgtgctgcgtataagcagcacttcctctggcagcctgacatccgggattggcatccttctaggggctagcaattggagctcaggtttgcgcatattcaaggcctgctggagccccaggcttgaagcagtgctcctgcatggtgggactctataccatggaaacttggcttccttccacactgtctctttcttcttgagaagccatgaggataagttgaaaggtagggttggtcccaaggataaactgaccatttgctttagggcttcttggaaggacttcagagtagggttttggaggatacctgagccaatttgcatgacttcaggtgaaaatctctgtgatgtccatcctttatctctctttcctgtcccctgctggctctttattcctcttcatctccctgtggtcctttccaggagcctactgccagcttgggcttcttcatcaagcaagttcctctctttcttgtttcactaaagagtataagagatggaaaggcttcttgtcatcgttgttattgctgttgttaaacagaaaaataagttacaaaaatgtcatgctgaaaattttaaaaattctgggccgggcgccatggctcgagcttgtaatccagcactttgggagactgaggcaggtggattgcttgagccgaggagttcaagaccagcctggacaacatggtgaaaccccatctctacaaaaaaaatacaaaaattagccggatgtggttgtatatacctgtagtaccagctacattggaagctgaggtgggaggattgcttaaccccagggaggttgaggctgcagtgagctgtgactgtgccactgcactccagcctaggtgacagagccagaccctatctacaaaaaaaaattttttttaatcctaaaataaaaatggagactgctccccaaagttacagtaacttagacagcaacttttaagaaaccatgaaaacccttggcatattactcatgaagacttggaatttctacctaaatctgtgaagtgggaactactgatattgacagggtacagcacaacaccctgtgctgggtacttcacatacatgatctcttttaacctcacaatttccttatgaggtaggagactggcacccgaagacattgtgtaacatgccctaatcacgcaagaagtaagtggtaaactcaagatttgaacccagacctggtggccctcttctccgtggcagcattgccctgtgacacctactcaacatccatctcctctgcttttttctagtcgctagtaaacctttcccctagtaaaccctctccccctgctcaggttcccaaagtgagcttcagaagcagtttaattttaagagatatgattgtgtctccactttaaagcccagctcaagcaatcaacacatatatttttgaaccccacccccctcatgttggtgccattgggagatatacgaggtgtttaagacatgatccctcctcctgataaatagttgagaaatctaggttagggaggatttgaatagatcagagtagggatgcacttgtaagtgagggaaattcagaagggtggggatggggggccgattgcaggctcccttgaatttcaggctgactagttcatatccacagtaaagtggaagtcattctaggttctgaaattagagcaccacatgatacagtgatatttgggatggatggtgatggtagtgcaagactgagactgcaaggtcctggactagaatagtggtggtaaaatagaagaaatgactgagagctgttatgaagagagtatcatcaccagcactgggaggtaggccatttatagaggatcagggagaaaggaagaagtaaaggtgactctgagatttccagcctggataccgactgaaatgggaagctcttgggggagggaacatagctttactgaaacatatacttgatgtgttctcttttgatgtactgaatttgaagtgtcttatgaattccatacagtgtatctacatgaaaaaatttgttgcagccagttaaaaagcaaattttaaaagataatttgatgacatgagaatatgctcatgattacaatgttaagtgaatatgaacaggatacaaagtggcttactaccatatagtctcaattttgtaactatatttagtgtgtgttttgggagaggggatatgcacagaaaaacacaagaattaagtgctaacagtagtcatctttgatgatactttaccaaagtaatataccttaacagtagttatctagaattagaattatagatgatttttatttttttatgctgtttctgtatttttcaaaatttctaccatgaacgtgtagtcaggaaaaaaaaaagtaatacatgctggcaggggcagagggcactaccctattacctccaggtggggagtaaaagtctaggttccctactcagccaccattgacaccctggggagaagaagggcacctcagtattgctgggtggagtagaattcaggctctccaatagacctccactgataccactctggccaaaaatgggagcggcacctttttattgctccgcatttggcctctactgacatagcagtgggtgggcctccttgccattaagcaaagatggaaagtcctgactttctactctgccttctttgacaccaccctggtggaatggaagggaagcctaacagtaaccatttagtgttaatatgtgccaggcactattctgggcactggcaatacataattaaatagaatagataagccaggcacagtgatgtgggctgatagttccaaatacttaggaagctgaggaaggaggatcgcttgagcccaggagtttgagaccagcctggacaacatagtgagaccctgtctcttaaaataataaaggaaataggtcaaataaagtccttgcccatcatggagattacattctagtgtggaagatagacaataaacaactaaataaaaatttaatgttgtttactgataaattctgagggatgctattcagtaaagacctctcggaggaggtgacatttgggaacagagattaatgaaatgagggaaggagatttacaaaatttgagttcggccgggcatggtagctcacgcctgtaatcccagcattttgagaggccgagacaggcagatcacttgagcccaggagttggagaccagcctgggcaacatggcaaaaccctgtctctaccaaaaaaaatgtaaaactgagctgggtgtgatgacatatacctgtagtcccaactacttgggaggctgagatgtgaggatcaattgagcccaggaggtcaaggctgccgtgagccatgattgcaccactgcactccagcttgggcaatagagtgagaccctgtcttaaaaaaaaaaaatggtagtgaagtacattctagatgaagagacaagcaatatcaaagaccccaagagaaatggatttagtatgttcaatatagatatatgtttcaatgtgtattaaaaagaaatataattatcagatcaaactctttggtttcaaagatattacttaggatgaggctggggtttttttatgtctatataagaaaagtccacataggcggtatgtgaatatggccaaactcttgacagtatagaactttaggaagcagatcagtctctaatgtatataatattattagccccatttaatagatgtaggaactgaggcctaggggagttaattagcctgtacaaagtcacacagcaggtaagtgcggaagataggattccaactgagacgctgaggatcatactcaaagcttagaagaggaaataaggaattttccttctgcctggcagagctgctgattgttgcataaacaaaccaataatattcaaagagtagttggaggcctctaatacgtttaattaagcatttttttcttgtgtgcccgaagtacatgcccaaagcgattgtattgctcatttccctccagcttctagttctaaaatgatcaaggggtagaaggaaggttggaaattattaggaaaaataaggtaaaccactcagggttttggaatgcctaactgttgacaactttgtcagtctacctggaggctctttagacaactgagattcaggtgctgtcttgagcacagccaccaaatccagcagtgctaagggtcattttctgccagggtaagtgggcctagcctccttggccttgccactgaggggcagctgctgcaggattctcaccacagagttccagaggagggtctgcagacctcccatcccatggttttctgctgtacctggacagggacttccccaagccatggtcgggtcatgaaggagctcacagtcttttgagaaaggaaagtatctttacaggctcctggtttgccaacattcttctgcctctttgcagctccaagcacattttggagggagatttcacaaagatttctaaattgagttagaatttcaagtctattgtgacatgcaaattagtcctgcttgcccattggcagcaatgcagctgaagtgcctagagacgggccataaaatggaaacatcaaagtgattaaatgtgcccgaagagcataattgagtgcatgaataagagaaaataaaacaaattgattttctccagtgccagaaaaacagaataattgaaaacaaaataatagactttgaagtaatcaaagtgaggaatgcaccatagtgacatagaaacagccagttgtgggagagatttattgtgtttctgttatcatttttacaactttaatttcattagctaataaatacaaatcaattgaaaaatcagtcaaccagagagacggcagtcccaagccaagatttttattcacatctctaaaacaggctgaggtggtgattcttaatctactttcataggtgcacatttctgccatgagctggaaaacaagttctgggaggtctgtctgctttggaggtggtgatgttctgttctgacagtcactttccacatatagacttacagattcaactttcaaaagggtcacttttataccccgccaagatttctgacagagaactacccaagtacaagcatcttggtttacatagatgacattttcatggcactgaccagcaactgtggtcttacacaaggtcatcctggattcatttggtgatagtggtggtggtggcagctatggcagcaacaatagcaggagcacctgctgctctcacaatactgctgagcatctatggctcactgcttccaacccccaccctcatcccctgacacatacgtgcacactagtgacactgaaatctaatctaaaaccaggaaggccagtcaagagtataccactcttttggcttccagcctggtgaccatgatcctggggaagatcacaggaggggagctgggccagaggagacttctcatgttcactatggcaataaggaactggggacaccaagccatgctgggctcacatgctgaatgatcacagagcaatcatgagaccaccacagaaccatttttatggctcctccaagaaaagaatccctctaccccactcttcagctgttcacggctgggctcagtgacccttcacttcaggatccacagtgatagctaatgtgacttgaattgtgggttttcctttcacaggcccttgagctctctggcagctgttggcacttctagatgtttgtgacacaccctaccttcagggctccacagttagcgactgtttctttggctccagtaaaggtctttgggaccattgggactgtaaaccagggtgtgcagaaggagttggcagtgctgagactggcattacttgttggctcagtcaggatggcatagttaatagattgtgcctgccaggcaatttgtcctggagaatttatcttccaggaagcacctagaagctgaagggagcctctctgaccttctggtggcgtccaaggcctaatcatgatatgccttgaggtgaataggggatattagcatttaggtttttttgtgcaagagagcgagagttggtctccagttcaagtcaaaaatcccagcttccatttcccactggtgtttgggtggggcaaaatagagcaaatagctttcaaactctaaagcattatacagatgtaaggctgtattattcctcctaccactgctattcccattatcctggatttcccagcccagaatttttgtctgagaaaaagaaatgtggagaaggcacatcgaccaaagaacctcggagctctgtctccaaaacggctgggaggcattgcccagcccagcagatagacaactgccggggcccagctccacaagctggctggcaggcaagcagcccactcctgtgatgtcacctctacagttacttgcgcccatccttccacatgaagccagcagatttaggcacaggaggggagaaaaaatgaatcataggctattttagaaattgcttcggttctgtttgagactgcagtagtgccttgagaactaagacgagagcaccctaaccatcagggtaatatcctctaagtgctggtgtcctgtaaatgtcagaagcctggtgggattaatccacaacctcaggttctaattcaggtcagaggcagacaagtggtgattggcagttttacttaattgtcaattaaaggctctctgatgacaggagggatcgacattccaaggcaagcaatgcagttgacaattaagagctaaaaattaaaccagccatccatatcatcacatgcccaaggcttcataggaacccttggtactgcaattgttcccaggtagaaaatgaggtccttgaacctggccatgatggggcagcagctggaaatcttgctctagccctggatcccacaagatcccctgctccctgacaatctctcagaggctccccatggcctctcagataaggccctggccttgatatggcctctggccacctctccagctgcattgctcccctccctgaacttcatcctgtatcctgacctcaaaaactttgcagttggctttatacatcctgctctgttcctgctgcctggaacattcttccctcctttgcccttcaataaaccacctactctgtgaagcctcttatgccctctttttctgcccacagcactctgtacatactagaattgtatcaccttgctgctgtggactataatgtgtttgcctccatatatgtcttcctcacgaggccaagaactccttcacggcaagaactgtcttgatcccctctgtgaccccagcacccagcacagggcctaggccattgtagacatcagcaaaggcttaggcaataaatggacagaaaaatggaccagattgggctgagggagctggatagctggatgagagcgggggtgcataccatctaagattctcagataccagagcctgccagcagcaggacagcctggacaccggctggccaagggtaatccctacaatgatttttctcaagatgtgcctcatgttcctctatatgagagacaatctgaggtgacacaaagacatttttaattttaatagtcatatttattttaacgtatgctttaaaatgtaataagcaagttgtctattattattattattgctgcttatgatagatgaggccaaaataggtattaaagtttttttcttattttttaaaatttctttttaaaaattaatagagacagggactccctattttccccaggctggtctcgaactcctgggctcaagggatcctcatgcctcagactcccaaagtgctgggattacaggcgtgagccactgggcttggcctgaaggtttaaaagtgagttaataacccaaaaaataaaaaaataaaaaaattatatatatataaatatatatatatatatatttgtatatatatatttatatatatttataaatatatatatatatatatcaaggtgactattaatacagctgttaagtagatataaaaacattcctaaaagaggtactcatatgacagaagttttggaaacatttttcaacagtcctaaattcacttctctgttcctttgtggtgccacccaacctccaagggttcctgagatcacaccagcatccctccaaactgctgtgatgctgattgcgttcagaacttatgtatcctagcctggttctccttttgttagcatgtgtttgctcaccttacccacacttataaggtccttaagagcaatgaccaagctttaagcctctgggaatttaatgggaaagtgcttgatcaactgccctgtagtctacagatgtcttttccttcagtgaataggtactgagcacctactaggtgtcaggcactactgagggtgctaacagtagagtaatgaccaagacagcagacaaggtccctgccctcatagaggtggtgagaggaagccaacagcgagcaaataaagaaacaaacacacaagatgttttctgtgcgctaagtggattgaagaaaataaaacagaatcatgtgacagaaaaggagtgactgagggggtggcttcttagcttgggtggtcctaaggtctctcagaagtgactttggggttgagactcgtcgactcaaggtgacaaaggttatgagaagagttggaaatggggatagccaggacagagcattccaggaagaaggaagagcaagttcaaagacaggagaagccctaagagggaaaaatgatttctgtgctcaagccacacaaagaagactcaagtgagcaaggagggtggtggtaggagacaggaggcaagggaccggcccctgcaggtgagtaacttagattttattgtgattggaggctgttagagggatttgagcataggagtgatgtggtctgtcctaagtattaacaaaatactctggctgctatatagagaacagggttgtaggagacaaggaaggaagcaaggagaccagtcttgaggctattagaatcatccacataaagggtaagaatagtttggggtacagttacagcagtgaaggagggaaaaaaagaggtagatttggaatctattttggaggtagaatccacaggacttgctaatagattgaaaaggaaggttgtaaacaaaggaggagtaaggatgacccctagtcaacgtcatgaaggaaaaaaaaagcacaagaggactgttctatgtctgctctgtccactatagtctcaccactagccacatgtggctaagttcattaaaattaaacaaaatataaaattctgttcctcacttgcactagacatatttcaagtgctcaatagccacatgtgactagtggctaccatattgagcagcatagctgtaggatggtcacatcatccaagaaagttctattggaccgcactgctccacattaaaaagattaagagaataaaaagacaaaccacagactgggagaaatatttgcaaaattcatatccagtaaaggagttcaatccaaaatatacaaagaactcttaaaactcaacaataagaaaacactcaatttttaagtgggcaaaagaggctgagtgcagtagctcactcctgtaatctcagcactttgggaggccaaggtgggcagatcgattgagtccaggagtttgagaacagcctgggcaacatggtgaaaccctgtctccacaaaaaatttaaaaattagccagacatggtagcatgtgcctgtagtcccagctgctcaggaggctgaggtgggaggatcacttgagcccaagaagtcaagactgaagtgagctgtgatcacactactacattccagcctgggcaacagagcgagaccctgtctcaaaaaaaaaaattaaataaaaaaattaaaatgggcaaaagcgagcccattttgggggtgtggtggctcctgcctgtaatcccagaactttgagaggcttaggagggaggattgcttgaggccaggagttcaaaaccagcttgggcagcatagcaagaccccatctctacaaaaaatttaaaaatatttaaaaaaaataaaaatggacaaaagatattaataggcacctcaccaaagaagatatacagacagcaagtaagtgcagatgctcctctgcctattgcagtggggttatgtcccaataaatccattgtaagttgaaaatataagtggaaagtatgttttcaacttacagtatcttcaacttatgatgggattatctagatgtcaccccatctcaagttgaggagtgtactgaatgcattattacttttgtaccatcataaagttgaaacatcttaagtcagagactatatgtgaaaagatgcccaatatcatggtcactaaggaattgcaaattaaaatgagataccattacatatctattagaatggctaaaatccaaggcagtgacaacaccaaatgctgttaaggatgtagaactacaggaactctcattcattgctggtaggaatgcaatatggtacagtcacttgggaagacattttggtattttcttacaaaaataaacatattcttaccacatgatctagcaatcacactccttagtaattacccaaatgaattaaaaactcatgtccacacgaaaacctgcacatgaatgtttgggggtcttttttgttgtttgtttgggttgttgttgttgttgttgttgttgttaatttttttttttttttttagagacagtgtttcactctgtcacccaggccagagtgcagtggcacaatcatagctcactgcagccttgacctcctgggttcaagcaatcctcttgctccagcctcttgagtagcttggactacaggggtgtgccatcacactcagctaatttttttattttgtagagacagtttctcactattttgcccaggctagtcttgaactcctggcctcaagtgatcctcccgcctcagcctcccaaaacactgggattacaggcatgagccactgtgcccagccctgcacaaaaatgtttatagcagctttattcagaattgccaaaacttggaagcaaccaagatgtcttgcaataggtgaatggataaacccgttgtacatccagacaatggactattattcagcactaagaaaaaatgagctatcaaaccacaaaaagacatggaggaaacttaaatgcatcttgaaagaagccagtccaaaaaggttacatactgtttgattctaaccatatgactgtaaaaagatgatggttgccgggcttcagtgaaaggaagggagggatgagtccatggaacacaggtgattttgagggcagtgaaactattcctgcatgatactctaatggtggatacataacattatatacttttcaaaactcatagaactgtgcaagaccaaaagcgaatcttaacgtaaacagtggacttaagttaatgataatgtatcagtatccattcactaactataataaatgtatcacactaatgcaagatgttaataataggggaaactgcctgtaggggaaggggaaggaaatatatgagagctctctgtactttctcttcagtttttctataaacttaaaactgttctaaaagtaaaatatattaatttaaaaaagaaagactaaagagattgttcatcaacacctaacaaaatacctggcacagagtagacacgccataaatgtttattgaataaattgataaacaaatgagtcaaccagtggttcagtagaacccaggccccctgagtcccagttcagtactccttcttgtacatcagagctagagtaacagtatagtttattgtccaaaccaggatatttgagagtgaaatggggtgccttaggtataaatcaagactgtttcagagataaccagaaatcacaaactggcagtccataagctacatctcgcctccaaaattgttctgtttggccactcatcttaatgcctcatatgatattcttttaaaatgtcagtcatttgcccaaatttaacacagtggaaactgcataaaaatgtgaaatttggacttctcttggaaaatggaaggactcggtcccatggggccgacaggactgcacagtggtgagtggctggagctgagcagcagctgcccacttttgccagcaggtaccttcctctttgccacaagccccaccagtcccttttgtatctcttactctaggccaagtgtgagtttccatttacactgtcttggttttgttttcttctgtggcagagttaagaaaaaagggaaatatttcttacacttatgtcatgattcaaagtaagaaaatgaaaaaaggatcaagagggccccttgtgtcttgcccccagcctgctttacaaacagtatattcttggcctctctaggcagttgagtctgcccgctgtggtctgaacttcttgtctccctaggccccagcctgtgctagcctttagaattttctcaggctgccacccactgctggaaaagctagatgtgaggggaaaacaatgggcattatttaagcttgcatttttattgttaccccaattcaacattgctcatcatcaacttcttggtgaaaattatttctgttgtttttcttaattgcctccaaatttaactggagagtgaggcagagcagcagaggagtacagcacccacctttcctccctgcgaacatgtcttgttggaatgctttgacatggaattttgttcatccttgcattcagtcattcccctagctctggctatacttacagatggaaggactctcacttcacaccagtgtcccctgtaggttgtcctcagctgaggcaacaacacaagcgaaggtgtggaaacaggaaagcatggatggggcccatttacgctaaggagttggacttcattcataggtggtaggtcgggaactgctaaagtcttttttttttttttttttgaaatggtgtctcgctctgtcacccaggctggagtgcaatggcaccatctcggctcactacaacctccacctcccaggttcaagcgattctcctgcctcagcctccccagtagctggggttacaggcgcccaccaccacacctggctaatttttttgtatttttagtagagacgaggtttcaccatgttggtcaggctggtctcaaactcctgacctcaggtgatgcatccacctcagcctcccagagcgctgggattacaggcatgagccaccacgcccagcctgctgaagtctttttgagcagagaaggaatgtgatcacagctagcaattgtgcagggaatagctctagaagcaggaggaccagataagaggttgtcgcagtgacctgagtaacaagagatgtgactaaagcagagacagtggaacagaaagaaggggatagattggagagacatcttgaggttaggcttcacaactcataagatgtggagaaggcgtgaactaagaaattaaggatcaaagattatccagagatttttttgagttagggggttgaaataccaaaagcatgatccaaaaaaagaaaaaaaattgataaggaattggagctcatcaaaatcaacttttgctttacaaaagaccctgttaagggaatgaaaagataagttacatactgagataagatatttgcaaatcatatatcccacaacagatttgtatctaaaatatataaagggctgggtgcagtggctcacacctgtaatcccagcactttgggaggctgaggcgggtggattatttgaggtcaggagtttgagaccagcttggccaacatggtgagatcccctctctactaaaaatacaaaaattagtcgagcatggtggcacatgcctgtaatcccagctactagggaggctgaggtaggagaatcgcttgaacccaggaggcggagtttgcagtgagccgagatcgcaccactgcactccagcctgggtgacagagtgagactgtgtctcaaaaaataaaaataaaaaatatatataaagaactttccaaactcaacagaaaaaaaaaaaaacaattaggaagtaggcaaaagacaagacatgaaaaggatatacagtcagcaaatgagcacatgaaaagatgttcaacatcattagccattgggaaaatgcaaattgagatcacaatgtgatatcactatacatctatcagaatggccaaaataaaaaccaacaccagatgccagcaagaatgctgagaaaccagatgactcaaacattgctggagggaaagtaaaatggtaccaccagtctggaaaacagtttggcaatttcttataaagctaaacatgctactaccatacctcccagcaattattctgttgagcatttgtcccagaaaaatgaaaactatgttcacacaaaaacctgtatgtgaatgttcatagtggcttgattctatagccaaaaactggaaatgactcaggtgtccttcagcagataagtagttaaacagattgtgctacatccatactgtggagtactactcagcaaaaagaagcaacaaacttgatacacaccacaacttggatggatcttaagagcagtatgctgagtgaaaaaagcctatctatctcaaaagtttatatactgtatggttccatttctataacattctcaaaatgaccaaattttagagaaggataacagatgaatggttgttgggacttagggatggtgaaggaggagggatgggaatgactgtaaaggaggtagaggagggaaatctttgtggtgataaaatagtttcgcatcttgattgtggttgaggttacatgaatctacacttgcgattaaatggcctagaattatacacttatacacacacaaatgagtgcttgtaaaactagtgacatattaataagatctgtgaattgtaccaatgtcaatttcctgacttggatattgaacagtaattatgtaagatgttaacatgtggggaaacctggggaagggtgtgtagaacctctctgcactattttttttttgcagcttcctgttattctataattattttaaaagtaagagctcagtacaaaaaaggaatgaacttctattgatacatgcacaaatctgcatgaacctcaaaggcattatgctgagtaaaaaaataaaatagcctatcttaaaaggttacagactgtttgattgcatttatatggcattctcaaaaagacaacactacagtgatggagaacagatcagtgcttgctaggtgtgggggagaaaggaagatgtgattgcaaaaggatagcacaaggagatttgaggggttatggaactcctctctgtcatgaatctatacatatgtttaaaatcagatctgcacatgcacaaatgtcaattttactgcagaataaaatttaaaataaaagtagataggcaaggccgggcatacctgtaatcccagcactttgggaggccgagtcgggtggatcacgagatcaagagatcgagaccatcctggccagcatggtgaaaccccatctctactaaaaatacaaaaattagctgggcatggtggcacacacctgtagtcatagttactcgggaggctgaggcaggagaattgcttgaacccgggagattgcagtgagccgagaccgcgccattgtacgacagcctgggcaacaagagcaaaactccatctcaaaaaaaaaaaaaaaaaaaaaagataggcaagtagtttgtttctgacttgtttcttctttccttccttcctttcattcgtccattcattcagccatttactgagcacctactatgagtgaggcactgtgcaagactttggaaatcaaccaaaagtaagacagccaggccctgccctcagggagcattgtttctgtttcagagaagtggccagtagggtttggagcccagtgtttctacttggggaagtgtggcaaggcaaagactacggagggacaaagtgagcaacttttcattcctagagcccagtccggtaggatttcaaatgatcacttttccctcaaagactcttaggcctgagatcagaggaaagcccccaatccgtgtttcacaggtactcacaagagaaaatgctaggagggttgtgccttgctaagggaaggaagaaaagttgggggtggggagcatgagatttgatgcagttagtaaagaatgaactctgaaaagtgttacgagagagagagagagacttaaaacaaccatttgtttagctcatgactctatagattggcaattgagctgagttcagctgggtggctcttctggttctggctggatacacccagcatctgcagtcagctggctgtcaaaggcctcgatcacatgtccagtaattggctggtggttgcctgggtgacagggatctctgggccatttgtttctcatcatccagcaagctattctggtcttgttccttatggcgaggtcacagagttcccaagagcagcagagaataagccccaaaatataagtgctttttaaaaaatagctctattggggtataattcacatacattacctgactttgaattttgttttctcccctgtttgcagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgagaggcagggtttgggcctcaggaccatccaggtggagccctgggagagagggtactgatcagcagactgggaggtggggagaagtccgctggtgttgttttagtgttatatatctttggtttttttaataaaatctttgaaaacctacctctttgtcccgttgtcttcattgtaaagcgccactgacagcacacacagttctgaacttttcttctcgctgaagtgtcaagaataaccctgttccttccaatctctactctggcccggcttgagagtctgacctcactggggaactagtgtgtccctagcccaagttcttgggacagaaggccaagctctgtgttgcactggggctgtccatggtggggtaggaatactggcactgcagtcatggagaggggcttattggcaccctggggaggagctgtccctgtccagggagtgatttagggatggaaaaggtgtgttggcatgtcagatccaagaggagcacttccatggatagaaaggatgcttcccagtagacaattggcacataatgaaaaggggaggaagttgtaatgtgtggtgttactgcaacctctggggagttggcaacatggaaaaatggggatgggagataatgggagagatgaggaagagacaactaaatgtcatgatattgtaattttatttaccaaatatttacaaagctccttcaactaactactgggaccgggacggcagacaagcacacagccccatccatcctggctgtctaggaattcccagacaaggcaagggaggagaaaaagaagcagatcccaacatgtttccagctctgttatcaacatgagctcagagctgtgggagcacatttctacttttcagtattttccaaattttctgtagtgggcacattttactttaataatagaaaaaaataaatacataaaccccaaaaaaaaaaaagaaacaattgatccgcggggagttagggggtagttacagatcaaagtcagttcaagacacccactgaggaagactttgtgctcaggccctggggctgttctaattgcctggaagaccgatcagtgggggcgatggcggggagggggatgcgggggagggggatgctttttagatcagttggcttgagggtggggcaaatttgtccccaccataagcctgcctgtcttacctttaggaaattgctgccgaccccgccaccacccaccccttgtgtctgcaagggaccagccacaataactataacaacaatggtaaagcaagcattggcatatgccccattttacagatcattttcacttgtacgtcactatccaccctgctagtgggtattatcatccccactctatagattagaaaattgaggctaagaatgatgaagtaacatgcccctttttaagtggcagagccaggaagaaaaacccggctggaactgcaaattcccttactttttccactgtcccacactagtgccactagaatatttttaaactgtgactttgaagtaaacaactttcttactgcttccaaagcccaagctggaccaagccacatgctgcttctgggccctcaccacacagtagcattcattcgtttgtgtgcttttcagcaagttgcttgacctttctgggtctgtttccatacccataaaatggggtgaataattcttgcacctcatgggctattgtgagtggttgatgaattaccaaagatggaagcactttgaaaagcgtgtattctggacaggagggcctgccttggaaatggtccagggaaggctcacctctgaggaaaacccagtgcttataggaaacccaccagccccctctgtctccagggcactcacaagggccaaagagaccaagaaagaagtgtagactatgtctccaactcaaggggtaagaaaataaccacttaaaaaggaatatcgatattggatatgcatatatgtgcataaaacacctttgggaaaatacacaaggaactgggacacctcagttgcctctgggcaagggaaccagatggcaagtggcagagtgagggcgacctgcactcagttcctttttgtaccttttgatttttgaaccatgtgaatgtattacctggtcccaaaaaagttaatacataacatttttt

SEQ ID NO: 17591 - DNA, 6819 bp, Human; identical to SEQ ID NO: 12457

SEQ ID NO: 17592 - DNA, 72992 bp, Human
accaactggattacttagctcttctggtaaagctcctggttaaataagttgttagtatgtcttttttaatgctttgatttaatttgaatggaaaagacatggtagtctacatacttctaccaagatgaagatgaccaagatgttcttgaaaatccaaaagtctagaagaccactggatgtctttttttttgagatggagtcttgctctgtcgcccaggctggagtgcagtggcacgatctcggctcactgcaagctccgcctcccaggttcatgccattctcctgccccagcctcctgagtagctggggctacaggggcccgccaccacgcccggctaatttttcgtacttttagtagagctggggtttcaccacgttagccaggatggtctcggtttcctgacctcgtgatccgcccgcctcggcctcccaaagtgctgggattacaggcgtgagccaccgcacctggccgaggtcttttactgtgtatgttacttttctttacattcagagtagagatgcaactattttattaagcaaagaattggctgcataaacgtccactgaaggcacaaaagctaaatagctacccaccaataatctcattcagtgagaaaactagtccaatcagagacccaaggagtggcttccagtcacatttgtacctttccttaaagaacattcttcctgtccttttagttacatatgtttatgtttacatattgccaaaaaaaaaaaaaaagccaaggtttggtggaaatggctaaagtaagctgtactttattcactcataataggaaataacaatttcatatactgagccctgagttcaagttcacttttttttttttttgagaggggggtctgggtatgttgcctaggcagatcttgaacttttgggctcacgtgatcctcccacctccgcctgcagggtcgttgggactataggtgcatgtcaccatgccaggctctcaagttcacttgagataaagaatacccaacactgtgtaagcatagactcctgtccaaaagtggtggtgaagcgtgaagggggctgtcctatggtggtggtgtagagaaggggtatgaaagaaagtgccagtgaccttacatttgatcctttccaatggtagtagtggggtgggggggtatgaaacagagtcagtgaccttgcaattatcctgtccactggcattggggaggtagggggtgttattgacccttgacctcacaatggatcccgtccaacggtggtggtggggggacatgaaatgcaatcagtcacttaatcttgtgcgggaaggaggggaaaggaaccacgaaaaagagaatcagcgaactaacaatccagtccaaaggtgttccaaaggtgttctcttgggagtcaggcagggaggtgggggtggggctgggccacgaaacagagtcagtctagttaggctgtaaaatctaagtgtcaggatgcagcgaacggcaagtcctcctcccggaaaaggcgcctgcggttgagaagggtcttgagcagcgcggaggatcggattccgggctcctggcctcttcccggtccgcgggcacctcggctacctttcggcagcggagaacccagccagaggcggagctgaaagcggctgcacttgctgggctgggctgagtcccatgagccagggaggggggtctctggcgccgcgcccggacaaaacacaaacgtcacagaggcagcggcggccaatcagtggagggcgcgcgcggccgcgtgcccctcgcgctcctcgcctcccctcgcgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcggtgagtacggggccaagggtccccatgggcccggggccgccgccattcgggctgccaccccggatctccgcagcttcggggtaaagtctgtgggaaccgcaggcggggctagggaatatccggggggctctcctggggctcggatttcggggcgcggaggggcagggcctggccccctcgcacccagcctgggacttacccggagacacagaaacggcgtctcattgcaggaccctcatcgcaggcgagactccccaaacctgcggtcgttagcttcaaatctgcttgacacaaacctcacagcccttaaaacttcagaacgagatgtgggtggctttttaatgtttttatttttagaattttttttttttggttgggtaagaactgtttagaaataccttgaggttgaataaattatgcaatggcattttgttccttttctgctctaaggtgttgctgtgtggctggagtggcaggactcgaactgttgtcttcatcaggttatgttaaatcagttagaggcctggcctgcagacgccttagatgcttgggaagagcggacgtctgggatcctagcatcagagcagggtctaatacaactctggctttagtgccagcacctttcgtttctcttctccattggtgtcccacccacattctccctgtccggtgggctggtgggcggctttcacggattgaggtgggaccaaagaagattcgggttcccagcctgcctcaggcctagctgagatgggaatagattccaccaccttctgttaactgaatcatgtttccccagaaaacgaaggagctggttgtgaaacacctaaaagtaaaacgcatgcattgaggtatcagaatggaactcagcatccctggaggaaaatcaaatccagcagcaaagatgttctaagctctccaggggaaatcgtagggtgtctgttcatttaatgaattttatgtaaatgtcaagggtgtcagtgatagtgtcagttgggcataaaaactaaagtgcagagtaggtagaacatttgaggaagacctgatatgcaaaaagtgatgtccatacttttttttttttaaaagctaggataggaagagaggaataggttaaagttgagaccaaattaaaattttagaagccaatttgccagagaatgatgatgaaagtcaaagttcaatgacacgttgatttctgcatcttcaaacttcactcccaaaagctattggtagttttacttactatctcgagaattgtagaggtttgaggcagtttctgactttagagtttagaaaatgttgctattgctataaatataggcaagttttccatctttatggtttagggaagattctgaaggtatcagcctttcattagtgtaaactgaaacaggataattcacaataaaaggaacaaaaggaatccagaaactcccagttctttccaccctcaaagtttaagtgatagctccaatagccagccaaaattttggttagttgatttccatagcagctagtgtctacccgtgttaataggtattttggtaaggatgttatgtgagtaggaaaaccacagtggaggatagtgttatcatggaaaacctgtgaggccagtatctggaaacaaatgttctaattctggctctgccactagctcagaatgtggccttgactaagtgaccaaacctcacttggggttcattttcctcattaataaaatgagtagattgtatcaggcgatctttaaaagcacagctcaccactatacgattgtgatttcaaaggaagaggcatgaactttctaaaagaaaactaccaaatcttttgatagatatttcctataaaagtcttctgacctattttgggaggggtggagggattcactaaggtcatgagagaagcataataatttaaggttttccttataaggaagcgcacagaagtgctagatatagttgtagtggaatttgctagaagtgacaaggctagtttgtaacacccagagatgaatcaggtgctaatcagcctatctttaatgacaggacaactaaaagacgggagttgttgcaaaaaggccatctctacttctacttttctcttagttctgtctcttgatagcagttctattttggcaattgatgtgggagttggagaattcagaatgggtgtgggatatttttaaggtgaggagagaggaggagtgaagaggcttcatgcccctgtatgattagagaaaactgcaggagagggccaactcaggcacttaaagcaccaggtagtgggcagtggataagtgaatgaagccaacgagttgaggaccgtgataaattcctggtatatagctagctccaaaggggcagctgattggcaccaattcagtatatttcaagagaactttggcataaacaaaatagatggatggatcaagttggcccacaggctgctagtttatgaacttgatgcctttctccatgggtactttacaaatgggacgtacattttgactagagtaactagacagggaccagagaaaggagatacacaggatatacacaatttgttacaaccttgataaataggctttcttatgtggatgtactgcacatcagtaaataaggagattatttgctatgttcaaaagtggaggctaaaacttgttgttacttcagaagctgtgcttttattttaaagcaggggttcctgagcctcagcactcttgccatttcaggccaggtaattttggtaggagctgtcttgtgcactgtgggaagttgagctacatccctggcctctacccactagatgccatgagcacctcccactccaagtcgtgacaaccaaacatgtctccagtcattgccaaatgtcccctgggggagcaaaatgtcccctggacttctgttgaatcactgtttggaagtgtttacttgagtggttttcaggccagggcctcatactctgaatttttgttgtaaatggtctgggggtgctgggggtggagagcagagcactggtatttttaggagatccccctgtcattctaaagcatatccagggttaagcaccattaatcagatgatcttctgtctgatctgctggccccctttcatctatgtgcagtatttttctctatgctttttaaaataatgaaagtttcttgaactccatcttgacttgaaatatagcctgccacacagttagcaaatatagcaagaataacaagtgttctaaatggatttttaatttattatggcaatagtacattccaaagggtggcattttttaaaatgagatttttcttttgggcctaagattacagtcacatggttccaaattcagagggttcaaaaggacacagaaaagcctgcttcccacttgtgcccactggcctccccttttttcgcataaatggcagtttatagctttgtctgttccttgttttttgagcttaataccttagagacagatttttgtatatctgtacctgcagaactttgtttttcttttttatggcttctgagaatttggttatatgaatgtaccagaatttattagcaactttccctattgatggctacaattaataggttgtttctagactttgctgtggcaacctgccctccagtgaattattatatgcattgtcatttcatgcatgtccgcgtgtatctgtaggacagattcctaaacgtgagattgctacatcagcaggtatgtgcatttgtaattttggcgaacattgtcaaattgctttccataaaggttgtttgttttccccctcgctagaagtttctgagagtacctgttttcctatgccttcaccacattgttgtcaaacttttgataggtaaaaaaaaaatgatatatctagatagaatttttttctccttgagtaaagatgtctttattttagttttttattgtggaaattaaaaaaaaaaacttaggtgggtgcctgtaattccagtgctttgagaggccaagacagaggatggcttgagaccaggagtttgaggccagccctgggcaacatagtgagatcctgtctctaaaaaaaataataataataaataaataagattagccaggagtggtggtatcgcacacctggggtcttagctactcaggaggctgagacaggaggatggcttgagcccagattgaagctgcagtgagctgtgtttctgccactgcactccagcctgggggatgtacatgtataggtaaatacatatataaattttattgtgtataattaaggtatacaacatgatgttatgggatacatatagttaaaaggttactacagtgaaattaacatatctatcatctcacatagttacccttttttatttttgtggcaaggtcagctaaaatctactcatttagcatgaatcccatatacagtacaattttattatctattatatattcttcatgttgtgcattagatctctagaccttaaacatttacagaagtagagagaatagaatgatgaactcctgggtttgttttattgatatccatttgctatttgtctgtagatgttgtatgtgtggtctgttagattttctgatcaaagtcatgcttgtttcaaaaagataaatttttgttttcaaaaagataaatttttttcttttcctatgctaagactaatttatcttttgaattatctggttcttaaagatttggtagaacttcatatgaaagtgtttaagcctgtatgttttggggagttttgctctctgatagctttctctattctgtgttattgatctctgtagattttctgtctcttctagagtccattttgatatatttttcttgaaaattatcctacttggctaggcgcggtggctcatgcctgtaatcccagcactttgggaggccaaggcaggtggatcacatggggttgggagtttgagaccagcctggccaacatggtgaaacctcgtctctactaaaaatacaaacattagctgggcatagtggtgggtgcctgtaatcccagctactggggaggctgaggtaggagaattgcttgaacccaggaggcggaggttgcagtgagccaagatcatgcccttgtactccagcctgggtgacaagagtgaaacggcatctcaaaaaaaaaaaaaaaaaaaaaaagaagaaaagaaaaaaagaaaattatcctactcattgaggtttttaagtcagtttggatagctgagatagttgtcactgaacagtcttaattttccctgtgacatttgtccccccccttcttcttgagtaggttagttgatgatttattgggttggatttattagttttatgacttttgttatctagtttattgtctgatttgactttaataattccttctggtctcaggtttattttgttcttttaaaaattaggtgctttctgttctcactcataagtgggagttgaacaatgagaacacatggacacggcaaggggaacatcacacaccagggcctgtcgggaggtgggggggctaggggagagatagcattaggagaaatacctaatgtagatgacaagttgatgggtgcagcaaaccaccatggcacgtgtatacctatgtaacaaacctgcacgttctgcacatgtaccccagaacttaaagtataataaaaaaaattaaatgctttcttctttgtcttgtttatttcaatgtttaaggttagttattcctctgagcactgctttagcagctgatgtgtgtatttggtcttttttctcttagctcttctgtgtcttcaggtttttattttcctatgaatgaagagttgtttggaggagttaaaaatttccagtgaaggtgcattctgcattttaattttatttatgtctagttttgttgcactgtgattacagaatgttgtctgaattattctctaatttattgatgttaactttgaagctcattatatggttgttttctgtgaatgttccttgggcagcgaaaagaaggttatactctcttctcaggttgcagagtgtgatatgtcagctctgcaatattatgttatttaggttttgtgtaactttactttttttatccacctgatttgtcatggatcaaacacaagagaagttaaagtctcctaataatgattctctttctccgtatagctcctattgtttttgctttatgactatcagtgttatgtttgatgcttattaactcacatcctcattgtgagatatacccattagcattagagtgctgcccttttactagttgaaggctttttggcctggattcgtccttatttgacattgagatctagttccctattttcttgtttacatttcctgggatagcattgccatccttttattttcagtttttctgaattacttcgctctaaatatgtctctaaatgtagtgtaaagttgggttttgctttgtgaatcagtctttttcatgtggtaagtttaacctatttatacttactggtatgatagatctgtcatctgtaatgataagcatttgtaattttctgttgctttctgtttttaatacctcagttttcctatgttatatatttgctttgttttgccatatttattttaataaataactaggcttgaatttttggttctagtggttatctttatagttattactttatttctatagacctttgtcccatatgggtcaccacttgtcagccaggagacctttgagcacttgaaatgtggctagtgtggccgaaaaactgaattgacttaatttaaatttaaaatggatacttgatgcagttaatttttacatctgtgtagaataacttggatatggaatccactttatcacctgtaaattttaggaaatctctttataggtcaattatttctgatagaaatttagcctctgaattgagatgtgctttcagtataaaatacacactggatttcaaagacttaatataaaaatagtaaaatatcagtacatcttatattgattgcatgttgaaatggtaatattttagatatgttgggttaaatggaatattatcaaaaactttatttcttttttatgttaatgtggctactaggaaattttaaattatatatatggcttacatatttctttctttcttttttttttttttttttttttttttgtgagacggagtttttgctcatgttgcccaggctggagtgcaatggtgcgatctgggctcaccgcaacctccgcctcccaggttcaagtgattctcctgcctcagcctcccaagtagctgggattacaggcatgcgcctacatgcccagctaattttgtatttttagtagagatggggtttctccatgttggtcaggctggtcttgaactctcgacctcaggtgatctgcccacctcagcctcccaaagtgctaggattacaggcatgagccacagcccctggcctggctcacatatttatattggacagtgtggcttcagataatatatgttaattccttattgggagcaatgaaaacatcacattttaatgttcagaataaacatttattggctgggtgcagtggctcacgcctgtaatcccagcactttgggaggccgaggtgggtggatcacgaggtcaagagattgagaccatcctggccaacgtggtgaaaccccgtctctactaaaaatacaaaaattagccaggcatggtggtgggcgcctatagtcccaggtactcgggaggctgaggcaggagaattacttgaacctgggaggtggaggttgcagtgggccaagattgcgccactgcactccagcctggctagagtgagactccgtctcaaaaaacaaaacaaacaaacaaacaaaaacaaaaaaaccaaccacacatttgttgaatttatttatttatttatttacttatttgagacagagtctcactctgtcacctaggccagagtgcaacggcttggtcttggctcactgcaacctctgcctcccgggttcaggtgattctcctgcctcagcctcccgagtagctgggattacaggtgtctgccaccacgcctggcttatttttgtatttttagtagagacggggttttgccctattgcccaggctggtctcgaactcctgaccttaggtgatctacccgcctctgcctcccaaagtgctgggattacaggcatgagtcaccgtgcctggcctgaatttatttcctgaaatataactttcacatgtcttgttccatatttttttctataaacctctctggatttttggatcaatgtattgtttttgactggcagttaatgttatggtggctccttgttatatttgcacaaatttgagttctctttcccttaagcagttgtgataaattaaaaattctcttaattatataagaaaaggagaacttggactattatggcataaagatagaaccttctgaatgttgaatgagttggtaggaaatgattcacattttcttttggacttgcttttcatctttcagtctcgccctgtcggcttctggttcccatattaaccacttttctcccctccctgcagactgacgtcccatttgtttgattttccagttacttttgcacagccacacttgcattaaagagattttgctcctgcctccttttcttagattttatcctcaattgtctctttccaaagggcaggcgctcacctcttttttgtaacctcttacagcttcctcagctcagcttgctctgcacagagcaggtgctccataaatggcaattactgatggcatgcctgactccatatcgaggttattaaacattatgccactttcatttagtcagttatataagtttattttatttatttatttatttatttatttatttatttatttatttattttgagacggagtctcactctgtcgcccaggctagagtgcagtggcaccatctcggctcactgcaacctccgcctcccaggttcaagcagttctcgtgcctcagcctcccgagtacctgggactacaggcatgcgccaccacgcccggctaatttttgtatttttagcagagacggggtttcaccgtcttggccaggctggtctcgaactcctgacttcaggtgatccacccgcctctgcctcccaaagtgttgggattacagacgtgagccactgtgcccagccaagtttaaacttccatagtgtccccatgtgtaaatatagcatctctcaaaaccaccagaaagcagattgctgatagccctgccgtcttttcacaaaactaaatattttgatttctgtcataatcacaccggctctgtgaacctcagagcctttagctcttagaaggtagcggccagtttccgcattcttactatttttaaagtttaagggcccagccatcttcttttcctttagaacatattttaagatactttggagatactttggttccaaatgactccctttcgcaaagtcttggctttttaagtcattttgctccttgaagcctgatcaccactggggacaacagtgattgcgttcttggagaaaatggaaaggtttttaaaaaaattatgttaggaaaagggaaaaacaatctcattctgcttccgagtgtgtttattttgtacctttacatatgtaaatgacagattttttttttttttccctgtaagcagtagtttttctgctacaaggtgtcaccaagaattagaccaacctgtttggagaaagggatcaactattcagaattaaaggggaagagaaaaatttagttgagggtaaagatatctaacttggcttattgcatcttgaccagtttttaaatttaaagaaagaattggtccaggcactgtggctaatgcctgtaatcccagcattttgagaggctgaggcaggaggatcgcttgagtccaggagtttgagaccagctcgggcaacacagtgagacccctgtctctacaaaaaaataaaaaaattatccaggcatagtggtgcacccctgtggtcccggctacatgggaagctgagatgggaggatcgcttgagcctgggaagttgaggctgcagtgagctgggatcgcgtcactgcactccagcctggacaatagagcaagaccatgtctcaaaaaaagaaggagggagggaagtagaaagggaaggaaagaagggaggaaaggtagaagacggaaggaggaaaggaaggaaagaagggaggaagtgagggctttttgggcctttaagatctgataaggctgcattttaacatggcgtggtttatctggctctggggcagctctcaggcaccaaagtcatggctttggcctcactgtctttgtagcacttatgttttgtgtgcttttgaaagtggagacagctgcagttactgatctattgatggttgggtggtttcctcccattaagcttttggaaaattgatcagactgttggcaaggtttgggaaaccttggttttgttactggatggaatctgaaaatatcactgctttttcttttcctgtatatgtataggcattccattattttacttccatggtaatctgattttagagttgggcaaatccttttattttaggaataccctggtctaagaatgtcaacctatagcctgagggctggccacctgtttttttttttctaattaatagactgttttttaaaaagagtacagttcgtcctccatatctgtgggttccacatccatggattcaatcaacctcagatagaaaatattcagaaaaaaaattccacaaatttccaaaaagcaaaatttgaatttgcctcaccttgaacactatgttgaatccatgtaaatgaaatgatgtgtaggccttgtaactagtctagagataatttaaagtatatggaaggatgtgcataggtcatatgcaaatactctaggccattttatgtaagagactcgagtatccatggattttgatatccaagggtgtccaggaaccaatcccccacagatactgagaggcagttttaggtttacagcaaaattgagcggaagtacagagtgcccacagaacccctccccacccccaaacacagtctctgccgccatcagtatcctgcaccagtgtgggacatttgttataattgatgaaccagcattgacccatcattatcacctaaagtccatagtttacattagggctcattctttgtgttgcacactgcgggttttgacaactcctgtttttgtaaataaagttttactggaacacagccatgctcattcatcacatattgtttgtggcttttgtccatccacaacagcagaaattgagtattgacagagactatatggcccacaaagccaaaaatgtttactatctggtcccgtacagaaagtttcttgttccctgttctaagacaaatcagttccctctttaaagaactgagcagtgattggtcttaatttccatttaagtggtaaagctctgtttctcctgtatgctagtaacaataaactttgactatctggagtgtgacttttggggtagtgaaggcttttccaggtaatcgggtggtttacctataggatatctgcctcagagtggaattaccatatgaaagctgttgacagtttataggtttaatttatccagggctgtcagcaaagtttatctgtatcagtttctccgtagccctgccaaaatgaggttttatgattttaatcgcatcataggtaacataggaatgaaaagtgctttttcctctgcttgggttttttgtctgctttttgttctgtgtaaagtgccattggccattttgtaaccagaatctgaagtttttatcatttgcataaattcctgtgtatatttggcatagtaagctcttgtgctgtgtaaatatcgtttcctttggcaaagtaattatcaaagtataaaactgaagacatttggaaagaattgctatattacctgtaatatgggtaattcatctgtttttttgtgatagcccttcctgcttttgcccatatatttacatgtgttaacactgtatgttggtttcctttttatctagtgcacagtctgagttttcatatgctcagtgttacctatatcatttacggtgcttttatcatggtcagatttgtcacctatagcagagtttgtaagtagttattaaatctctctggaatctattgccattttctgatgagcctttgtagctaactcatttttaccctgttctgctgtcaagttgcccaacaattattaagacctcaagtttttctcttgaaacttggctgtttctcttttatcttggccgtttctctttgatcatatgctaagctctcagagtagtttgtatttgtggattctagtcaacatggcaacttttctgattttaactaaatatcacattttaactttgtaatttatgttgaaatttggtgagggcagttccttatttattactttacattttaaataattcttgcttttcttgtgtactaattcttcttgataaattagtcattgtgcaccttgaatagcatatcatcaaaagtgtgctaagggaactgtggatgggttacgtggtgttttagggtttacatctttgccatgtacttggcattgaaactggcattgaggccgggcatggtggctcatgcctgtaatctcagcactttgggaggacaaggtgggtgaatcacttgaggtcaggagttcgagaccagcctggccaacatggtgaaaccccatatctactaaaaaaaaatacaatacaatacaaaaaatcagctgggagtggtggctcatatctgtagtcccagctactcaggaggctgaggcaggagaatcgtttgaacctgggaggtggaggttgcagtgagccgagatcgtgccactgcactccagcctgggtgatagaatgagactctgtcacaaacaaacaaacaaaggaaaaactagcactgaagtatcttcagttagcctatttcgcttttatggcaggaaggctagtttacgctatacttgccttcgtgggagagctgggtttgattgtgacccatggtggatgtccttcatatccctcaaggagaaccccattcctggtcattgcctcatcttaactctgagattaaaccttttgccataatgaatggcagaaaaattgtagtaaactattacatttgcacaggtcagcatttatattcgctctaattgaatacttagggttctaactcagtggtatgttatttccctaagggtcacctaaacagttgtgattttattttcattcttggacttgatctatgattctccttaaccatttgagttgtaccagtgttgctttctctcttaccagggcatggaggtcagtatataatagtctcactgttgggaagaaattatcatctctctaacattttcccataccatgaagttaaatattttgccatgtgttgctggccagaaaacagtagggccttttgaaatttgtaacttacatatattttcccacaattgttacattttcatagaccagagaacactcaggcttctatctgaaccttttcttggatctgtcctagtagggtataatgtttccttaagcttgctagcagatatttcttaataccagcctgtggattttgtataactttggttaatttctcctcctgattctgctgttaaatagaaagcaaagtggttattgctgtattactgttcctgcattggtcatgtgatgtgctcatgtgagcactttatttgtaatagactcttctgggaggaagctgcttgtctcagggagtctcctgttctctagaaattgcccttcatggccagggtactgcttcttttgttagagctccttacatattctctaccgtgttatctctggcctacatactcctattcctgtttctttgacctgagcttgacttcagtgaagctattggagaaggaaattaaaatggactcttggctgggcacagtgactcacacctataatcccaacactttgggaggccgaggcaggcagatcacctgagatcagcagtttgagaccagtctggcaaacatggtgaaaccccatctctaataaaatacaaaaaaaaattagccaggcggtggcacgtgcctgtaatcccagcaacttaggaggctgaggcaggagaatcgcttgaaccagggaggcagaggttgcagtgaaccgaggtcgcgccactgcactccagcttgggcgatggagtgagactccgtctcaaaaaaaacaaacaaaaaaaaaaggactttatatggcacctgaaaaagattcaatagattcgactagcacttactgagtacttaccaactaaaacaggatatcatctaattctcacaacagccatgcccattttaccaattaggaaactgaagttctgagcgggtaagaagatgactcacacgtataataggtagtagagccacatgtctgcccgcctgatcgtcttaccacctctttatagcagagaaagtaggtgagggattgggcgcagtgtgtgagcaaaacaaactggaggaaaggaccatcgagtgcattgtcaccgcctcccaagcattaccacatcctgaagcacagccgtttccttctcgagtttgtttagtttttatcttccccatttaagatcatctgaaagtgaaagggaaaaaaagagctgacactgaaaagtctcttacagagtacaaagatgtttgtgatcagtttcccaagaggctgaaataaaactcaaaggtgaaaataaagacaacagtacatgggtaaataaaaaattggggatgcttaatagccattgtctgggcttgaggagttctttgatttgtttaccctcattgaattttctatgattagatgctagtccatggttctcagtcctggctgctcatgagaattgtctggggagcgcctgaaatgagtgacacctgctccctacataaaccaattaaatcaattgctgcgggtaggagtctaggtgctggtgcttttgggttacccaggcgattgtgtaataatattcttccagagttaaaaccacagtgttagagctggtgaaatttttgcccaagagctatgaaccactttaggggatagagtctgtgagtgagatgccaaaggttaacaccgaagtcattctggagtccatcagcattagttgaaagttctggatttggaatgaaatggaaactaagaagcattgggaaattgccaaggcatattcattgcctttgaggagctcatagataaatgagaagctgggacaaatacataaatttacgtatgctagtcagaaggatgaatcatataattttgtggtatctttttgctgctgtccctacctcgcccttaaaggtttttgaaataagggtggtttctgggaacaggtaaggtgttaacccaattgtcctttatccaaaatgttgttggaggctttctggatggagatcacaaagagaagaacaaaatgtaaatgtgcatactctttttctttttcttttttttttttttgacaaagtcttgctctgtcgcccaggctggagtggagtggcgcgatcttggctcactgcaagctccgccttccgggttcacgccattctcctgcctcagcctccccagtagctgggactgcaggcgcccgccactgcacgcggctaattttttgtatttttagtagagacagggtttcaccgtggtctcgatctcctgacctcgtgatctgcccgcctcggcctcccaaagtgctgggattacaggcgtgagccaccgcgcctggcccctttttcttgacttccaccttttttccttggctgtttactcctagcactgctctccagagttttcttagaatttatattagtaggcaaggttagtgtatgataaataactgtatagagagacaaacaaaaatcttatcctcttagactaattcagtgggaacttgagcttagagactgatgtggtttggctctgtgtctccacccaaatctcatgttgagttatgattttcagtgttggtggtggggcctggtgggaggtgattggatcatgggggcagatttcccccttgctgttctcatgatagcgagtgagttctcatgagatctggttgtttaaaagtgtgtagcacttctccctttgctctctctctctcctgccaccatgtgaagatgtgcttgcttccccttcgcctctgccatgattgtaagtttcctgaggcctccctatccatgtggactgtgagtcaattaaacctctttccttcataagttactcagtctcaggtagttctttctagccacatgagaacaaactaatacagagatcatctgtaatcttcccaattttacacatgagaaagtagaagccccaagtaaggaagagactatgccagtcatcagctagtttttggtataacatcttggccacctcttccaaagggaaccagaaattattctttttatgaggccaagggaacttacatttgtgtgccactctctgctaaacacaatagtggttagctgtaattctcacagcgtccacattaagtgtttccatttcttggatgaagagtctaaagcttagatagtttaagtctcttacctaagcaaagttaggggcaaagccatggttaaaattcaggtagagtgaggtttgtttgtttgtttattttttggagacagagtgttcctctgtcgtccaggctggagtgcgtggtgtgatcttggctcactgcaacctccacctccaggttcaagtgattctcctgccttagcctcccaagtatctgggataacaggcacccatcaccacgcctggctaattttttgtatttttagtagaaatggggtttcaccatgttgtccaagctggtctcgaactcctgacctcaagtaatctgcccgccttggcctctcaaagtgctgggattacaagcaagattgagcttttaaacctacgctcttttcagtttaacatagtataccattgtccccagtgcaattctttatagcaaatatagtctctattagcaatgctgaggttttgtctaaatttattctgttacacaatcaggaaatggtataatctaatgcttatctagttttattatttcagaactatcagattgatacctactccacttacttacaatgaaataattctacttctgaaaaccactacttgttagtctgcattatcatctctgggaatatgagaagcagtatatacagacttgtactccagtcttaatttctgatgcctaccagcagtgtgagcctgggcaaatcacttaatcccactacacttcagtgtccttatctacaaaatagaaatgctagtggctaatcataggatggttgcattgatgagattgagaacgtatggcatagtgcataacacatggtaggtgcttggtagatgttggttatgaatttactatgagaagttagtgacacagcatttccttgatgaagtcagctttctgctaagaataaaagctgggtagggagctcttaaccttgaatgttaattatcttcaagtttattggctgaaggtctcagctgtacaaaactgatcattttccaagaaacatagcactttcagctcttttgtgctttgagagtgacttgctttggattccctttgatcactgtgatggctaactaaatgatttgcctcagttaacctcaaatatgagtacagtgtgaccattagctattcctgcttccatgacaacagggcatcctgtaactcaccaatttaccgttaggactagattctaaactcccttctggaattaggttgatatggatgcatggcggctttggctgcatagtgcttgttactcacatgctctagctcgtcacagctttatttgtgacatctgttctgaacacatcatgtctcttccactctctggcctgacacaccatattgactgttactgccactgtattgtcttcctacctgccttttggctcttctcatgattttaaggattgaatacccttaaacaaatatatagaatgaagttggcctgtaagagggatttaccgttacctgcaaatgttatcttgaacctctgaattttatttgctatgttaagtttgtaactaaacttactgggtgttttaattttcagttgcgatccgaggtttttttgtgtgtgtgtatgtgacacaggctctcactctgtcacctaggctggagtgcagtggcgcaatcttggctctctgcagccttgacctcctgggctcaagcgatccttgcacctctcagcctccgagtacctgggactacaggtgcacactgccacatccggctaatttgtatattttttgtagagacggggtttcaccatatggcccaggctggtctcgaactcctgagctcaagtgatcctcccgccccggcctaccactgggattacaggtgtgagccaccgcacccagccaggaaattttttgttgttgttgaggcaaagtctcactgtgtcgcccaggctggagtgcagtggcacgatctcggctcactgcaacctccacctcccaggttcaagcgattttcatgcctcagcctcccaagtagctgggactacaggcacgtgccaccatagctggctaatttgtttgtatttttagtagagatggggtttcgccatgttgcccaggctgatctcgaacatctgagctcaagtgatcctcccaccttggcttcccactgggattacaggtgtgagccaccatgcccagccaggaaatatttattgaatacctacaatgtaccaggtattgtactaatggactcttcaatcttttgaggaatcatgatacaggacatagaactcatagaactcagtgactgaggcagtggcagagggcattgcccaagcacagggcacaacttctgggcccacagagaaatccattcacagcttgctttggctttgttatacagagcagcagttttctcactagtctgtgcagatatatgtttcaaaagagcaaacaaacaggatttctaaagagaggggatcaagggactactaccttaattaagaactctatcccaatcaccttcgtacccccttttcctatcagaagaacaaaaatcattacatgaagggtaccacgggtgtcagaccccattaggaagctctgcatatagtagcatattttgtatgagatttttgtatttttttaaagaatagaatagttctagttataggaagatttttatgagttactttgccgtatttgctttatttttccctctccatccatccctattcctctctctctctctctctctcacatacacatgctttatgcttttttgctgaaccatttgagaataaattgcagacatcatgcctctttacccctagatacttaagtatgtatgtcctcagcttaagggtattctcctaataaccatgatacagttattacccttggggaatttatcattgatataaaaataaaatggaacatctaaatttcccttaatggggccaggcgctatggctcacacctgtaatcccagcactttgagaggctcaggctggtggatcacctgaggtcagcagttcgagaccagcctggccaacatggtgaaaccctgtgtctactaaaaatacaaaaattagccaggcgcggtggtgcacatctgtaatcccagctactcgggaggctgaaataggagaatctcttgaacctgggaggcggaggttgcagtgagctgggatcgtgcctctgcactccagcctgggcgacagagcaagactccatctcaaaaaagtaaaacaaaaaaataaataaataaatttcttgtaatggctgccagttcctatattggacagttctcaggtctagaacactctcagaaggcactgtagcagaggagggtgctgagcatagtgcagcagagcccggggtggggggataggggactcctacctcagcaacgcagcagaccagtagcgggcaggagtggcaggaaggctggctgggtgccaacaggagaatgaactaaaagtctgcagacagaagggccaccctctgttctgacctctagaacattaacagcaggcagttatccctatcggcaaggtaaaggacaaaagggggttcttctctaaagacactgatggaactatttcaggagaatcagggaagctggtgtggtattagcgcccactgaaaagccccagtgtaatcaggaattcagggagctctctccgccaagagccccacagggctcccagtctttagcctgcttccttcccaaacctgactgaacaaccaaagatcaccacacgtctgagggaagcctacagcgagaaagagactaacaaagacagaaaaatggacattaacccccaaaagagacaaaatctgactggccataaaagagtgctttaaaatataatttagcaataaatcatctacaaccccccattaacatcccagagaagatcgcattttccaaagatggccatgaggatacttttctacagtgtgaccttggcacccctctgtcaggagcaggagtcgaaatttccttctggagtctgggcaggccctggctacttagcctaattgattgtggcagactaggccagctgtgtgacttctgagcctgggtcataaaaggccatgcggctgctgtcttttcactgaagtggtggaaggatccaactagcccgaagctgccgtgatgtgagggagcccaggaagaggccaccccaagctgctcagatgggcagtcctagttgtgcagttgtctgtcccaagcatcagacttaggagtgaaggggccctcggatgtttccagacccaagatctagtcaccctgcagccttcgggttttcccagctgaagcccagataagccatcccttctgcgtgctgtctaaattcctgactcacagcatctgtgagtatcataatatggactttggactgaaagaagtcgtgtaatatctagatgttttggggcactgaatttgatagggaataaagtgtgcgtgaaatccccagtatttggctctttgtctctgaagttctgactcactctttttgtttttgtttttttgaaatggggtgtcactctgtcacctgggctggagtgcagtggcacaatcacagctcactgcagcctcgacctcctggctcaagcgatcctcctgcctcagtctcctaagtagctggaactatagtcacgcaccaccatgcccagatgattttttatttttttgtggagactgggtctccctatgttgcctgggctggtcttgaactcttggactcaagcagtcctcttgcctcagcctcccaaagtgctgggattacaggcataattggctcactgttattaataaccaaaacatggtctggcctagagtggaggcagccccaagtttggcagattccaaatctgcagcctattttgatccttcttaaattcagaaataaatgttcttgaacaaaggaaaactcttaagctcttaaggcagtgagaaactgctcatgaaacaaaacaaacattttaaaagtagaaactaagtttttaaaaaagtgattctttgaaggacattcacaaccatttggtaggtctccattcacatgtcagattgtttcttctgaaggactattcaattaatcattgtttaaccctagtaaatcaaaaaattaatgacttattctaaaattcagtgttttcaacagattgaaatcttataactacaactagagaaaagaagttgaagagctcacctgcacacatggacataaacatggggacaacagacactgtaaactactagacggagggggaagtgggcgcgggttgaaaaactacctattgggtactgtgcacactgcctaggtgcaacatacacatggaacaaacctgcgcatgtaccccctgtatctgaaataaaagttgaaaattttttttaaaaagcttaaaataatatgttctcagttatattttaccaatttaaacatggctaatgggaaaagtacattgccaactcagacatttagttggtgatattaatcgaaagcatttagttgatgatattaataaaaattatcagaatgagctggatcattctgttggggttttttggtgccttgcgggtaatttttccatgtattgctctttatctcattattgccactcccaaaccaccccccaacccccaccaactgctaaagctgaacaatggacaaagaaagccttcaagtaatccagacagaggagactctacattttaggaggcatggtctctgttgattgaagacagtacaaaatatgtcctcagcctctgctttaattaaaaggtacttactatcaatcacttgaacctaggaggcggaggtggcagtgagccaagattgtgccattgcactccagcctgggcaacaagagcaaaactccatctcaaaaaaaaaaaaaaaaaaaaaaaaaagacacttattatcaggtgacttgattaattgaagaaataattattttttctgccgcctgtaaattagtcgaaaagaggattaaaacgaagccagggttatcagccactatgtaaaccaggtataaagaaatatgtctgtgagctcctgctctcaggtggctagctaaacgctcttggctacctcctggtcccaccatagggaaggctccctgcattacattgaaagtcatttatatttctgtgtctattcaccctaggtcttggtgaatgtgaagctatatggaacctttctagacaaagcaaatcataccttttgcaaatatagtaattgtctccagcttcccaataaaaggacaaagtataaaaaacaaacagaggccaggcgcagtggctcacgcctgtaatcctagaactttgggaagctgaggcaggcggatcatctgaggtcaggagttcgagaccaacctggccaacatggtgaaaccccgtctctactaaaaatacaaaaattagccgggtgtggtggtgcatgcctgtaatcccagctactcaggaggctgaggcaggagaatcgcttgaactcaggaggtggaggttgccgccacttggtgagccaagattgcgccactgcactccagcctgggcaacagagagagactctgtctcaaaaacaaacaaacaaaccagaaacaaaggagaatgaaaggatcgtcaaacttaggagaaaaacagaagaaatgcacatgagtgtatttgagtctaatgacctgtttgcatccactaagtcagagttttccaagccccctcacctgctccctttgtcatctttgaactgataccagggaaaaacttaattggtaaatttgaataagatgaagtatattgagaaatgcagaataaaaatagaaagtcaaaattaaggaatgtagagaagccaagtaagtagggaaaaaatgaagtcaaataattggaaagcagaactggaaaatacacaatataccagaagacttatcaaaacagaaccctctggcgaggacattcatttaaaaccaaaatgtttttcttggtaagtttattatttaaaaaaaaatggttgttagaaccttttcatttaaactgagtatccggcattaatacataggaaagatactttcaatgtacgtgaagaaagcacagaaaggttataaaaatcaggcatttcatacttatttttaggctaactaattaactaaaaaagacttatcctcctatttaagctgatatataattaaggtgtctgagtacaaagaatttgtccctaaacctaatgtagaatgtaagagacaaaacctgaaattttccaactactctttttaaaaaatacgaacttctggactgagtgtggtggctcatgcctgtcatcccagcactttgggaggctgaggcgggcaggtcacttaaggtcaggagttggagaccagctagtccaacatggtgaaacctcatctctactaaaaatacaaaaattagctgggcgtggtgatgggcacctgtaatcccagctactcaggaggctgaggcaggagaatcgtttgaacccaggaggcgtaggttgcagtgagccgagatcacaccactgcacttcagcctgggcaacagagtgggactctgtctcaaaaaaaaaaaaaaaaaagaaaaaaaaagaaatcaacaacaaacaaagaaaaaaacaaacttctgaaagcattatctattatttgaaaaaatcattgagaagctaccataggcgaggcactataatatgtgctatgggggatagagagacagataaaagtttctttccacatgagttttataacaggctgataatccaaggaagcttgaagaaaatgcttcctgaaatttggttctcttagaccatgcctagtagttgagttttaactattgcagaatcatcagatgagcccagggaatgggttctcagggctgaccaagcagtaactgacagttcgattgtgtatcccatggcctcagactattctgtttgagcatcatcagcgtcattagtgattgctatttaattagcccctcttctaagttttaagaatatgtgactgttaaatattgtggtttattaagtttttatttatagagatgggggtcttgccacattgcccaggctggtctcgaactcctggcctcacatgatcttcccatctcagcctcccaagtagctaggattacgggcgtgagccactgcctctggtttaaatgttaagcacatgttaaccctcaccaaatctctgtgaagtagatactgctctttttttataggtggttacaatgaagtttagaagtgtaaagaaacttacccctgctcatgaagcttgtgaatgctctagtcaagattcaaaccctgacctttgtcatcgaacttcagcacctgacctttgtcatcaacgccccgcaggaccataagcttttctctgaatcctgaactcaaaaaactctgaaaattgaatttctttttcatatatttgctgccacaactcattttgtggcaaaaccagacctgaactgacttgattccatagtccttatcctacttactggaaatgttcacgtatttcactgcagctatgttgtggctctctaatactctgtattgtacaatgtatggtatagactcctttttaccttcctaaaattgaaaaacctttaaattctgaaaccatctagatctgcaacttctagagaagagatgagaagctgactatggccacctcacacctgccagccagctctcactgctcacaacatgctcgtatcctgtgactcctaacaggctgccaacttggaaatttaaacatgtatactttcattaccctcaaaaactcataattgtgaaaaaattattagttcatactgatactaccagtttcagtttaacaccagaattcttctacttcttccctattccagaacttcctttttcctcttaaagaaaaaaaaaaactggctagacatggttggtggctcacacctgtaatcccaacagtttgggaggccgaggtgggcggatcacctgaggtcaggagttcaagaccagcctggccaacatggtgaaaccctatctctttgtaaaaatacaaaaattagccgggcatggtggcggatgcctttaatcccagctactccagaggctgaggcagggagaattgcttgaactcgggaggtggaggttgggtgacagagcgagaccctgtctcaaaaaaaaaaaaaagaaaaaagaaaaaaaaattatctgatacttgttaaagatggtagggaaggctttattcaagagggaccactacagtgggagttttgcaatagtggggagagatcaggttgaactcctaatgcaacaaggacaagtggaaatttatagccaaggagcagagtgtgggtcaatgggtggaaagttactaagaggaaaaatccaggttggaggggattcttgttgaaggcaggccagcatgataagatatcgagggtagggggatcagacaccaagggtaggggattttcactaaaatgactcagcaggatttttgctgagactggactaagcaggtcaagatagaacccaaagtcgaggcctagtcagaaagaggactcagagccgggcacggtggctcatgcctgtaatcccagcactttgggaggctgagacgggaggatcgcttgagcccaggagttcgagaccagcctgggcaacatggcgaaaccccctctttactaaaaatacaaaaattagccagctgtcccacctacctgggaggctgaggtggcaggatcacttgagcccaggaggttgaggtggtagtaaaccgtgattgtaccactgcactgcagcctgggtgacagagtgagaccctgtctccaaaagcaaacaaacccagaagaaccggtttcaagtttggtcaaaggagagagtctttgtcatcccacagtgagaacatcaatgtttcttttgtgatttaaagataatttcctttctgtttagccaggatgcaaagtatttttcctggcatgtgaaaagctagacttttattttaacttagataatagggaattcattttataatgagattcactgtgataaatatcagcaattttattgcatttaaaattaaaattatattcatccagaaccttttaggaataatatacagatgctccttgacttacagtggggttacatcctgatgaatccatcataagtcgaaaatattgtaactcaaaaatgcacttggccaggcacagtggctcatgcctgtaatgccagcactttgggaggccaaggtgggtggatcacttgaggtcaggagttcgagaccagcctggccaacatgatgaaaccctatctctactgaaaacacaaaaattagccaagcattgtgacgggcgcctgtaatcccagctactcgggaggctgaggcacgagagccgcttgaacctggggggtggaggttgcagtaagcggagatcatgccactgcactccagcctgggtgacagtgagattctgtctcaaaacaaaaaagcccttaataattagataaacccatcataaagtgagaagattaaacaatcaaaaaatcataagttgaactgttttaagttggggactgtctctatattatttgaagcaaaatgaccagagctggctgggcgcggtggctcatgcctgtaatcccagcactttgggaggccgaggcgggtggatcacgagtcaggagatggagaccatcctggctaacacagtgaaaccccgtctctactaaaaatacgaaaaattagccaggcgtggtggtgggtgcctgtagtcccagctacttgggaggccgaggcaggagaatcacttgaacccaggaggcggaggttgcagtgagtcgagatcatgccattgcactccagcctgggcgacagagcaacactccgtcaaaaaaaaaaaaaaaatgaccagagtcattttaaatgttaattgcctaaggccaaatgaatgtgtatagaatagatgttggaaggtcattgtgggggcattacaccccttctcctcttacttgaagtgggtatttggggattgaggtacttatcacagtgaaagtatgaaggagaaaagtgaatcatcatttagttaaaagatttaccaaaggccttcaatatactcacttaggatgagggaaatgagggatggattatttcagactttcatcttttattgtaacttttttgagaatggagaagggggtcagggatgagtggggaagaaaggttctgcagattactttctagattaggttctttttttcaagttttatttggtagggagagcaaatgaataaaccagaatatgactggaagtgttagaaaattggattcacttctgaatctctgacttgctgccttcatgacgtacagaagaataaggagagtttggaagagaaaattgttaaatggctctgctcgtctctctctgggcctggccatgatgttgcccatttctgtgcagcctccagggaatatggagcagcaaagaggcctaggcagggcgagggagatgggatggacccctcaataccacggagaccggaaggaccagtgtttgtccaacacttgctccgtgtcagcctccatgcacagtatcacatttagtccttacacaaactagttttatccccattttacagattaaggcagctgagactcagaagtgaagaagcttaccaaaggtttcacaacctgcaaatggaggagttggggctggagaacatttctgtctccaaagctcatgccttttctatcaggccctccactcccagccaccatggagtttccagcagggctgggggttgcaggccaggctgatgctagaactcttcctgccacatgacagcaggggaaagagctcaggtttcctcttttaagtggccaggtatgtttcctctcatggcgtcttgtttatgtaaattttatgcacagctagctcagggaagcctccagaaggcactgacctccttccttatggtcaacccacatcttaccctctccgatgtggcatggtagatcactctgcctctgagtatacccaggagatagtttctctggcatgtttctctggcacatgccaaccctgtgtctcagtcagagcccctcctctggaagcacagggtctctggggtctgtggctacttcccagaggggcagagctatggtccctgaagaaacacactggaggaaaatcttaggaaacagttggcacacacagtaggtaaataattgtgaaatgaatggatccgttgcctcctggaaagccctatgaatgggagtggatttacacgttctgttacctttgtacttggcagttttcccatggtgtttatttgaaaacaagttcagattatatcccaggtcacttttgtattgccgctggtaacactaggaacgtttttgtgttaagaaaaaaaaactgctttcaaagttgcctcttgtaatgaatgttctttttctctgctaattaacttattttcttgaacttgctatttcaaaggataaaaattcaactagagactgcaggattatttaattttctctttccaaccagtagtaaccgtgctaccgtgggagcactttatttctccatctgttagactataaaatcatggaacatttttcatgtcttaatagggagagataatgcatgtgagaaaacttcatatatgtttctacgaaaggaacttcctgtgcggctggctaacacaatgagagaagttaatcttctgccggataatttacttaaccgcccttcagtgggattggttcagagttggtaagtaaacaatgtggcttaaaatggatcttcccacaatgctgtgaacatttggcagcgagaccattctctgtaaaagtgcacatactgcccgtctaggtaggaatgagtcatttgggatagctgggttttccatgcaattaaaagttgttttgttttttttcttttagagctgtttgttttaaagttgttttagtgaaaatgcttgttaagttatactagacactttcctgagtttttcttgtgtgtggtgggattgcagttcttctgacaggatatttgctgcttttatcaagtcttaaccttactcctttcgttttccttgtaaagacattccttgaagtcagtacttcttgtagaacaaattaagtcatttaaaggggaacctcagattggaaaaatatcagttccctcctttgcttcatttgctccatgaaaagtaggaaaaattttgacagagtataacataaacttaaatcagttatagctctgatgcttaaagcatatgtcatttaactgaagaagttgaatttgtgacacaaagtcctgggccacccgtgcttttgactgagtggctagacattgagtttccatgccccttttctcagatttgataatttgctagaacggctcacagaactcaggaagatacttcacctatgtttataggtttattagaaagggtacaattcaggaacagccacatgggagagatgcatagggcaaggtatggggggacacatggagcttccatgcccactctgggcacaccaccctcccagtacccccatatgttcaccaacctggagactctctgatggtcgttcaagggttttgatagagctcaatctccagccctctcccctccccagaggttgagggtagagctgaaagttgcagtcctcgaatcacttggcctttctggtgaccagccccatcctgaggctatctagaggtcccgtcctaagtcaccacattagcataaactcaggtgtggtcaaaggcggctccttatggatagcagaagacaatcctatcattcaggtagttccaagggttttgggagctctgtccaggaagcagggacaaagaccaaatgtacttaaatgtgttatattattccggcaaagtataggcttgaacaaattgctatgtcaactctattgtttggtttttgtcttttaactgttccttttccgtatccattccaaacaaatgcatgccatttcttccttcttgtttcttaaacattctattttgaaatactttcctacttaacagaagggttgtaaaactggtagaaagaattccagtataccttcacgtagattcactaattgttaacattgttaacatttggcaacgttctaccattgtcattcagattctctctctctgtctcactctctgcatacacacacacacacacacacacacgtgcgtgcacacatatatataatctatgtctatatatggtacacacacccatatatggtacacatacacgatgtctacatcatgcccctttgccctaaatactttagcatgtatttcattggaacaggtctcagaaaaccacaatgtgatcatcaaatttgggaaatttaacattgatacagtaatgtcttctaatatgtagaacttgttctcactttactactaattgtcctgatactacccccatctttttttttttttttttttttttgcagtttctcctcctgatttaggaatccacttcaggatcatgcattgtgtttcactgccattttttccttttaaaagcgaatcttatgcataatgggctgtgacccccaccaccatccccttggtcacagtgtgtcctccttgctctcttgactgtcaggctgggaacctcaaaataatcttttttttttttttttttttttttttttgagacagagtctctctctgttgccgaggctggagtgcagtggcgggatctcagctcactgcaagctccgcctcctgggttcatgccattctcctgtctcaacctcccaagtagctgggactacaggcgcccgccaccatgccctgctaatttttgtatttttagtaaagacggggtttcactgtgttagccaggttggtctcgatctcctgaccttgtgatccgcctgcctcggcctctcaaagtgctgggattacaggtgtgagccaccgcacctggcccagaataatctttggctccctgctatttatgactttctccaactgtcccctttggaaaggacgggatgcctacctagcttgcttgcatgtggcagggcggagggcatcactggggctggctggctttgacctcttggcgttttgacccaatgattttaacaatatctaatccatagccttatatgcccagagacttttatttatttattttatttatttttttgagatggagtcttgctcagtcgcccaggctggaatgcagtggcacaacctcggctcactgcaacttctgcctcctgggttcaagcgattctcctgcctcagcctcccgagtagctaggactacaggcatgtgccaccacgcccagctaattttttgtatttttagtagagacggggtttcgccatgttggccaggctggtcttgaactcctggcctcaagtaatccactcgcctcagcctcccgaagtgctgggattacaggcgtgagctaacacgcccagcccccagagacttttaaaaagtatgtccatcaatgaacattcattagtatcaaatgcattgtccaaagttcacatgaagctgatgaatcaagtggcattctcattggagtatttatatgtgtaacagtcatttttagttactagagtgtcctcatcctctatccaaaggtgtagataataggattagtggcaattaaagcttagaaataattagaataaagggataattctttcaggacatgttaaaaccccaaatagagatcacatatctctaattggaatatctgaatccccaccagatccaacagatcctggctggatatagctgctgcactaatgggcctctctggatctcatttttctgtgttctccagattttaatgttggacagactgtttcttatactggccctgattgagatatggagctattcttaatccagaagctgtttctgagggtttaattggccttctttctcccccattaagtactgatgaaattaatttaactcagaaggacccttcttcacttctagtttctaagttcttggcaggcacttcagtgtcacacatgtgtttcttaaaatgtataagtacatttttggtaatcaaactgtagacttggtatataagttaggatatgtctgtttgtaagtagaaaaaatgcaaccgaacctggctcatgtcactagaaggtccagccgtagggtgagcttttggtgttggtttgattcagagattcatgaagctatcgaggccctgctttcgatggtgctggcttcattttcagactggattcccccctggtggcagaatagctgcagcagttccaggcttccaatccacacagcactgcacaaaagcagagcaggttgatttctctgccaaagtcctctagcgagtcttttctgtcattttactggcctgaattgagacagtatgtccattcctgagccattccctgtgttcaggggaatgcacacagtgataggcttagacctaaactattgggctaatgaataattagtgacaagagaaatagaattgcccagagaaaaatgggaccacccaggatctttggaggcactggcttccctgatgcacttaagccacatgggggatgcggatgggatggagacctgagtgaaattttggagtgttcttaggaagagggagaggaggggtggatgctgggcaggcaactaacatagtaactcttctttttcttttttttttttccttttaggtatatgcagagttttcttgaacttttagaatatgaaaataagagccctgaggatccacaggtcttggataagtaagtatggtaccacttagctgaaagtaaaaatatctaggtaagaaagattttggtaaatgtaattcaagtcattaagactcaaggagtatgaatgtggacaaaagcgttcattttcttaatgagtagtgactcaacattgagttttttttttttaattcgagctaagaatgtaacacaatacaaaagtaataatgacactttcagttttgcttttatgatctaatacttaatacctttacccaaggtgaactgggcagtcactataaacactgcagtaaatgttccatctagtggtagttttaagaatgcagtggcctttttatatacatgaatttatctactcaatcctttacaattaaaaaaaaaatttcaataggatattacatttgagctcaaaaactgtagtggttttattttggagaggcataaaagtatgtttttttatatagcaacctgaattctattgctccctttatgcacagactggcaaattatcatgctgatgagattcatttttatttatcccaggaacactaactctagctgtgagtatgttttcccctccaagagaaattaaatatccctttcacattaatttcttcctgtttcatgtatatgtaagtggatgcatatggtaggcctgttgtgctgagaaatttctaagtataaactagtccacatagttatgagactgaacacctgacttaatagatgttccataagaagaactagggaaacaccatgttatacaagcaaccttaggaggtatttaacccagtcctctcaatccacagataaggaaactgagttcagagatgtgaagtgacttgcccaagattgtgaccgttcatagcaaagctggacctataagctatgtttacgtctgagccatgagtagctagttctagtctagttgtaaactaaaattcaaaggaaaaacaaaagccctcacctattatatactttgttgggtgtttgtctgatggatctgtgaagtgtggaaggcagggaagcattgggttagagccccagatgtagcgttttccttgatataagccactgctgtcatttaagcgattattaaatgaattcaatccaggagctttgttttctcaaaagtcattagctggtaaccgtttggcagaaatcctaaaacctagggctgaccactgtagctccaaattttagaacaaatttgtagaagtatagttggtcctttgtactggcagtttccacatccttggattcaaccagccacagattgaaaagatattcaggaaaaaaaaaagcaataaaaaataacaatgcaacaataagaaataatacaaaattttaaaatacagtctatcaactgtttacatagcatttacattgtatcaggtattataactagtctagagatgatttaaagtatccgagaggatgtgagtaggctgtatgcactattttagataagggacttgagcatctgaggatttgggtatctgcggggatcctggaaccagtcccctgcggatactgagagacgactatacacgatgttaaatttctgctgtgtttttcccggagtcccgtctcagtttctggaacaggttatccgatgtgatttatggccacgagcctgctttgcaaactgtcagtgctgaatccagtgtgtgcttgacgatagcaataatagctgagctctcactccgtgagttttgtagcttgcctaggttcatgtggttagttatgatagttggcatttgagaaggctgatgttcttggtgaaggaaggagtgaaaggtgagcgagtatcatggtagcagccttttctgtttaccaagaggttgtatgggatcaccagcagggaaatcattttagtaaagcaaaagtagcttagaggacaagcttgttgatcatttatgatagagtttagaagagcccggaagattggaggagaattctgagcattgagccattgaggtaagtctccccacttcagataagttgaggcacttctctactataatgaatcgtttcactttagtaatatttaacttacaaatacattgcaacgagtattacataaaggacaaattgtctattataaaattttttgtgaatgacgatggcctaatttcagagttttacatctttattgtcattgtacgtatgtatttgttacagaaatatttcgtcaaatatttcatcaaatatttcagaaaaataagactattgagataagtaaaaagaaagtcaccccaaatttctactaccaggggacaaccactattactattttcctttcttccgtgcttttccctaggcatgcatatatttatatgcgtaaaatatttttacaaacataacaagtgtcaacattatagatctacaccattattaatagtttcataatattcatgttaatagtccatcttcagatagttcatgcaatttgatcttctatcactggattttagactggtttgtagttttcatgctactataaacaatgctttaaagaacagcttttaaatacatctgttggccgggcatggtggccgacgcctgtaatcccagcactttgggaggccaaggcgggcggatcacctgaggccaggagttcgagaccagcctgggcaacatggtgaaaccctgtctctactaaaaatatgaaaattagccaggcgtggtggtgggcacctgtaatcccaggtactttgggaggctgcaggagaattgcctaaacgcgggaggcagaggttgcagtgagtcaagattgtgccactgcactctagcctgggcaacagagcaagactctgtctcataaataaataaacaaacaaacaaacagctgttcaccttttccagttattttcctaggatcaattcctccaagtggaattattttctttgggcttttgctgtatgttgctgattgtcctgagaagtgcctcagttaagccccaaactctagctgatgctgatacgtggagaataataagtatcacattgttttgatttgcttttcttatttgtaagggtgacgttattggcatttgtgcttcttctttggtaaattttgcattgatagcagatcctttgcctagttttctgatggggtgctagttttttcctttttttaagttttttgttttttttctacttcatttattaatgtgtgtccctataggattgctaaaattctacatagtcatatcatttgtttcttcacattatttgtttctacctttgatattaagcttagaacagccctccttatcccaagattatgtacttattcacctgatttttctgttatcatttctgtgatttcacccttttacatttttaatccagtatttggttttaagtcttgaaattaggatgtgactgaaattgttagcccgctgttccagttaacttgattattagtttgattgtttacctactgatttgcaatgtcactttctcaatatgctcgatttttatatatacatactcactcatgggcctggtcctaaactttttatttagttccattgactgacttgtcttataccattcttaatgtattttcccatatgcatatttacaataagatgccagatacttgaatagtttaatttcctgtgttctgtctgcatttcatcactgtattttactgctgcgagatatttatttccaaattttactcttaaactgtatgagacactttaggaggctgaggtgggcggatcacgaggtcaggagttcaagaccagcctggccaatatggtgaaatcctgtctctactaaaaatacaaaaattagccaggcgtggtggcgtacacctgtagtctcagctactcgggaggctgaggcagaagaattgcttgaacccgcgaggtggaggttgcagtgagccgagatcacaccactgcactccagcctgggtgacagagtgagactccgtcaaaagaacaaacaaacaaaacccaaaaaacagtgtgacattatttctttattcatggaagctattgctttgagattgctttaatcagtccttggagattttgtggggattgtcctcatgttctcagaagaagtactgatatgttctgcaattctttattcaacttttatagaacctgtgttatatgcaatcacttatccaaaaagtctggattcctaaaagggtatttgagcattttttttctgtactagaaccttttactttttgcacttctgaaagaagggtttctgtagaaaaaaagtttcaagcaaaaacttggctcatactttagtttcttgtgggtggttccttgttctatgtagtaagaataatgtctctacttataaaaataccagcagacaactagtctggggacagagctgggaagtctgtgcatcagcccatgagatattaagactgaccacgttttgtttccctctcacacagctttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacagtaagttggagtttgttggtccagttttgaaaaggtaaccatagtgatttctcccaaatgttttcctgttgttaatttactgacctgcatttttggttgtagaaatttcatttctagttcggtttttcctaagtgaatcctagccattacaaagctattaatttgtattcttggttaaaagaaatgtttgaaaggcttttatgaggctcacattagagacaggaccactgcctaccttttaagtctctgctgatacagtcttgatggggatgagggaccgcctttaatggcagccggccttcatctctgaatacttttatgtatctcagattgtattattttctttatccaggatattatgtgttttcctttttagttttaaaaacattgacactggaaatattgaattggatgttggtgataggagccatcagttctttatttcacagtgatcagtgaagtcagattaagccagactgtcagtccataatcccgtattgagagttttagtctgctcttgagggtactaagcagatatgaaaaaaacaactaaaattccctccacacaaaaaactttttggctcatcttcagcactgtctctttggctgattttataatccttgaggaaaagcatccacatgtctagagcataattcaccctgtttgctgcatcacaaagtggacaaaccatctttattttagtaatttgatttatttggataactgaatgttatagaactattaaatgtggccttatattaaatgtatatcttcaaaatggaaatgtatgacaatttacaggaataaaagagcctaaatactgttcaactaaactacttagataactccagttgctttctgatctaaatacacatgtacacatatatacgtgcatgtttttagatcattagttaggcctacacatctctgtttttcttccccttaatcagttcgaactttattaattagcctaatgcctgtatttatcatttttcatagtttaaaatatcccctattttatttaggcatccttcttttgttagtcgcaatttttgcttgatttaaaaataagaacacctataaatatttggatgcagattgcttttttctttggggcttcttttggcttttattcagaaacaaaattttgcaaatcttgtatattgtgaaattatctgagtgtatttttaaaaatacttgaacaagtattgtttgtgtacacaacattgaaacataatctccatgggggaggcatctgaaatgctgccagcgaagacactttgcaagcttgtccaaatggtatagaccacatgttctaaatatttaatgaaagttggagtttgtgtctggagtagtactaagaaggtgggtatacttgactaaggatgaaagtaagtttcttcatccatgtcacattgggagaggaagaacggattgggcacctggcacgtgtcactgctttagaacctgctgactgcaactgacagaccttaaaccacatcctcctccttcattgaccaataagagttgttcacccatcaattgtgtgtattccattgctctaagttgctgtggatgctaaaatgatttttacacataagatatcctttctaaacataagcccctatatttccctgtgtgaccatcccagcctgctgtgttttaatcccctccctttccttttgtgttcgtctagcacttctgtttgggggtgacactaatcctgttcatcctaaacacataggaagtatcgatcccacctgtaacgtggcggatgtggtgaaaggtaaggagaccgttgtaatggtatcgatcgtagttcaaattggattgtggtttattggaggcagcttggctatagggttattttgcagtgcagtctgctgattcatcaggtcactctgggcccaagccactggatccagatgaaatgttctttctaggcagttcaggtaggcagttctttctaggcagttcagcataattggtaaggctcaaaatgtgagtttctactttattgattagagtttcatttgtagttctgtctcaaacagtaaacatttaagtaagattctgattgccactgttatctgaaaatttcagagaatccaaattcttatcataaaattaggttgaattcacgtgtctataaaatttaaacatatttctgttgttcacatctggctttagaatttatgtggcatgtaagcttcatgggttcattggactttaagctagacattgttccagtatcctccgggaagaaccaagccctatatccgtaagtccctggtacccaggcactttgaatttgaacagcagtttcctcattatttattcatttaagatcaatgctatctccaagaaaccttcctggttgtgagcgatccaccaggtacctcttcagttttcttcattgttacggttactttgtgcaacctcagatccccaaattgtccctttctgcagattgtatctcctgtgttggcctttatctcccttctttaaacgctcacctcccaagtttcatggctgcaattctctctgatcttcatcaaggatcttcattgctcttcagcagccatagcaaaggaaaacctctgtaatttgtttaccctgggcattcctaaacccagggaggaggaccagacctgttggttttagcttagcctaggattgtctggctgccctggcctctgttgagtcacaacagatttactcacattatttcagttgtaaggtgaatcagcccagcctcagctctaggaatcctattggttgctctctcacaagataactttgtggttgatcagaacctccaaaggcctccgggggcaaggaggaaagggtcagtcttatcatagcttacatgttcattaggccttagctcagtgccttttatgaaacagaaaacttggttcagacagttgattacccctttgagaaaaaggcacaatttagaaagcaaaagtgcattgtgatatatggtatgtgtgcattttctcttgaactgtaaccaatttgaggtcagggtttgtgtcttatatttgttttataacttgcatagaaccaactgtagtgcttgtgtaggtgattaataaatattccttggtttgatacattttaaatcttttgagaatatacttttaaaaacagctttattgagatacaatctcatatgataaacttcaaccatttaaaatgctcaattcagtgttttttagtgtattcacagagttgtgcaaccatcaccacaatccagttgtagaacattttgtttttttctttctttttttttttttttttttttttttttgagacagagtctcgctctgtcgcccaggctggagtgcagtggtacgatctcagctcaccgcaagctctgtccttcgagttcaagtgattctcctgcctcagcctcctgagtagctgggactacaggcgcatgccaccacgcccagctaatttttgtatttttaatagagacggggtttcaccatgttggccaggatggtctcgaactcctgaccttgtgatccacctgccttggcctcccaaagtgctgggattacaggcgtgagctaccacacctggcctgtagaacattttcatcactccagaaagaaaccctggacctgttagcagtcactcccttctacccttctctttagccctagacaaccactaatctactttctgactctgtatagattttcctattatagacatttcatataaacaaaacaatacaatatgtggtctttggtaactggcttctttcactcagcataacattttcaagggtcattgatgtcatagcatctttcagtactttattcctttttatggctgaaaaatattccattgtatgaatataacacattttatttttctcttcatgttagttgggtgatctcagacttgattaagtaacctctttggggctcagattcttcatctgtaaaatgatgctcttggtaattcacctatattgtagagttaaatgagttcatatttgtagaacccctaaagcaatgctagtacacagtaaaggctgtagacaggtttactagcagcagacagtccttgggtgtcagacatgtcatttggcttcccatgtacgccattgattatataataggttggtgcctttattttgtttctggcataaattataaaatattttttaaagtcatttcaggcttttataagacaattggaaatttgaacactggatatttgacattaaaaatatgttaactttttaggtgtgatattggtatctggtcttgtttttataaaggagtgctagctttgagagaggtatttaaaaatatttacacatgatatgaaatgatgtgagatttgcttcaaaattatacacagggaggggagtgaaaaggactgggcatttgttgaaaattcttgaggctgttgatgggcacatgggctcattatactatgctctgtacttgggtatgtgtttggaattcttcacggtaaatgtatgagtctgttctcatgttgctataaagaactacctgaaactgggtaatttatgaagaaaagaggtttgattgactcacagttctgcaggctgtacaagaggcatggcttgggagtcctcaggaaacttacaatcatggcagaagggtgaaggggaagtaagcacgtcttcacttgatggcaggagagagacagcgaaggggaatgtgctacagacttttaaacaaccagatctcgtgggaactcactatcatgagaacagcaaggggaaaatctgcccccatgatccaatcacctcccacaaggccccaccgccaacactcaggatcactattcaacatgagatttgggtgagggtgcagagccaaaccgtatcaatgaagttttaaaaacacttgttttcatcatcttattgtttctgcacaaataaagtctttcactaatttttagggagcttttaaccaagaaccagtacaactagataagtagcagggagttttatgaaactgttaccacttctatagaacagagcgattaagtggtgctaaagtgagtcagaggtgtcagagtgtgaggaggaatcgactgtgatttgactcttaatgtgaacagaatcgatcgttttatggcacttactgtctgtgttactcttctctcatatttagtacatattacctggccttgtcattatttgtactttcttttttttttggagatggagtctcgctctgtcgtccaggctggagtgcaatggcgtgatctcggctcactgcaacctctgcctcctgggttcaagcaattctcctgcctcagcctcccaaatagctgggattacaggcacccaccatcatgcccggctaatttttgtatttttgtagagatgaggccatttgaccagatgttggccatgctggtcttgaactcctgacctcaggtgatccgcccgccttggcctcccaaagtgctgggattacaggcatgagccaccatccccagcctatttgtctctctctatctagggtgtcaatttctaaaggtctggaattattcttatacgcttttgcatcactcctcttagggtcagaagttttgtaccaaaaagtagctgaaggttatatgaagaatagttcaatacataattgaaagaaaaaaccctggaagtttatgccaatgtctacctcatagcttcctctttgctttgtcccttttagacacagttttgaccctgagccacagtcccctcctttttcttccctcttcttgtactcacagctttatctttagtctttctcctgcgcttattaactatattatacccattattgcactgtgaacaaagtttactgcttcccttacttaatcattcctgccactcacttagcataattaaagcttggagttcctggtgaagccctatacaataacagtcacttcttgtgcccttttgtgactcaaaatccctcttcccccaacacacacatacacatacacatgcacacacacacgcatggacatgtacacacatacaaatcccacctccacactcatggggtaagcaggaaggactggcatgctccccattccccacgcctctctcaaaccatggtttttcatctctcaacagcatcctcccttaaggaaaaaaacagtggaggtggtttcagattccgaaagtgtataaccctctaaagcagcagccacataatcaactttctgacatccttcattcccttcataaacgatgcataccgatacccacagcacactaaatactcttggcttatgtgtgttttctggaatgcttttgtacttctgcttccacctggtgaggtgcatgcttactaagggtcacttatttgtacccaagcccttggtgtaagttatactgactgttgtgactatataatttatttaaatgttatgtaaactgaagaaatatgcatacaagaaagagacttatttctgttaaaaccaagttgaatgctttggaaggactcttaaaaatgttatgaaattactgtgagtaagaaaacgattagattacagggcagcacggagtaaaaatcttacctggaatttatacccaggttgcttcacaagtatctttaagtttattatactttaaagaaataggaattggaattcatagatgtaagtgatattgttcatccaagaaagacgaactggaaccccaaactgatccacattcaaaggaaaggccttatatgaatatactgacagataaataaattgtatgttcaaatgtgcattttaagttaatgtttacgatagtaatcacattttacggtttcccactttacccaacatttttgttaatcatccaactccttttcccagttgggatagttaagaagactaatgccattttcccaaaataataaaagtgctcatcgaagaaagtttagaaaatatgggaaaagagagaagagaataaaaattacctgttttcataatttagtgagaacgttgttttatacatttgaactcatatcagatttatagataggtgtgtagctgcaaatattgtgtctaatctttgtctccgtgaaatccatagtatttttgaatttctctatctccagcactaatgcccatcacacacacccttcctggctgaatttgataccccatggtagaagcctctatcctgctgtctgcgtcagtattttggagttcttcctgtgtctaatctgtgatactcattatctgtatatttaaatggtctttccagccaagtgtgcataacctttattctgcagtgggggattggccttacatcagttactttttctaccctggcaaatgggctaggcaacctagaaggaaacctgcaggcctctcttttccttgtagaccaaagcagatgtctccagtcgactgtctgcttcatttcctatggaccctcctcttaattttttgagcatcaaatgcttatgcagaagctctttctacctccaagtaagactgagagagaataaagaaggcacagagcgccaaaggttgaaaggcctgaaatttcttctgtgtcttctagctaaaaggcactggagtctccatccccaaatgccccaggagcaaccatcagaaggtctcaagaggcccaggcctcaccagctcttcttaccaatccctgccaagtgttgccaaggaagggaagaaatggatgtcagcctcttttgactcttagtgaagtcttactgttgccttcctctttttagagtagttggtattttcaccctggctttgtaccttcttccactatcctctgagatttcttagttaatcttctaactcagaatctctatagctaatcttttatttccttccttttgttttaagcagttggatgttacgagagtaagggctccaggttttaatgacagccctactaatgattttcttagctgtgagaatcctacatggtttaagcatagtcagatgtccagcccaaatgaccctgtgtgggcgtctgtgtgtgagcctctttgtgtgcacacatgtgtgttttataggtttaataagtgttggctaggtgcagtgacacacacctgtaatcccaacactttgggaggccaaggcgggtggatcacctgaggtcaggagttcgagaccagcctggccaacatggtgaaaccccatctctactaaaaatacaaaagttagacgggcatggtggcaggcacctgtaatcccagctactcaggaggctgaggcaggagaatcgcttgaacccaggagacggaggttgcagtgagctgagattgcgccattacactccagcctgggcaacaagagtgaagctccatctcaaaaaaaaaaaaaaaaccacacaaacaacaacaacaaaacaagtgttaagcccactcccatccttagatctcttgagacagattacagaaaactcccatgtagaagagtagagacaatatttttatttttgactagacagttgtatcaacatataaaagtggggtgcatcttgtgtagcattaattgaatgtgcagaacactgaaacatgcctccttgctgcttatttagcaccttagtatctacctttacacatctacaaattatagaccccaggtagtgaatgctagaattagtgttgtaaagcaggtcctattatcctttgggaggtgccttccactgtgacccttttccctcctttctttgtaagaagctaggaaataaaatggaaaatcctgctgtaagatcattttgaaagtataaacttaaatacttggtgtaaaaatcgattctcacagcgatgctaagttgcctgtgttgttcttacatgctattactgcttaatataatagcacacaagtggtatcctcagagcgcgtggcattattctggttcagaaataatgtcttgtgctctcactttgggctcttcaggttacaagtaacagagacccactcacgctagctcaagaaagatttatcaaaagaacctggtaggtcccatgataatccaaggacaggaagcactttatagttggagctatagaaattggaattatcagcctggccaacatggtgaaaccccatctctgctaaaaatgcaaaaatcagccaggtgtgatggcgtgtgcctgtgatcccagcaactcgggaggctgagacaggagaatcgcttcaacatgggaggcagaggctgcagtgagctgagattgcaccactgcactccagccttggtgacagagtgagactccatcagaaaaaaaaaagaaattggaattaggaaacagaaaacaaggttgttttctgtgtgtctttgcagctggagttgccaagtcatggcctttccgcctttctctgtgcctgctcctttacctgtttttgtctgtgtactggacgactcagtggcagcttgttgggcactctagtccttcacagatcatgataattttcaatgtaccattttggcttctgccctgcctgatcaccccaactgtcttgatcctaaattctcaaaagatgcatttaattaactcagcttatctttttttgcccacgatcttgattctgaattcccaaaagatgaatttaattaactcagcttatctttttttttctttccccctacgatcacaagttttaggattctgatcaatctggagattggatattctgctcccactcccacttgcccagtctgctgtggtttggagcgtgaggtgtgggggcctactcctttaaaaaatctccattggatcccacttgggatgggtttggggtaggaaggatgatgatagacatgccttattagaattgctttgagacttgaaagggttcctaaaaggcagcatatcaattccagaaggtggggtgcgggccagtgttgtctctgtgggttctaccatggtgcactgtggccagggccaaaaagtgcagaaggtgaatatagcccatcaaccttaccttcatcttcagatacttgcaaaatagatctcggattcaggtatggctctatgagcaagtgaatatgctgatagagggccgtgtcattggttttgacgagtctgtgaacctcatatcagatgatgcagaagcgattcattgtgaaacaaagccaagaaaacccctgggccagatcgtgctaaaggagatcatattctgccacaaaatgtctctaaccagaaatgatcaaggaagtgagacactattgagaacttgtttttttaggtgtcatttgttgggagtatagttctaaaatgcctgttcagattgtttccattatctgtatatattattaccagatgacagtaaatgctgtgggattgtttttattaaaaaataaaataaaaacaattaaaaacagcccatcagcacttttctaatgttttctggtcatttacatttacctttttgtgacactggcttcttaaacttcagctttatgattttctgtattctgttagactcaaagttagggaccttggcaccttccttttaattttttcagcactcactcaaattcatcctagtccagcctctcatattttttgtctcaaatgattgcatgcattcaagatagaggctaatatttgatagcagagttctgtggtgaattttgaataggaaaatctgatgaaacaacctccattatctgttcaattttcctgtgtgctatttcttaaaacggattcatggctagtttggttctgttgggctgattgctgtgtgaaccttcaccctgttctcagccttttaaaattttagtctaatgcatttacagtttagatattttaacctggggaagtatgtatgagccacacctgcagttttgttaattactttataatcagtaccttaaaacccttgaaaacagattcctaaaagaaggcatgtcacttatattcagtggcaataataattctctaatattttcttctaaagattgatggtaaatattggccccagtatgcacataaaagtaatttggcagttatcttttttgaaattttgatttctaatttaaaaaatagaaaagtttgattagaaagcttattataagtagaatttgcattttactctaaatgtaaattacaagccatgagttgaattttggttttgatggcgattttttaaagctttttcatttttatgttaaattattttacttaaacagaaatgtcctgtttgagtatataagtgctgttaccccagaacctcataatcattcatatcctgggagagatgagtggcagaattagcgtgactcagacttgattttccagggaagtggcctagcttctcttccgaattacctgctaagttttaagaatgtggactctcaggcctcaacatagagctactgcctcggaatttccaggggttcctttcataatctgtactctttcttttaaatttggtaacgaatcccacacacagctagattggggaatgagtctaggcctctagttcccagtctcaccaaaaggaacacctcccgtcagtgtaatttactgcatgttgagaacttaatcatgggtcagaggatcgttccatttaacaaatgctaagtgtgtattgtgtccaaggcattgcaacatgcattgtgtccaaggaatttacaaagatgcatagtatatatgtaataccattaatgccctcaaaatacttttggctagctggtgtatgtgagtctacattgtgatgacttgagttcttcaaggatcatcatgcaattcttaattataacgttgatacactgtaagttgtagtgatgctttaaaaattcttattcgcacgtggttttaggagctgtactgggtctttgtgtttcgagttggctgcttctgtctaggcttggtctttcacatgttaaatttgtgtagcacattttcttaacaacgctgtcataatcatgctactgggcaagcgaattccatgaggaattagcacatttagtgggtttaggttatttttgttttgtagtgaatggaagagcactgtttaaacatctttattacatacctggaggagttgttttgtgaagatgtgttggctttgtgtatcgataatgaatgatcgtttttaggtttcagtgcttgtgatcttggaagtttgtgttcagctttgtgctttcacgtcactaggtggagatgtagcattgtttggcggcataggctaagcaagaggagtgagtcttgatttctcttcttttgacaaaagtactttacagatatttgataaggtttattatagcctaggaaaacacttgtaaatttagtacaattcaaaatttttaacttttttttcaggattgaagttcaatcctacttaagtgtctattttcatactgatcaactcttttaaacattttttttctcctcttactgctgtttcctttttgctgtccctcattatttcaccttgtctgagttattttaatgtctctatctttggttctttatagagatttaattctaaaagtttagtaaaggaatcagaattcttactctgaggtcaaataatagataattaatttggtagcaatatgaagtcaatgaactaaaatttatagtctgaacataccctaatcttatctttgtattattttaggttaataatgtcaatttttaacattaacattctgtagggcttacttttccccctttgcttccttccttctttctctcacctcttgaatattaaacaagcacagtatttactttgcacggtattgatgtggggaatataaaggaaataagagcctgtcttcaaagagctgataatcctgttgagaacattccaaatgcgcccacgaagcagcagttttctactcctaggtatatacccaagataaatgaaggcatatgttcacacaaacatttggacataaaggttcatagcagcactattcataatagccaaaaagtggaaacaacccagatgtctaccagctgatgaacggataaagaaaatatggtatacttgtacaatggaatgtgatatagcaataaaaagaaatgagatcctgatacatgctgtgatgtagatgatgcttgaaaacatgctggtgaaagaagccagtcacagaagaccgcatattattccgtttatgtaaaaagtccagaatagcaaatctatagagataaagtagatccatggttgcctagggctgggtggaggggagtaactgctaatgggttcggaacttctttttgtagtgatgaatatgtaaacttgattatagtgattaatgcacagctctgactatatactaaaaaccactgagttgtatgtactttttttttttttttgagatggagtcttgctcttttgcccaggctggagtgcagtggtgtgatctcagctcactgcaacctctgcctcctgggtccaagcgattctcctgcctcaacctcccaagtagctgggactacaggcacccgccaccatgcctggctaatttttgtatttttagtagagaaggggtgtcaccatgttggctaggctggtcttgaactcctgacctcaagtgatccccctgcctcggcctcccaaagtgctgggattacaggtgtgagccactgtgcccagctgtgtgtacactttactttcaatgagtgaattgtatggcataagaattatctccaataaagatttttaaaaagtaaattaccaaaaggtttaaaatttatcaaactaaggttgttttttgtttgtttgtttttgtttttgttttttgagatggagtctcactctgtcccccaggctggagtgcagtggcacgatctcggctcactgcaacctccacctcctgggttcaagcaattctcctgcctcagcctcccaactagctgggattacagacgctcaccaccatgcctggctaatttttgtatttttagtagagatggagtttcaccatgttggcctggctggtcttgaactcctggcctcaagtgatcagcccacctcggcctcccaaagtcctgggtttacaggcgtgagccactgcacccggctcaaggactgtttgttgaccatctacacaggcactatacgaagttctatgcaagttatgaaacaagtgttaagacacaaacgctgacttcagattgtttacagttcgagagaaaaggcatatatgcaatgtccaatgtcttgtaatgcacctttgctttctgaatctgctccccatctttgaatctcctgaattctgtcttccggctgtttctgtaatggctcttatcttcttaccatatgtcttttattttatcctttaaaaagcggactgttgctcctcagactttgataaatatcagccccagcctgttacctttaactaactcaaaggaccttttaaagtgatagtggcatctccagtaacttaaattgtgtggctcatggaaatctattcattcagcaaatacttactgaggtttcacttacaaataactctggcaaatcacaagactgttggcattattatttttaagatcatgacaaatattcttttgctacaatttagtcaggttgcatggtgcttagaacgtatagtcttgagttcctaaattttcatgaaaaatatattttggtaatagtataagttaaacaagtacgtgtttggtatagagctagctgaattgccagtattctagtatgttgacattgttatggtcattaaaactttgagaaaagaaagccaggcacggtggctcatgcctgtaatcccagcacttttgggaggccaaagagggtggatcacctgaggtcaggagttcgagaccagcctggccaacataatgaaacctcatctctactaaaaatacaaaaattagctgggcgtggtggcacacacctgtaatcccagctactcgggaggctgaggcaggagaatcgcttgaacctgggaggcggaggttgcagtgagccgagatgacaccactgcactccagcctgggtgacagagtgagactctgtctcaaaaaacaaacaaacgaacaaacaaacagaaaatcctttaagaaaagagagattggctgggcatggtggcatatgcctgtaaggccagctacttggaaggctgaggcgggaggactgcttgagcccaggagttcgaggctgcaatgagctatgatcacaccactgtactctagcctaggcgatagagtgagacgctgtcttggaaaaaatagaaaagagaaattttgcattagtcatggtaattctattaaagccacaaaagggtattttgtaaaaggttgtagttgattaattctacatccatccgtttagacagtttatcttatgtacctatagatatatacatgcacatgtgcacacacacacacacacacacacacacacacacacacacgcttgtgcctatgttattagtacagcagctaaactttttccttttcttgcagatgcatatgaaacagccaagatgctgtgtgaacagtattacctggtagctccagagctggaagttgaagaattcaatggtaaaagaaaactaattttaaccttacattcaaaaaagctgactaagaagctgtttatacctaagccatatttcagtgagctccaaaaattatactgatttttcattttcttatatctttttaaaactttctacgcttttggtcaaccagatatattattgtaaggagtttttgtacaggaatgtgtaatgtgttagaccccagaattcttggaacagaaataatcaaggtagagtatgtagaaaggtataaataggcccttctcaaagtaacaaatgcaagcagtcgatcaacatatggaaaagtgtttaacttcactaatcaaggaagtgcaaacaaaaacacagacaaatgcctttttttttttttttttttttgagaaggagtctcgttctgttgcccgggttggagtacagtggtgtgatcccagctcactgcagcctctgccttccaggttcaagtgattctcctgtctcagcctcctgagtagctgggattacaggtgccccccaccatgcccagctaatttttgtatttttagtagagacgaggtttcaccatgttggccaggctggtttcgaactcatgacctcaggtgatccacccgcctcagcctcccaaagtgctgggattacaggcgtgagccaccgtgcccagccaaaaatgccatttttgtctttcaaaatgacagtgattaaaacattttaatgctttgaatttgtgcccataaaaatactttctcaccagcacatacatttcttgtataagctaaaagtggtattccctttctaaaaaatgccagcaatgttctttctatttggcccagtaaataagttaataatggtcatattctttggtccagtaaattaaacttcagaacacttattataagaaaatagaggctggacacagtggttcacacctgtaatcccaatactttgggaggccaaagtgggtggatctcttgagtccaggagtttaagaccaacccgagtgacatggcgaaaccccatctctacaaaaaatacaaaaattagccaggcgtggtggcacttgcttgtattctcagctacttgggagactgaggcaggagaatcacttgaacccgggaggcggaggttgcagtgagccgagatagtgccactgcactccaccctgggcaatagtttgaaaccccatctcaaaaaacaaacaaaaatctatgaaaatagagatgcacagatttatgtacaagattgatgatcacagtagttttcttataaagttagaaaacaacccaaattttccacaatagagcattgtttaactgaattgtggtacacccattagatagaatactatgcagccctttgaaataatgctttaaacgaataacgtatgggaaaaattgagatttttaaaaaaatacaggctacaaaagtttatagtagtggagttcattggaaaatattttgaaggatttatactaccaaaatacaaatagcagctctctgggtaatggggttacagatgatttttacgttcatcatatgattacatatttatttgcacattcctttttttatttgcaaattatggaagagacatgcttatcacaaaaatacagatacagaaatgtgactgaaaagggaaatcccccacaactttctcagtcccatatagagctttggtttttgcataaagcatgtatagctttaaccctatttataacgtggttttcacttcaccttgaagacctttgcaagtattaatctcatttagagattatccatagtgtaacttaccataatttatttaactgttttcctatgggtatacatttaggatttcctgttttcctatattccatataatgagctatgaaagagtgtgagaggtggggagggtggaaaaatttgtgaacgtatggaagtatttctgcaggttggattcctagatgtggaatgactgagcagggtgtgagcatttacagttaaagataaaccaggccaggcatggtggctcacacctgtaatcccagcactttgggaggctgaggcaggagaatctcttgagcccaggagttcgagaccagcctgggcaaggtagcaaaaccttgtctctacacaaaatagaaaaattagctggacatagtggcatgtgcctgtaatctcagctactcaggaggctgaagtgggaggatcgcttgagcccaggaggtagaggctgcagtgagccgagatcacatgactgcactccagcctgggtgacagagcaagactctgtctcaaaaaaaaaaaaaaaaaaaaagataaaccaaattccccctcaggagtacactaaaaatgtatttctcttataatgagataaaactgtgaaaggagttcaggctgctgttgaaggacatggcccctccatttgactagaaggcatggagtcaaagctgctttcaaggtctcttgggttctctgagaagagtcatgtccccattgaataaatatactaccaggaccgagtgggcttgtctggagtgttcctgatgagaaccatcttaatattctttctctctcttcctatggactaggcaggagctgatctcacatctgcaggtagtaacaaattgctcttttgcgtgagtggcagcctccctcattctaaaggccaaagcagcaggcctgttcttgctgattcccaagtgccagccatgtcagcacattctgtccccgctgaggctgtcatgctgggcagctcacccaccaggagaggagctttccgactctttttggcattgtctcacgaattacagaagccccctttcgatcatgttttgaagccccttgtcctatcactaagataaatgaatgctggtgtttctaggtagcttctagctttatgttgctttgggtagtgtagtgattatttttatgtataagttcttaatgctagagctctcttgtgagcatgattaaggaatgtgctttcgccttaacaagttctatgttggagatgcaggttggaggttgatcctgaacaccttaagtggatgcttttttattctggaaggagaactgtctggaaataaaattccttatatctaatggtatttcttaaatgctgtttcaactaatggcatttggagcaatgactgtacaaaatagagacttcattatttctgaagtcttgagcatgacaaacctaggccatttttaaattgacttttaaaaatgtacccttagatggaaaattcatattctacttattttataagtcagcaaacatctattaagcatctgctacttaacagccagcctcgagacccagaactaggaaagagtcatggacaaaagcatttgacatggttttaaaaggaaggaaagaaatctaaactgtaatgttcccaaagaaaagtgcaggtaattgagcaagcctttagatggctcctagagaatgttgtttaaactgaaaaaataaaaataaaaaaacccactatataaaaggtgtttgccttttcttgagatttggggtgaaaaggttgaattcataaggctgtttatataactaatcatgccatttggtacaagataaactgagcacccagcttgttcctcgagccccattaaaatgacaataaaggagccaggcgcaatggctcacacctgtaatcccagcactttgggaggccgaggtgggcggatcacttgaggtcaggagttcgagaccagcctggccaacatggtgaaaccctgtgtctactaaaaatacaaaaattagctgggcatgatggcatgtttctttagtcccagctactagggaggctgaggcaagataattgcttgaacctgggaggcggaggttgcagtgagctgaaattgcgccactgcactccagcctgggcgacagagcaagactccatctcaaaaaaaaaaaagaggggaaaaaaagaaataaaaataaaatgacgataaaggaatccaaagaaaagcagcaaaggaaagcagaggagctcattagtggaccagtgccttagtccatttaggctgctataacaaaaataccagagaccaagtggcttcagcaaccatttctcatggttctggaggctgggacatccaagatcatggttcctggagatttggtgtctagtgaggacccaccttctgattcatagctggcttctcactgtttccttccatgggggaaggagcgagggagctctctggagtttctttaaacgggcattaatcccatccataagggctctgccctcataacctaatcacctctcacaggccccatctcctaataccatcacatcaagggttacatttcaacataggaatttgggggagacacacacaaacattccgtccataagaggcatgaatcccaacttttgaaagagggtcactagatggaagtatgctgattggtgggacagagcagaagcagccacaggggaggaggctgcagcagaggtggcaactggtttgccgaagattgtcctggagggactctgggggcagggccaggtggtgcaatggactggaatgggaagggaaggcagagggtagggttaactgaaagctggtctaagaaagagcatggagggatgacgggaggcagctgtactctggccgggttcagcctgccaacaggcaactaagtattttgttcgagaacaacctaggaagaattagggcttttcatgtgagtgttgttaccctgcagcaaagccctgttcgtttaagcatttgggggcctctctgctcagaggcccatttactacctgctcatcctcaagccaagttgaaaagtcttgaccagtccagagagctctaagtcaggcttcccacttaatggagagccccagggggatatgaacgccagctccctcatacagtgaatccggttcttcattctcaaacaagaatattgcaaccaagatggatcagaccttcagcaaaagccagcagcaagaaccaaacctaactggcattaaacttatcagctctactgttactgccagaaaccccccttttgaaattctgagagaaaatcatttcaaacctagaattctctatctagccaaacctttaatcaaatagatcagaggtgtaaagattgacagatgtgtctcccatgcatccctttctgaggtaggttacctgactgccttgatgttatgtataatatgcatctaagaaaggggaaaacattctagaacttcaatcaaaaacaactttaggatgatggctatgcagcatgtttgcaaagcaattgattctaatttgaaaaatcttgaagaatggactggataccatgcagtaggtatggaagctggaagtaggtatggaagctggaagtaggtatggaaactggaagtaggtatggaagcttccagtaagctggaagatcttagcgaaatggcatggaccaactatgaagcaacccaaaaagggtagcatgatgttgaccagttggaggagtataaagaaactccatttcatgttaaggctgggaacattctcctccaagggacacatgaatcattgttattgcattaatagggaagaaaatgtctaggtacactgttgtggttgttctacagtgatcaatatttacatagttataatgtcaccaacacttgattttctactttcttgaaagaacctataggcaatttacagcatccctaatttgggttacagaacagaatgtaaatattaccaacccaaagactacagcagaagtagtaaagagtggctgcctctgggttcagactgaaggataagataggaaagggggaaggacttttgtttttcttcttttgttaaatttttaagccgtttacatatattactaagtgattttaaaaacaactgctcaggccaggcacggtggctcacgcctgcaatcccagcactttgggaggccgaggtgggcaaacacctgaggtcgggagttcgagaccagcctgtccaacatggcaaaaccccgtctctactaaaaatacaaaaattagccaggagtggcggcgcacacctgtaatcccagacactcaggaggccgaggcaggagaatcgcttgaacccgggaggtggaggttgcagtgagccgagatggcgccactgcactccagcctgggcaacagagtgagactctgtctcaaaaaataaataaataaaaataaaaataattgctctttgaagagttcgggatttagactcaaaagctctttgttcaggtgtctggtttcggtgccacttctgggaccacgggcaagtcacacaggcttcccaaagcctgtttccagacctctaaacaccaccacccctctaggagccaggaagtgttgtcaggaggagtcaattgaataatgtatgtgaaagctctgtgtagactgctaagaatcaagcaaatgtgaactctaatttgtattactgttaattactttattagaggaagtagctggttgaaattacagcattctacctgagagagttcatgtagtttcaatctcttaagtgattttgggtcatgaggaggaggaaggactgtatttttgagcatctgctctgtaccgcacactgttcttattgcttcacctgggttttggtgtttctcagattgtcttcagatgacccatggtgcaaggggaaaagatcataggtctctaggggtttatgtgctagctgcttgagaaaaagttatgtgaaccttacattctatgctataagatgccttgtttgtcataatttaacaaaactgaacactgccatttagtccagttcaccagcccttttttttcctgttgctccacattctcccgtggaattccccctggggtcagtggcagaaggtagcccccaatttgaaaaacaccaagtgatatctgactggccttctgtaatactcaggatgttatggcataggtgataatattccaattctgctcaacaaagtttcaaagagattgagtgatttatccaaggtcacatagctggtaagtgaaggaactgggtgtcaccccaggtttgtttgattctaaagcatatgcttttgctcagccctgcctttagaggtggaaactcaaattagccttttatagagctctgttttacacacttggaaaatagaatgcaaacatcattcttgaatttctcctactttgggtccttattgattgatggttttgtctctgttttcagccaaagcgccagacaaacctattcaggtggtttatgtgccctcacatctgtttcatatgctatttgagttgttcaaggtaagtggaattttaaaaacgtggaaagaagtcttcattttaaattactttgattcagggcataatggattcattagattagcataagaaaaaggttttgcataaccattttaaaaattctatttctgatatcctgtgggttttataatttgtacactgtgagatgagaaattgctgtgtacactatagtttttgtgaatattagtacatattgattttgaagcttaattgcactttagtgattttatgtaaaatccatactgttttttctttagttatgagattagagatgctttttagtttccaaacctggcaaaggctttactggtgatagccagatcaaaataaaaacatgtttatacatatttatgcttctgaaaattaaccacactggtacattagtggttgttccagtcctgagagatcctgcaactcttttataaaatatttgaatcaattcagaagatccaagagaggcagaggagaaagatgtagatgagctggaccaaaagaaccacccctcccccccaccaaattctttagagtctgcaacttaagctgttgcttttgttaatcagtagctaatgacatttacagtagcagtattacaggcacaaggcatttgagctaaaatttcatttcttccaatgcgtgaaacactaaattgaacacctgaaaaatcagttatgctgatttgcttccaaaaattagaatgttactgatgtaacgctttaaggttgaaatgggcattcaattgtgaactttctcttcagcagctgtggctttttcagaatttctttttaaccaatatttcttctacttttttcagccaaatgattaatttttgtgggaagcatgcatcctttcagtttttctgccttctttagagaaaaggtgctctataaatgcagactgataaataggatttaaagtgcacaaatcagcctctgcatagcctcattacatgcgataaaaacattcctctgggttgagttgaataatttaaataccgtaaagcgaaaaaaaaaaaaaaagaggaagaagaagaaggaaagaaaaataaatatttagcatgttggatgaggctaaaactaggtgaaaaacaaagtgtcaggaaatttttccttgatttgagcacgtttagctaagctctttagagggaaaaatgccataaaaatccaactaatatttgccccaaaaaagggttgttgggtataagtcatcttgcgcttctttctctttaaaaattgtggtttgtgattcggcagtatgattaataaaaagatcttattattttagaactcaatgagagcgacagttgaactctatgaagacagaaaagagggctaccctgctgttaaaaccctcgttactttgggtaaagaagacttatccattaaggtaactgttttatgtgcatgtatactttaattatcagttgtgatttaatagtatctagacattgaaaaatcagagggaaggaaattgacatttattgagtgtcctgtttgtaagttctatgctagatccttggcttaagttaccttatttaaacttcattagaaccttgttattcagggagttgaacaagacctcaacaccaagcctgttggatcccactgtaccattcggcctcctttgttttacactgttcacaaaggaaccgtatgtcactgggggattcaaagtccttgtacattgtggagtaatctgctatgtactttatttaatgaacccattgcctcctactaagtatagatcaacttctttgttttgattgttaacattttgaacattgcagatcagtgacctaggtggtggtgtcccacttcgaaaaatagatcgtctttttaactacatgtattctactgctcctagacccagcctggagcctaccagagctgcccctttggtaagcatctgaaagtgctgctgaaggaaagatcataaacacaggaaggggctcagagggagctgcctctctccccaggttgtcacattagtgtagttgatttagaaggttgcgtgtattatggtttggaggagggagaattttttgccttggctacttgctttgtgaatcctttggacttcaatttcctctctgatttgtgtctaagaaacactcctagctgagtgcctcattcccatatacagagaaaaagtacctcattgtggtaagactgctactgtagcaccattttccactttgtgctacccttggaaggggtggaagttgccagtgggtgagcaaagggacagtactgaatgcatagctgccgcttggtcctgcgcactctggcgtgcgtaccacagaggcgcgaatcacctagtgccttggaatctccactgtcaaatttgtttatataattaaaatgttaaattatgaaaacattaaatttttatgttaaataacattagcatgaaacatataggtggtgtatgcattttcagagccctttctgtctcactctggaaataaccttcagccctgttaaggcagtgagaaaagccactggttaccatggtagcatttagatcctggtagggccacacttgcttcccctgctgagtgtttctaattgacaaacaacaattgaaccctttgtcattaaacacagcaacatatctatcagtctgcaaaatggttcagggtataaattaagtttcattttaaagtcgtacctgactgataagcacataagattatattttatttgtatgaataaaatcaaacactttgcatcatttatttgagacagagtttgttaactcagcatgttggaaacaggaaatcatttatataggagtcgagaaaattcatgaaagatcacatttgagaggcgttgccttgactaggctctggcatgcacttaaatacacatcaaaaggaaaaaaggcaccacaaacaaatctagcaccttccccagttgtttaaaagaaatatagattgtctcttccaggtcttaaaatagcatcttgaggatagctgttatatcataggttttttttcttattgaaactgagggcttgtaagagacttttaacagttaacgcatgcgcactcccattgtatagatgaggaaatgaggaaatgaccttgtccaaagtcattgaactaattaactgcagagctggtgctggccatgtctgtgttctttccagtgtactacgtggccgaagaaatgcttctgctagtggctctcccagttaggaaactggcctgtaatcctagcactttgggaggccaaggcgggtggatcacttaaggtcaggagttcgagaccagcctggccaacatggtgaaaccctgtctctactaaaaatacacgaaaatagtcgggagcagtggcgcatgcttgtaatcccagctattcaggaggctgaggcacaagaatggcttgaacctgggaggtggagattgcagtgagcctatatcatgccactgcactccagcctgggcgacagagcgaggctctgcctcaaaaaaaaaaaaaaaaagaaaagaaaaagaaactgtcctcagctttaaagtgggcacatggatatgtactactagaaaacataatttcctcattgagcaacttacacttttacaccttttacacctctgtgcctttacatgtgcatttctgtttgagaatatccacccagcgaactcctgctgatcctttgacactctgggaaacctttcctgaacctcagcaaatccgaggtccagacccctcctctgcattctttgggagtctgggcttacactcacatctgcattggcctcggagttctcggctcttctgtgttggacatgagggcaggctctgggccttgcttgaacatagaaggcagatttgctcacatctcttcctagagtgagctagtttctttgctgtggttacctgagtcactactataaatatctcatcttcactactggccatattcagcaagtcccaaagcccttaaataatggggtacgttcttttaccccctgccctttcagttaaaccctaccctgagggaaggtatcaaggagagatgttagaaaatggcagaaatctgtgtaacttcataaaattgctgctcctagtagccatagtaccagcctcaatttatttagttttactgtgttaggcactgtgccaagattttatacttgttatattatttaatccttatagcagctctgaggtcagttttttatcatatgttcagatgaaaacatggtctcaaagaggttgagtaaactgctcagagtcgcacagaaagtggatttcaactgggtctgtctgagtctaaggcccatgtgactctgtgcacatggtcccctgccctccttccttaaccttgttcatagatttaaccagaagtgaggaagcttggtgttacatctccttccccaccctgccccactaccaccacaaatggtattacatttagttttgattcttactgttcttgtccatagaacacctgttattgacagtcaggattccttgacatagagatataggagggtactgaaaatttttttaatctctaaaaatacctgaactacaatataccaaaatattctcacattcccggaaccttagtagttgcctctcagaaaattgttttcctttccatgttctcgtcttgttactggtagatttgtactcagcactgcgctattgattttcacttgcaaaagcaaggaaatctgatcatgggactttgaaatgatgtggtttagttttgtcatcaggtcacattccacttgatttggaatgtgcttttgtgtgtgtgtgtgtgtgtgtgtgtgtgtgtgtggagatggagtcttgctctgtcgcccaggctggagtgcagtggcgccatctcagctcactgcaacctccacctcctgggttcaggcgattctcctgcctcagcctcctgagtagctgggactacagtctcccaccacctcgcccagctaatttttgtagtagagatggggtttcgccatgttggccaggctgatcatgaattcctgacctcaagtgatccacctgcctcagcctcccaaagtgctgggattacaggcgtgagccactgtgcccggccttggaatgtgcttttaaaaaaatgataaaattttgctttaaaatgctaaaaaagcattagtcaaaaattagaatatttctattattatccaaacatataagacatgtttttgcagggtgaaaataaaggggttgtttgccatagaagaggatatacatcattgtaaaggttgagtcagtaatttatttgatttaaatctgaatcaagaatttattttaaccttctctgaatggtcatcatataaaatgtgttagcatttgtgcctgtctcactgtattaattttcttttctcaataggctggatttggttatggtttgccaatttcccgtctgtatgctagatattttcaaggagatctgaaactgtattccatggaaggagtgggtactgatgctgtcatttatttgaaggtactgcgttttatttgttagtatgaggcatctttgctttttaaagctgtaagttctaatcgctgattgagaacagcactgtatcatctcttagattcatctcagatttacttcattttcccatgaaaaccatgttatgcctcacgcttgattctatgctcagataaagcaaaatatgaaacgtggaggtatagaaattaaaatactgattttggccgggcgtggtggcacatgcctgtaatctcaggactttgggaggctgaggtgggtggatcacctgaggtcaggagttcgagaccagcctggccaacatggtgaaaccccatgtctactaaaagtacaaaaaattagctgatgtggtggtgcacgcctgtagtcccagctactcaggaggctgaggcaggagagtcatttgaacccgggaggcagaggttgcagtgagccaagatggtgccactgcactccagcctgggcgacagaatgagactccatctcaaaagagaaaaaaaaaaattaaaatactgatttttaaaaccataattttaaattgtgacttaaaaaactacatgcctattgaaaggtctgatctaaaagaaggcagattttcataaactgaagtattttggtcttttgttttaaaaactcactggctttcccaaagctacaagaattcagtaatcataatatggttatgtaaaagattcatttaataacaaacttctctgtaacacagtttttcttattcattggtgatcattgggcttttatttctaaactctagaatatttgtaacatttttttgaataggtaatataggcacataataaaaatttaaaagctacaaaaggaaaaatgaagtctctcctcccactggccctaaaccgccagttctgttcagcgaagatcaccaccggtctcagcgtcttatggatcctcctagagttgattctacatttataaatatgggaaaaatagaatttttcccacataaatgaaatttcagcaccttcttattttttttactttgcaatctgtcttagagatctttccagatccatttatgtagaactggctcattcttttaaacagtggcataacatgccactgtgggtcaagcatccctaacccaagaatctgcaatccaaaatggttgaaaatctggaactttttgagcgccaacgtgatgcttgctcaaaggtcaagcttaaaggaaatgcttattggagcaccccagatttcagattttcagattagggatgcttaacaggtaagcacaatgcaaatattccaaaatcggaaaaaatcagaactacttctggtcccaagcatttctttctttcttttctttttttttgtttctttctttttctttttttttttttttgagatagagtctcactctgtcacccaggctggagtgcagtactgccatctcggctcactgcaacctctgcctcctgggttcaagccatgctcctgcctcagcctcctgagtagctgggattacaggtgtgagccaccacacccggctaattttttgtatttttagtagagacagggtttcaccatgttggccaggctggtctcgaactcctgacctcaggtgatccacctgcctcagcctcccaaagtgctgggattacaggtgtgagccactgtgcccggcctgttcccaggcatttcaaagggatactcaacctatgtatgtgataccagaatttaaccagttactgggagtatttatcttagatgcccatgcatctaagtaatgcgatatttaatatacttgatggtgtgtgtttataaacctgggatgcatgagactgtatctcttcctgggccctttgtgagaccagtcaccaggtatagtcaaaacagttgagcatctcaaagcagtatgagctgaattaaaatatgttttgttctggtcatgtgtatttcagttctgattttgaatgagcaaatgttttcattcctttaaaaaagctttaatgttttcctggccagtctaagtaaactactaaggtgtaattttaatatcattttgaaaatatgtattaaggtttctgatgttttaaataataaaatttgggttactatttcacttgagaaaaatgacactgtcgacctttggtgtatatttttgtttctccaataggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacattctgatatgtgctgcaacatgggtgaatcttgaagtcattatgctaagtgaaataaaccagacataaaaggacaaatactatgattccacttatgtgaagtacctagagtagtcaaatgcagagacacaaagtggaagggaggttgccaggggctagcgacgaagatggaatggggaggcattgtttcatgggtacaaagtttcaggtggaaagatgaaaaacttctggagatggatggtggtgatgcttgcacaacagcgtgaatgtactcaatgccactgaactgtacatgtagcaatggttaagatggtaagttctgggctgggtgtggtggctcacgcctgtaatcccaacactttgggaggctgaggctggatgatctcttgaagccaggagttcaagaccagcctaggcaacatagtgagacctctgtctcagcaaaaaatttaaaaaggtaaaattagccgtgtgtggtggtgtgggtctgtagtcctagctactcaggaagctgaggcgggaggatcacttgagcccaggacttccaggctgtagtgagctatgattcgcaccactgcacaccagcctgggggacagaataagaccgtgtctcaaataagaaaaaggtggtaagttctatgttatgtatagcttatcacaataaaaaatgttaacattataaaggaaaagttatcaatcacagaacaagtttcactgttttatggtaataaggaaaataatctgtagttttcttctgactatgtacccttaagcttcaactctactagcaacagtggggttctgcttcatttaacttaaaataatcctgtattaacaaaaaagcagtatatgtgcattataaaaaataagaaaacattggctgggcgcagtggctcacgccagtaaccccagcactttgagaggccgaggtgggtggatcacttgaagtcaggagttggagaccagccaggccaatatggtgaaactctgtctctactaaaaatacaaaaattagccgggtgtggtggcacacgcctgtaattccagctacttgagaggctgaagcaggagaattgcttgaacccaggagacagaggttgcagtgagccaagatagtaccactgcactccagcctgggcgatagagctagactccatctcaaaaaaaaaaaaaaaaaagaagaagaagaagaagaagaaagaaaacataagtaagccaaaaaagaaggagaaacctctgtgttcccaaaacccagagattgccactgctatagcttcgtgtatattcttccagatattttgccatttgtgtatatatgtattttttttgcaaatgagattacactattcatactattttacaacctgcttttgtttcatttaaccatcccatctttccatgtcaatgatcattcactgcaacctctgcctcctggcttcaagtgattctcattcctcagccacctgagtagctgggattacaggcgtgggccaccatgcctggctaatttttatatttttagtagagacagggttttgccatgttgtccatgctggtcaaaaaaaaaaaaaagaaagaaaagaaggaaggaaaggaaggaaaagaaggaaggaaaggaaggaaaagaaggaaaggaagaaaggaaggaaggaaagggagggggaaggggaagggaggggaggggagggaagggaaggaaaggaaaggaaagagctaatggagcattttttgctagaatatccataaacactgttgcagaattacactgagacccatgacatctcattgacccaccattagtgatgttatgattgagcatagtttaggtgatggctgtctgatccctctgagttatagttatttttccctttttcactagaaaataatctgtgtggtgttattttggcactatgcaaatgtatacttacccatcagctgttcacctaatggtttttaccccaattgatcatttcggcctgtgttaaaattaacacagtaattttatttgggtttataaaagaatgttttttttttaaatcattcctttgtcaattattctcctataaagtaaagctcttcctcatc

SEQ ID NO: 17593 - DNA, 64024 bp, Human
tccctccctccgcccgccccaccagccggagcccggcccagtgctccagagaaaggccggcctgcagcacccgccaccgtcgccggccgcccgcacgtccgtccggtgagtcccgggtgccgccgcggccgcggggcctagtgcgcgcacagcggcctggtctcggcctggtcggcggcccgcaaggcgccctcccgcgctaggccgggcggcgtggcgcgcggcgccgagcaggccccgaggaggccgcagttaggcccggggaggagcccggctgccccgagcggcggcggaggcgcgctccgtaagcgggcgggggttgggggagggtcgcccggttgtgccggaggcggtcgaggggccccgggtcggctccgcggccgacctggggcaccgcgccggggtgaggcctggcgaggaggcgaaggctgcaggcgtgaggtgaaggccgcaggccggccgggccgattttcgctatgtaaatatcggtgagggggggggagggacgggggacaagatggcggcggctcggcgcctgctgcaggggacgatagagggggttgccgggagggggagccgccatcttggaggcggtgtctggagagaaaattccgctacagcccgtgagggggggtgggagagcgggcggcggcggcagcggcgccggtgacgggccccggaggcccggcgcggcggcgtgtgcgcgcggaggggcgtgctcgctccccgtggcggccattgcccttgccgccatgatgagcgctcgggctccaggcgctcggcggcagcgccaccttcctgccttgcctcccgcagccccgtgactggctgcagtttccgctgcgtttcagctgagctgccgcaggcggccaccgccgccgcccggacgccgggaccgtttcaccctcagcgcccctggccctgcgccttcccccgcgcctgtagccacccgagggcagtcggggcaggtggcattccggacacctgggcttaccagggcatacgggaccccaggaaatgttatttttgcttaagtcaaatcatatgtggctgctaaggtgctttcgatgcagttgtttttccaacaatctttgccgccccgagtatctgaataaaggaagaaaaataaagattgatgggaaagtttttgccattcttttgtcctatagggaaaaaaattgcacaacacgagagcggaggaataaaattttgaatcattcgtactcatttatgtggaaacaactttcttgaaaaacgatttaagtagtgatctgttggtggtatttttttaaatcgaggaataagggcagacttttttattttcttattggaggacaacttagtgtggtgcatatttattgtgcatttgcctgtcatggtatttcgatttttcatttgtgaagttttaaggcggagtttcatcccctaacgtacttttttgattgcacactgtgcaactttcttgataaactcggagcctactgttagcgatgcaccgtgctagatgctaagaaacattaaaaaggttcttgtaatgcagacggtggctgcaagaagtctcatgtttagaggtaggtggggcaaggtgaaatgcagtaaagtgagaggtacaactaattactgggatttccgagggaagcaaggttgccattggaggatcagggagggacgggttcctgaagtattaataggtggcattttgagaaggttaccgagggatgggtaggactttgttaggtagaggtggaggtggagaaaggacgtttcaagggtgaagcttcttcagtaaacagtaagtatttacagtttggcaaaagtggatggtataggtaggggagtggtgggaattcaggctagaaaagttagattgcagaagggcttgcttgccaggtggaggggcttatactcaatggggtaggcagcgggggtgccctcaactagaagagtgatggcacacctgagctgcaccttgttatttacttattttttattttgagacaggttcttgctatattgccccaggctggtctcgaactcctgggctcaagccgttctcccgcctcccactgcccgcctgtcactgccgtctgttccctgagctgtgctttacggtacttagtagttccattggactaggaaaagtttcaaagttgaaaaataatgagagtagtaagttgatcagtgttttcattatcagaacgattacaagaatgttcagaagttaagcaaattttgctacttttggaacgatgcgtctctattaagacagctgctccttttttctatcctgatttctcatccgaaataatcttttgctcagagttgtcagaatttctatggtacacaaatagggaggggtttctaacatttcatttaccatggttgaaaagtacaggactagtgctgtgggttatttgacgaaaatgagaaatgagtattcccgtggtaatttttttttttttttgagactgaatctcactctgtcgcccaggctggagtgcagtggtgtgatcttggctcattgcaacctctgcctcccgggttcaagtaattctcctgcctcagcctcccgagtagctgggactacaggaccctgccaccatgcctggttaatttttgtatttttagtagagacagggtttcatgttggccaggctggtctcgaactcctgacctcaagtgatctgcctgccttgacctcccaaagtgctgggattacaggcatgaaccaccgtgccctgcctgtttcctagaattttatgatggaaacctttaggtggcatagatacccattttcagtttttccatttttctagactgtaacaggtcgtgagcagcggtgctccatgaaagggctggagggaatgagagtctcatgtttattataaagggctatggtttagaaaagttcgagaaacagtgcattgcatgaggctgactagaagcaagttgagaaggcgggctgtggttgttgaggtgttaagggtaaacataaacttagaagaaccaggtgcttttatattttgacagctgggaaagacatagaagaactattaagaagatagaattgttttgctgcgcagtacagcaacagtggatgttcaagattaagattagagtcaagttgtgtgattaagacaggtaagtgtgtagtttagtttcaattagaaatggttaaatataaaattatttttgcctgaaagggtagaccttgaaactttggaaaactgactggtggaacaccttcgaacccaaccaccctggatgaataaggtgttagtttttaatttctgtgtatttttcagatagatgcagatttctttttttaaaaaaacatgctcacgaatgtgttacaaatttttttttccacattgctttttgtaaatgcttactctcattgcaaatgcttactctcacttaacccatttagactgattctgtcactgataatcttctttgtattatttgttcttgtgtacactggcaattccaaactttttttcactcttaaaactactcaacgggtccttgaaatctctcatcttcagcaaagattacccagtctttcacttcactgagaagggtagatggccatctgataaagagccaagtctcccctcccttccccttcatgcctttcctgtcttcacctaggccttcctccttttgccgcaggggaggttgcaggagggattgctgtctcacaagccccactgctgctctgagcctgctcttcaccctggctgcctccttagggaccaagctctgtgcgtgatgccgtctcttgcatcattaacctctctttacaaatattcctaggtttgctcatcttacaaaagcctcacctgtcttcactttctttgcaccccacttattcttaaatccagtattacccaaattgggaaacttgcacagcatgttaacaggtgtgttatataaaagtgctctgtgtttcagaaactctctgtgccttctctgtcttctatggtgggattccccttaatttatcatttaatgtattatatttgaactgtgtgtttatattttttccttctacactgtgaatatagagacaagttctgatttatctttgtctccaagcagtacctggcatatggaccattatctctcaaagcaataatttcggttactgggtacagagaattctacgtagttaatagttttcagctgttcaaaaatcaggtatccagtcagtgtgttttttgactcagggacatacatattaaggcacacttattagggcaccaggtcaaggagtaacccctcccaccaccccttatctgattggaatatggccagcctattcttattcctgccaagttatttttccagacaacattttataaaacccaggtatcttgtaattgtattttactcaaaggaagtatactctaaggaaattgtgtggccttgaggtacacagccattaggcatttaaaaaatatatttaaaaagttttatggaatatttttaaattactgaaaatcagaatcacccagatttaagagatcttaatattttgctacatatttgattcatatctttttgttgtttaaagaaataaaatctcacagattcaaagggtccctccccatccccttcctgtcttcttttctccagaagtaaccacctgtcccaatatgtatgtaccaaaacaatatcaggtattgcttgtgtgtttaactttacataaacagtatcataaccataccttatatattatttttacttaacagtgtgtttttgagatttatccatgtaatgtgtttagtccagcagttttcaaagtgtgctgcagggattcctggggatccctaagattctttcagggggtccatgaggtcaaaactattttcataatactttttatttgctcttttcacccacattttcctgtacactataggaatactgtacagaggctgcatgacatatgatgtcataatagatagaatgcagaaacacttacgggaatccagccggtttctattaagccagacatgaaagagatttgcaaaaatgtaaaacagtgccacttgttttactatttttttttgtttagaaaaatagttattttaaaataaatatgcagccataaaaaagaacgaggtcgtgtcttttgcggaaacatggatggagctggaggctattatccttagcaaactaacgcaggaacagaaaaccaaataccgaatattctcacatacaggtgggagctaactgatgaacacaaagaaggaaacgagacactgggggtctactagagggtgaagggagggaggagagagaggatcagaagagataactattgggtactgggcttaaatacctgggtgatgaaataatctgtacaataaacccccgtgacagaagtttacccatgtgacaaacctgcacatgtactcccgaacctaaaataagagttttaaaaaaatctcaacaaaagggaaaaaaggaataaagaaaaaaagtatttttatgggttaataagtgcttttaaatatctcagttttaatttctagtatgataaacatctatagatacgacccacgtaaaaactctttgtggttcttaatttttgttttttgttttgttttttaaattttattgtgatccttaatttttaagagtgcaaaggagtcctgagaccacgaagtttgaaaactactgattccattcattttatttgtatttcagtgtataaataaatatactgtggtttatttatcttttcttcttggagggaccgatagaaactgtttgcagtttctgaatttcaaacactactgctatgaacatccttatacatggtttgtctttcttgggattatatacatatagtagaagtagaattgcttcatttaagaagtctgtgcattatcaactttactgggaattgccaaaatggcaaattgtcttctatttgacactcccgctgtgtttgatcccgtttctccaaatcactgccaaaggattagattttgcaattttttcccaatctgttgggtataaatggcatctccttgctattttcattttgcatttctaagattactagtgaggttgaccttttttccccatgtatttatcggccatcagagttttctattaattgcttgtgcatacctttggttcatttttctgttggattgttgcctcctccttattggtatatgggttttatttatttatttatttatttgagatggagtcttgctctgttgcccaggctggagtgcagtggcacgtggtctgggctcactgtagcctctgcctcccaggttcaagcaattgtcctgcctcagcctcctgagtagctgggataacagacgcctgccaccatgcccggttaatttttgtgctttaagtagagacggggtttcaccatgttggccaggcttgtctcgaactcctgacctcaagtgatcggccctccttggcctctgaaagtgctgggattacaggtgtgagccactgtggctggctggtttatgggttttatattctggatactaatttgtgattatatacactgaaaatatcttttcctggtctgtggcttggcttttagctctgtttgtggaaagttttttatgtaggacttcataatatgatggtagccagttctcagtttttttcatttatggcttgtgttttcttatgtcttcaatacattcttcccttaccccaaggttgtaatgatactgtgctgtttcatatttaggtcgttaattcaccggagttttttgtatattgtgtgacgtaggaatctaatatctttttcatgtggatttatcaaatggttcagcgtttctccccactgatttataatgcaactcctgagatatatcatattcccacatatgtatctgtttttagtttctctcttttggtttcattggtctgtttgcctatctctatatctatactatcctgatttaataatagccttttttttttttttttttttttggagacggagttttgctctgtcgcccaggctggagtgcagtggtgcgatctcagctcactgcaagcttcacctcctgggctcacgccattctcctgcctcagcctcccgagtagctgggactacaggcgcccgcaaccacgcccggctaattttttgtatttttagtagagacggggtttcaccgtgttagccaggatggtctcgatctcctgacctcatgatctgcccacctcggcctctcaaagtgctgggattacaggcgtgagccactgtgcccggccttaataatagctttataattaaaactgagtatatcttcttttccttcaggattattttagctgttttcctccctttgcttattttggggttagtttgtcattttctgtgaaaactgttggatttttatatttgcctcaaatttatagaataaatacatagattcatgtagataaatgctaatagagctgggatttgaattctgggtatgtgctactacttttcataaagctcttgcacaacttttgttagatatttttgttagatactgtgtaatttttgttgtcattgtgaataggattttcttttagttatagttgctattattgctgatgtataaggatcactgttgacttatatgtattgatcacgtaaccttgctgaactctcatcatatttcatagattctgaggtacacttttcccccctacatcttcacatatctgaagtcaaaatagatctttgatggtgtcccataatcactgttgtctaggcagcagtcatgatgtagttatcattgcttgcacatgcacaaacttggtcagggctcttcattttgtcatcactttaaatgagtatgtgcattgctgtattgttatttcatgccaaacaataaaactggaggcggaagaaattgcaaagtgggtgtctgccttgaaagaaaatcccataaataataatggatcattttaagaagtgctgcatcaccaacactcttattggcagagcacaatattgttagcaacagttgaacagttttgagtggaagagcaatccatagtaggaccttgaatgtgaagttgtaggaataccttaccaatttattttgcttcttttttttctgtcgcccaggctggagtgcagtggcacgatctcagctcactgcaacctccgcctcccgggttcaagcaattctcctgcctcagcgtcccgagtagctgggactacaggtgcacgctgccacgcccagctaattttttgtattttagtcgagacaggttttcactgtgtttcccaggctgttctcgaactcctgaacccaggcaatctgcccgcctcggcctcccaaagtgctaggattacaggcatgagccactgtgcccggccaatttcttttgcttctgtatacacaagatatgataaaagtctgtctaaataagtctgaattgtcttgataaatctagaatgaaaatcctagataataagaaaatactgtatcagtttaattggcaatgtttttttcttagtcatgtaaaataagggtacagcttacaattggtatcttcagagtcagtgaaatgtagtagtaataacagttcatgccgggtgtggtggttcacgcctgtaaccccagcactttgggaggccgagacgggtggactttgtctcaaacaaacaaacaaacaaaacaaaccaaaaacaaaaaaacacagttcataattcttttgtatatagttttcatgtctgtgaataatacagttttatttcttcttttccattccttcttgcctcctgtttcttgttctggttttactgcattgactaattcctctattgaagtgttcagtagaagcattgataatgggcatccttctctagttactttaatggagtgcttctaatgttttatcattaaatatgatattgtagtgggcttttttgagagggggtgctgatgatatttttatttatttatttattttgagccggggtcttgctctgtcgcccaggctggagtgcaatggtgcgatctcggctcactgcaacctccgcctcctgggttcaagcccttctcctgcctcagcctcccaggtagctgggactacaggcatgtgccaccatgcccggctaatttttttttttttttttgtatttttagtagagatagggtttcaccatcctggccaggctggatgatattttttagttgcagttctcttttacttatcattttagagtttctactgtgagcaggagtttaattttgctaatgcttttgctacatctattggcgtgatgaagtccattaatcttctattttatttttagttttttttatttttcattttgagatggggtcttgctctgtcgcccaggtgggagtgcatggctcactgcagtcttgaccttctgggctcaagccatcctcccacctcagcctcccaagtagctgggaccataggcatgtgccaccatgctggcctgattttttaatttttttgtagagacggtcttgccttgttgcacaggctagtcttgaactcctggtctcaagcagttgtcctgcctgggcctccaaaagagctgggattataggcgtgagctacagcgtgggtcctacattttctattttaaactatttttcgattcccggatattcgcatatctttgttattgccatgtacttttccttttttatgtaatcttgtttggataacaaagttgtattaacctcataagataaattggggagtatttttttcttttttcttttaaacagttgctgtttaatagagacaatctgtttcttttcttttttggagacagaatctctctcttgtcgcccaggctggagtgcagtggcacgatctcggctcactgcaatctctgcctccctggttcaagtgattctcctgcctcagcctcctgagtagctggattacaggtgcccgccaccatgcctggctaatttttgtagtttttagtagagatgggtttcaccatgttggccaggcctcaggtctggtctcgaactcctgacctcaggtgatgggcctaccttgacctcccaaagtgctgggattacagacatgagccaccgtgtccgagcgagacgatctgtttcttaaaagtaagaacccatctgtgagattatctgtgcttggtgtcttttgagtgtaaatttgtggtttctgatttgttaattgtttctttcatgatgataagtcttgttttagctgttcttgagtttttttggtcatttatacaaaatgaacaattttctagaaaaatattaaatttcaaatgcattattataaaatacagatttccctgatgacttttaaaaacctaattttgttagtttgttcctttttttctgatcagtattgccagtaactgcctttattattggattttttaacatagttatttttattgatcctttctatttctactcctgtggttaatattttccttctgctttatttgcattcattctgacatttaaaaatgtaagttagaggcttagctcattcatatttaatctatttttataatatatatactaaaaactataaaattttctctagactataattggatgctatttaaaaaaattgaaatgcttttttttttttttttttgagagcgggtctcgctctgtcgcccaaggtggagtgcagtggcgcactctcggctcactgtaacctttgcctcccgggttcaagcgattctcttgcctcagcctcctgagtcgctgggattacagacgtgcaccagcacacctggctaatttttgtatttttagtagagacggggtttcaccatgttagccaggctggtttcaaactcctgacctcaggtgatccacctgcctcggcctcacaaagtgctgggattacaggtgtgagccactgagcccagccgaaatacacgtatttatggggtagagtgattatgtacatgtatacaatgtgtaatggtcaaatcagggtaattagcatatctgtcacaccagcatttatcatttctctgtgttgggaacgttcagaatcctttcttctagatatttgaaaatacataatgaattatttttaactataatcaccctacagtgctatagaacactagaacttattccccctatttagctataatttgtatctgttaaccaaactgtccctatctctggatactatgatttttgacatgaattggtttttattatttagttctaaatatattgtgatctccataattttcctgttgcccattaaaattatttagaactttgtatttacaggattttctttttgtattactgttatctctgtgatatttatttctaattttattgtattatacttggggaacattgagatgcaaaaatcaactctgtttctctataccagcagcaaacaatttgaaaatcaaatttgaaaactaatataatttataataaggtcaaaaaacatctgataccttgaaataaatccaacaaagcataccaagaccttcagtaaaaaccttactaagagaaatgaaagaagacctaaattaatggcaagagataaccatgttcattggattggaagtgtcagtattgtaaagatgtccgttctctctaaattgatacatacagaaattcagtgcaatcgcaataaatatctcaatagggctgttgctgctgccactgctgcttttttttcttttggataggctagttctcaaatttacatggaaaggcacagggccaagaatggcaaaggcaatcttgagaaaaagttggaagacttaacactaacatatatcaacacttattataaagctacagtgattaaattagtgggcgcaaagccagattgaccagtggcacaggatagagtccaaaagttgacctacacatacaaggtcagttgatttaaagaaaggtgtattgggattttgattgaatgtagaggttaattaagggagaagtgatactactaatctaacatattcttttttttctttttctttcttttttttttttttttttaaagacagtcttcctctgtcatccaggctggaatgcagtgcagtggtgcaaatttggctcactgcagcctctgccttctgtgttcaagtgattcttcttctgcctcagcctctcgagtagctgggattacaggtgtgcgcccccatgtctgcctagcttttgtatttttagtagagacggggtttcaccatgttggccagcctggtctcgaactcctgacctcaagtgatctacctgcctcagccttccaaagtgctgggattacaggtgtgagccattgcacctggccctaatgtaacatattcaagagcaagattgctttctctatttatttgtctaaaaaggaaaaaaaaaaaaaaaagaaatctctagctgggcgtggtggcacatgcctgtagtcccagctacttggaaggctgaggcaggagaatcgcttgaacctgggaggcagaggttgtggtgagctgagatcgtgccattgcactccagcctgggcaacaagagtgaaactctgtctcaaaaaacaaaaaaatcccacacagtagagtttttaattactcttatcagtgggattttttcattcttaggtgtttacatgagaaagcttttgtcttcaagtatattaattttgtaccagcacaccttatgaattcataccgataatagtttttcagtcgattctcttgtatttcctagatatagcatatgcaaataagtttaatttccttcaagtaataattatatcttctatttcatcatcttacctaattacactggctggcatttgtcacacaatcctataataatagtattaatggccattcttaattttgactttagagagaatacttctaatgttttaccttaggtttaatagatgtctttttgttataaagtgataactgacatcattctcatatcccaaaacacatgttctgacatgaactggtttaagattgcatatacttgagtattttttaaacagctttattgagataaagctattattaaatctaccctttaaaatgtacatttcagtggttttttagtagattcagagttctgtaactattatcactaattagaacattttcgtcaccccaaaaagaaaccctacacctactggtaatcactctcctctccccgcttccttcatcccctagcaaccactaatctaccttctgtctgtgtggatttgcttgttcctgacgtttcatataaatggaatcctataacgtggtctttcgtgtctggctcctttcacttagcatattgttttcaaggtcatccatgttttagcgtgtatcctatttatttaatttgttaactgttaaaatatctatcccaatttgactcaaaagtttgctttaaatcaaaagtaggcgttcagtttcaacttttcagcatctgttgagaatatcaggcgtttttttttttgacctattaatttgggccattatttggctccatccttgaattctagagtacccatactgtgccaaggtctgtggtgtgtgtgtgtgtgtgtgtacatgtacatggatgtgcttttttttttttttttttttttacatgacggatcatatttgcggatacttgacttgggattcataattaaccaagtttgtaatttggttaaattatttttgttaggtttttttttttttttttttttttttttttttgatacagagtctcactctgtcgcccaggctggagtgcaatggcgcgatcttggctcactgcaacctctgcctcctgggttcaagtgattctcgtgcctcagcctcctgagtagctgggactacaggcgcgagcaaccacgcccagctaagttttgtatttttggtagagatggggtttcaccatgttggccaggctggtctcgaactcctgacctcaggtgatccacccacctcagccttccaaagtgctgggattacaggcattagtcaccatgcccggccgcctagctaatttttaaaattattttgtcaagatggagtctagctattttgtccaggctggtcttgaactccttgctgcaagtgatctcctgccttggcttcccaaagcgctgggattacgggtgtgagccactgtgcccaggccccctcttttaaaaaaaagaaaaaaaaaaaaaaaaaaattcattacgatcgggttttcttttattgagttaatgctggtaatttacattttccgtcactgtgctagtgtagaattctagaccattttcatacaagttgttttctttttttctgttttttttttttcttatttcaaattgtatatgtttgtgctttctcccagtttcttcccctcttttagattattatcttgtattttattgtcttcccaaccccctggaaaaagcttggtttggagatttttttggggtaaaaattagctggctccctagctttgctccagagaatggtcatgaaattaatggttgctgatactcaacctggagcatgcctgttgttggtcttttgagaagcaggcgtatttcaaacctgcccctgcattgcccagcttgttcttttcttttattatttttttaatgattaaaggatttattaaattccatgtgcaaaacacattgctgattgcattagcaaaagatcaatgtaaaaataccccacaattctggaactgtccatttaaaatatttgttctagttgttgaaaggcccagtgttatattcttgccagtgcttaaggtatacagagaatactgtaagtgttaacactgagtttacagaacctcataggccgaaagtaatgtatttaggaaaagcaataatagtaagtatgcattcatgtaggtgagatatagtatggtcaatatgggtcaaattacagcgttggtgatcagtgacaagggagttggcaagacaattatgttaagaaagatcatagtttaagaatatttagggctgggcacggtgcctcacacctgtaatcccagcactttgggaggctgaggcgggtggatcacctgaggtcaggagttcgaaaccagcctggccaacgtggtgaaaccctgtctctactagtaaaaaatacaaaaaattagccaggcgtggtggtgcatgcctgtaaatgccagctactttggggaggctgaggtaggagaattgcttgaacctgggaggcagagattgtagtgagctgagatggcgatgttgcactccagcctgggcaacaagagtgaaactccgtctgaaaaaaaaaaaaaaaatttagagtgttttgaaaactgtaaacctgcaaggcatgatttttacaactagttaccagaaaatgaaggaaagcacataattagcttgaataaagtaacatgaaagcgagactgcactaatttaaaaaaaccccaaatcctaatacagtatcagaaaaatattttcttttctttcttttttttgagacggagtctcgctctatcaccaggctggagtgcagtggcatgaatttggctcactgcaacctttgcctcctgagttcaagcagttcccctgcctcagcctcctgagtagctgggactacaggcacgtgccaccacgcctggctaattttttgtattgtagtagattcagggtttcactatcttggccaggatgttctcgatctcctgaccttgtgatccgccagcctcggcctcccaaagtgctgggattataggcgtgagccaccacgcccggccagaaagattttctaatacaaggagacatattgctcattgagaaggggtttgataagaaaacttactaagttaacaactatgttaatgactagttcagagataaattaaatgcccaattttgggaaaggtagcaggtgcaagaaaaaggaaatgtataagaaaacagtttctgatacttaaacctttcttcatcatgtactgcatttgacagaaattaaccttttaaaaattttacctaggatggttttatttcatttattccatgtacaatgtagtctaaatctccacttgataccatgtcagaatcctgtcttcatcctttgattacatcaagtgtttctcacactgctcgaactaagtctgcaactaaaggtagaatacttcagtagaggaaacgtgaatagaatttcttttcagaatttcagcaaaaactaataagctattttaaagtttttcactatgaaataaaagagtgatccaaagagttgagttgttttactcattccattatgatatatggtagaatgttatggaatgaacatggatattgctaaattattgaatgcattaaatggcagtactttattaaggaggctgtactgctttaaatatctgaaaactagttagaatgtgtgcatttcctcacatcaagctaagccttaaaaacaaaagcatttaaaactagtgtttgtagctcattggtacaagtaggttcagagagtattgtgtcaactcttaatctgagcaggaatagaagctttgagaaaataggctttaagaaggtttgtcattttacagccaagttttaatagattgtgaaagtttggactcttagattttaaacaaacaaaaccttgaaattactgattggctcagcgtggttttatggaaaaactaatacaaaaacttggccttgactatttgagcaaagcctacaaaagttccagatgggacagggcaaggaaggatggggctctatttacaacagcagatattttcttttcctcttcttgacgtggagtaggcagggctatttgaaaataaaatattcttttcttagagaatggaacttgaattacagttattagattaatatcgattatatacattttctcttttccttttagactagttgatctgttaagtgttgatagttgttgtaaccttccactactattgattttttttattactgtctcataggttcttttgctttttttatatttacatatttccatgctgttttatttggcacataaaaatgcataatgacttcaaattcaacatagactagagaacacacacacttattttttcttccttctaaaatcacataaagaatataaaaacaaatccagagaaacaagaaaacctcagtggtatgaatcagaatatgatgaatttttggttgaataaagcaattggaaatcaattaatgtcaaaacccaagagagcttagtgaacgtgtgaccttattcagaaagtagaagggaccagccaagaattggcatcctgcagtaccaccaacatcaaaagcagggaggcacttggagatagaacaagccatgagtacagccagataattaaagccatggaaagctaagccatttacctattagtataggtgcccgcaatggttttcctgctgggataatgcccaaaattcagctctctgaattgcttgtttgtccataggaaattccaaagtgagtgctgtatagcaagaaagataggggcagtagtttaggtagcttgtggctatcctgaaggatattgaacctccagcacctggaagatgggatactcttccaccattaaaggagaacctggctggttacatggctcctttctcgcctatggactcattctagataggacttctgtgatctgaatttaagtttattgttgggcaaacaggaattatcacttgggctgaagaagttcaccccagcagtcagaatataactctagtctggaccctcatctacaagtaggaatagacaaccaggaagaaccatgcttttcaggaaaaccagcagtttaaaagagaggcaccaaattcaactaactgaataatgaaacaccagaggagacagtttatatagggtacagaatgaactttaaatccacagagagatttgggaagataccgtgtccacccaaaaaagaaaagattgctatggaaaagaaactattagaattaaaatatgaacttttaaagaaaaattcagtagatggggtggagatcaaattagctagcttagaagaaagaattcagggattctctgagagtgtagtagaaagacaaaatctgagagaaaagttaaagcaatatagaagctagatttagtagcctttttacatcctgtaataaatgctagtaagaatgaacagagaaaatggaggaaagtatagaaacaacaagaaactttcctaagttcaagaagggcttaagtcttttgattgaaaggccccacatggtctgcatgtgagaagagaacttgttagagtggtagcagtgataataaagaggaagtgataagtataagagttactggctttgagatgaatttaatttaagggctgatagagtcagagaagagaaatatgactccagatttgaaaatgagatatctggagaaatgatggctaacattgaacaacatgggggaaaaattaggaaagaaatgcagcttaagagagaagatattaattaggccttaaatataagttttcaccagttctgatttccctctaagacaaattgttatagacacatttgcctttgtttgcctttcctgcagcttaagcattccttctaccatgtataataaaatttagttctctgagtgtgacttagtgagaagaattagagttgagtcatagaattaacaggcagtgaggttttgggagacctaaagcagaaaagtgatttttatatgcatattagctgcaaaaagcaaagtgaataaataagaatcctgttaacttgcccaagagggagatcacagaagtatctaagcatcaaaatatataaaacaaataaattatatctgtgatccctaatttaagatagataaaatgccattgctatacctgttaacttttattgctttattatatattttatttataattaccttcttctaggatgatattgctttaaagaatggaaggacatttttgtgaatttcctgggttctcctagcccattatttccctcaaaactatatgtttttcttttctttctttctttttttttttttttttttactttctgtcctcacagtctgttcccaaaaactatgtttttccactgtgaattattttcaggatcatgattctcgtaactgggaagggaatatcttactgagtttgaggtgttagtagagtcccagaaataccttgagggcgtttgatagtaagactaaatgttagtacttgttcacccaaattctgagattcttggttctctgaaccatcctacttatttgtctttaggttcaactgatctctgggcttggtttgtactacaaaggcatggacaccgccagttacattatcacgtaccttcttccacccttcgtttatcatatctgagaactcctctgagtaggttctgttctgagaacagtttcattctgattgtcaaagggagttagtattctaactccagaggggttacaaagttgaggtatagtcatctctgtttagaatgtttgaatttttgtaatgacaaaaccgaagggaaaatgaccaggcaaaacaatagtttgttgaataattactgctcacttaagatgagatgagcgggcacccccatgtaggccagaatatctattaggaaatgcacgtgatgtaaaaggatgggaagaaagcaaatcagtctgttaatggtagcttgggttaatactgcagagcctttgagtattgaggaactgctgaagtgttcagagcagggaagtagtatgatcaaagcagtgcttcaggagggttaatttgcctacagattgcagaaatgcctcaatacttggcaccagcccttacgtgtagttttagggtttctagtcatttgttgtgggagtggcagaaaggagcaaggccagtccagaggctattttcatcccccagggatcaggaaatatgaagctgagtgggaatgctaactaggaattaaaaaaaaaaaaaaaaagattcttgagaagttgagaattgacaagatctggcaatctgactgtgagcagagaagaagaaaaaggccatagtggtcatatcaggagaaggctgggttttatccggatgagaatattcaacagtctgttggacatgttaggatgattgtaggaatcattgttgtggaaatagtagttgaaaccatgggaataaagagaaagcagaagaggagagggttgagcacacacctgggctgagccgcagtaaggggtgaggggagggtgagcagccagcagttaagaagagggaagagaactagaagtcacttaaagcaacagaggaaggagagcacttcacaaattagggagttgattgtttaatagaaatgccaaggaggatgaatgccaagaaaagttgttctgcaagttgagaatccgtagagctgatgggattgggtttatgtagggaaatttgtgcggtgaggggcttaaataccttaatgtatcccctttattgccttcttaattggcttgctttaatgtcatagtgtttcataatgcttagaatttttttttttttttttgagacagagtctcgctctgttgcccaggctggagtgcagtgtcgcaatcttggctcactgcaacctccacctcccggattcaagtagttctccctgcctcaacctcctgagtagctgggattacaggcacctaccaccacgcctggctaatttttgtatttttagtagcaatggggttgcgccatgttggccaggctggtctcgaactcctgacctcaggtgatccacccgtctcagcctcccaaagtgctgggattacagatgtgagccaccacgtccagccaatgcttagaagattaatttacgtttatcatttttaaaagggggaaaaggtattctatagccagaggtggttttgcgggagtggggcagtaataactttttcagagcatgtacactttctgtttttcatttgctttaattttttttctttaattttttttttttttttttttgagacggagtgttgctctatggcccaggctggagtgcaatggcatgatcttggctcattgcaacctccgtatcccgggttcaagcgattctcctgcctcagcctcctgagtagctgggattacaggcatgcgccaccataccctgctaatttttttgtatcttagtagaggaggggtttcgccgtgttggctaggctggtctcgaacgcctgacctcaggtgatctacccacctcggcctcccacggtgctggcattacaggcgttagccaccatgcccagcccatttacttttatttgaaacagtttgaataaataacatgaaacatgctatttcttaaaaatgagtagaatatatctcagagttggtatgttgagaattccttttatgaatgttaattttctcaattaacatttaatggatatttccattactattccatgttaatggatttttttaaggactatatatgtaatttagtatctgtaagtaagacatatataaataatcataatatgacaaaccagtacaataagagaagaatagagtgctgtggaaatttcagagggaaaaattgtttccagctttctcttttttttgtggggaaggagatttagagggaaagatcaaagcagagataatgggggaaaggggttccaggtagaaggatccctgaatcaaatatgaagttggggttttatggggatgttgagcatttttgtttggctgaactttgtgtgggtggggaccatgtgtttgtgtacatgctgacagtggtagagggaagtgcttgaaggaaagttaggggagatgatgatgggaaggtagtttggggccagaacttagaagatgacaggtgtttgaattttatttagagggagcaagaagccattaaacatttttgaacagaggaatgatgtcacctagctttagaaaaatgacttgtgtttctgttaattgaaattttaataagcatgtagtacttataaaatcagcaaaaaaaagcggtaaaggtgaaaattattggttagagttctttttgtcagaagtttttggcttaagtagaaaagggagaattaaggccattggaatgtcttacaagaattcaaggcaggaatatagctggacctcagataggtctagaaccaggagctaaacagctgtctcccctccctgcttactctattctgttactcaaggcactcacagtctaagccagagttgcaaaatgacttttctcagctcttatgttccagccaccaggacagagagagaaggagagagagagagagagagagagagagagagagagaggcagacagacagacagacactgattcttgctcatggttttggattctcagggataggactttgattttattgtgcttaaagatgagcttactgtttaccgttttatagctagtgccaatcaactgtggccaggagaatataaatacactatgggaatttacttctctagatgagagggttagttaagagaggttaggcagaatcccaagggttgtttactacagttatgcactttgaatttttatcattgtgtaatctactggttggaagttagtagactaattacatatagagaatatgaaaattgtgcaaaaatttcccccagtaagctacagaatgtattttaagttgaatcttaacacaactggttacccttgtgggaacatggggtgttacagactgaggacacaagagtgctggggtcttaaaagcgttctatattttgatcagggtagtgattacaaaagtttatgtatgtattagaattcatcaagatgtgtgcacttgatagacctaagcaatacatttattgcttcaacttaaaaagaagtccaggcaaagttgacttgtttatctgccctgctttgtcatatagatgcccatttatcattgtaaatcaagtaagttctattttactttagataagtaagtttttgatacacatttatctttcacataatttgagtgtctcagaaatgaaactatcatgatggcatttaatacctgatatgaaaaaactaatggctttggtttacttttttccctgatttaggagctgtgactgatgagaattaaaggccatggatgaagatgggcttgaattacaacaagagccaaactcattttttgatgcaacaggtataactacttgaattgttccacttcccatctaccagatttggagttggttgtcatcaatgaattgctagaactctcacattgatcattcacaggttatcttgttatcctgtcaaaattcacaggtgttacggtgagcacattattattaccctcctcaaagatgtggctccctcacaaccaactctcatattcttgtcagtaacagcagcaatatcaaaccttagttttatcttcagttatgaagataatatcttgacgagttatgtccctaattcctgttgtttttccctttgaaaatattccttgttagctttgtttggacctttgtttaaaaaaagaaaaagaaaaaatattctttatttacatctgctcttcttcatcctagtgcctaccacatagacaggctctacgtctcattcttagtctggaaataacttttgcattattttccttatccttagtctctcttatctagcctgctgatcagagtactcactgtaaaataacatgtggatcctgtcatttctctattctctaatacccagtagataaagaaggtctcccacattgaccctgtcctatttttataactctctctcttgcaagttcccaaaaagagacttctgcttcaggaagatggagtcttcactccccatagtgtacaaggaaaaattatactcaggaagttctaaaaataggaaaaaaaacagtattagaaaacatgtatttcagattacccatggttataattatataacgttgtaaagtggttacacttgcgttttgggtttttttgttttcagacagggtctcgttctgtcacccaggctggagcacagtggcgccatctgggtccactgcaacctccgcctcccaggctcaagtgatctgctcagcttcccgagtaactggggctacaggtgtgtgccacaatgtctggctaacttttgtattttttttttttttttttgggtagtgacggggttttgccacgttgcccaggctggtcttgaacccgtgggctcatgtgatctgcctgcctcggtctcctataagtattgggattacaggcgtgagccaccatgcctggcctatacttggttttataacataaaagggatttgaggccagacacgatggctcgcacatgtaatcccagcactttgggaggctgaggtgggtggatcacttgaggccaggagttcaagaccaacctggccaacatggtgaaaccccgtctctactaaaaatacaaaaaaattatctgggtgtggtggtgcacacttgtaatcccagctactcgggaggctgaggcctgagaatcggttgaatctgggaggcggaggttgcagtgagctgagatcgcaccactgcactccagtctgggtgatagcacgagacgcagtctcaaaagagaaaaaaaataaaaataaaaaataaaagggttttatatcacaccaggtagctaccccttattataaataaaatgctaataagttttccattggactgtaaatgatcagattgtagtatattaaagaaatagcaatcaactttatcaggaaattaaatgtcagtgattttaaattaaaattttttttttttttttgagacggagtcttactctgtcaccaggctggagtgcagtggcatgatctcggctcactgcaacctctgtctcccgagttcaagtgattctcctacctcagcctcccgagtagctgggactacaggtgtgcaccaccacgcccagctaatttttttgtatttttagtagaacggggtttcaccatgttggctaggatggtctcgatctcttgacctcgtgattcgcctgcctcggcctcccaaagtgctgggattacaggggtgagccaccgcacctggccctaaaattttctttttattattattttatttttcttttagcggcagggtctcaccctgttgcctgggctagagtacggtggcatgattatagctcattgtaacttcagactcctgtgctcaagggatcctcctacctcagccttctgagtaccttggactacagatgggcgccatcaagcccagctaattttattttttgtggagacggggtctcgctatgttgcccaggctggtctcgaacaagtgctcctcccaccttggcctctcatggtgctgggattacaggtgtgagccactgtgctcggtcaaattttaaaattttcttgaatctctaaatccagtggggatgtgtgtgtgtttcttaacaacttgggatactcttttaactcgtttggtaatttcaatttgataatgataaatgtaaggtttataattctttcttccttggaacatgaaatataagtaatatacttgaaagagactaaactctttggagaaaaatgtgcagtgtttgttcacttaatcttgccacaggcaaacctaggtaatggactaagtggtagattgaagggctattgcgttttagtcttgattgataacacttaatggtatttgtttatctttgagcaagtcacttaatctgccagggcctccgttttcatatgtcataataataatgaaacctctcattacagtttttcagaacacttcccatacattcccatttgatcatcaccacagtcctgtgaggtatgcatggcagatactactgtcctcattttactgatgaggaaactgaaactcagaggttgaatgacttgcccaaggtcacaaaactaataagtgtcctaccctgatgtactctctgatttagattttggtttttttttggttttgtttttgagatggagaattgctctgttgcccaggctggagtacagtggccatgatctctgctcactgcaacctccacctccctggttcaggtgattctcctgtctcagcctcccaagtagctgagattactggtgcagaccaccatgcccggctaatttttgtatttttagtagagatggggttttgccatgttgaccaggctggtcttgaactcctgacctcaagtgattcgcctgcctcggcctcccaaagtgctgggattacaggcgtgagccaccgcgcccggctgatttacgttttataaccagtgctcttgccactagatgctttcatctttatgtatgctaaatggagattagtgatctattacttaatgataatattgtggatattgaaaacaagtttaaagcattttgtagaaattctgtagaaattaaagtgaacatactcttttttttttttttttgagatggagttttgctcttgttgcctaggctggagtgcaatggcgcgatctttgctcaccacaacctctgcctcccgggttcaaatgattctcctgcctcagcctcctgagtagctgggattacaggcatgcgccaccatgtccggctaattttgtatttttagtagagatggggtttctccatgttggtcaggctggtctcgaactcctgacctcaggtgattcgcctgccttggcctcccaaagtgctgggattacaggtgtgagccaccgttcccagcctaaagtgaacatattctttttattatttctagatgtaattaaaatagatattagttgacttcctataatttctaatattctttggcctttgattttttttttttttttttttttgagacagtcttactctgtcgcccaggctggagtgcagtgatacaatctcggctcaatgcaacctccgtctcctgggttcaaggattctcctgcttcagcctcccgagtagctgggattacaggcatgcaccactacgcctggttaatttttatatttttagtagagacggggtttcacaatgttggccaggctggtctcgaacccttgacttcaggtaatctgcccaccttggcctccctaagtgctgggattacaaggcgtgagccaccacgccagacctgatcatttttggttgttgattaagctgtgtatttctctgagggcctggccagtgacacatagtcattgagttaggcacctggttggactcagcctggtctgagtcaaccagaggcactaatctactgaatagctatgtaggtaagacttataaaactttctttgcttttctgtagaacagaagccaagatattttatttatttatttattaattattgagacggagtcttgctctgtcacccaggctggagtgcagtggctcaatctcggcttactgcaacctctgcctcttgggttcaagcaattctcctgcctcagcctccctagtagctgggaccacaggcacgtgccaccacacccagctaattttttgtattttttgtagagacagggtttcacagtgttaggcaggatggtctcgatctcctgacctcgggatctgcccacttcggcctcccaaagtgctgggattacaggcgtgagccactgtgcccagccttcttttattttattttatatttttgataaggatatttgattctatttccatttgtgacattcattcagaataatattttctgagcaccatacactgtgcaaactgtgtgatcttggttaagtcatttaatctcactgggcttcaactgattcagtcctctaccttcattccttaactgcaaaatggactagagtaggggaactatgttccgaggaactgccttgggagttcgggtctagggggacgggaggaggctagatggaggcaacgtaccctggtgaagttggggcagctcctgctccaactactctcaacctccaccactccagcgcagctgcacttgtatttatcctatcagtctccagagcctcctcaacccagttgtctttcctcctcaactgtggtctttagtccctcttttaatttatcctttgatccttgtatgtcctagattcagaggatgatttctaaatttctatagccatagatggagcatattggtggtatattgcaccagaacaaaaagggaagcgtgtgaagggagaaaggaaaaaaaatagaagtaaaagaaacacatgggagagatggaaagaagaacaaatatgagttgaggagagggaggtggagcaaaaaggtaaaacacatataatgaaggaaaatagtatgtttgtcacctgaagttgcattacttaattttttttttttttaagagacttagagacagagtcttgctctgtcacccaggctggagtgcagtggcacgatctcggctcactgcaagctctgcctcacgggttcacgccattctcctgcctcagcctcccgagtagctgggactacaggtgcccgccaccacacccggataatttttgtatttttagtagagacagggtttcaccgtgttagccaggatggtctcaatctcctgagcttgtgatccacctgccttggcctcccaaagtgctgggattacaggcgtgagccactgcgcccggcctacttaattaatttttgtaatcttcccttaagtacctatgtgtatggttttcttttcttttctttttttttttttttgagacggagtctcactctgtcgcccaggctggagtgcagtggcgtgatctcggctcactgcaagctctgcctcccgggttcacgccattctcctgcctcagcctcccaagtaactgggactacaggcgctcgccaccacacccggctcatttttttgtatttttagtagaggcatggtttcaccatgttagccaggatggtctcaagcttctgacctggtcatccgcccgtcttggcctcccaaagtgctgggattacaggactgagccagcgcgcctggccttttttttttttttaaaacagtcttgctttgtcacccaggtggagtgcagcagcgccaccttggctcactgcaatgtccgcctccctggttcaagcagttctgcttcagcctcccaggaagttgggattataggcttgtgctacccatgcccggctaatttttgtgtttttagtagagatggggtttcacaatgttacccaggctggtctcaaactcttggcttcaagtgatctgcccaccttggcttcccaaagtggtgggaatacaggtgtgaagccattgcacctggctatatatggattttattagtgtgcctaaaattttactttcatgtatgtattttttctgtgactgcctcaattgctttgttctcctaatttttaaaaatctattgatttgagatgattacaaaagttcttgggttaaaaacatgtgattcaaaaatagattccctctttatttctttaatctatcttaatgtttaagaaaactgaggagctaatctgttttcccagtagaaattaagtaacatttacgttaattgtagtcatgcatacttacctgaaatttgtcattttaattttttttttaaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtaagtcttggggtacagtgattgtcaaaggtgtttttgtaggctgcctcttctaatttacatcaggggtgaaattttcttgacttaaatgtctgtaaaagtaaatctcatagacctacctgcattgttgtttccatttgcagcctacaagataactgaaaattaagaaaagtgaggccgggtgtggtggctcatgcctgtagtccgggcactttgggaggctgaggcaggtggatcacctgaggtcaggagttcgagaccagcctggccaaccaacatggtgaaaccccgtctctactaaaaatacaaaaattaaccgggtgtggtggtgggcgcctgtaatcccagctacttgggaggctgaggcaggagaatcgcttgaacccgggagccggaggttgcagttagccaagattgtgctactgcacttcagcctgggtgacagagcaagactccttctcaaaaaaaaaaaagctgaaacaaacagaactgaactttggaatcatgaagaatgtgattaggctgttaccagcctttattagaattatgaactctcttgaaacctaaaaggagttcaacttggaaaaacaaaaagtctaaccaagctacttactttttttttttttttcggagggagagtcttgctctgtcgtccaggctggagtgcagtggtgcgatctcagctcactgtaaactctgcctctcgagttcaagtgattctcgtgcctcagcctcccaagtagctgggattgtaggcacgcaccaccacgcctggctaattttttgtatttttagtagagagggggttttgccatgttgcccagtctggtcttgaactcctgagctcaggcaatccgcctgccttggccttccaaagtgggaggattacaggtgtgaggtatcacgctgctacttattttcttgaatatggatacacggtactgtttatgtaatacttatgtacttatataatatgtaaaacactgcataacagataacatgaaaaagagctctggtatagtatgaaacatgattccaaaacatggtatcaagtatgatggattcatattaggttattggagaaaagtaaagtattttgaaacacacctttacatgtttatcttagcatctggaaagacaaccgttatcttcttacaacatacttcttggtaccaatttcggagataaaattctagattggctaggccacggttctgacccagtgtggaaattcttatgccttaaggaactaaacttaaaatataaaggattcacagactatttataaatttacaagaatatttgctttgttcgaatacctgttttcatacaggaatttaatataacattaatatactggagtccaccagcattttaggaaacttctttgagattttgaaactcctttgaaaacttcttgagattttgaaaatcaaagaattatttgtggaaaagggaagaaaatgccttcattcaacacgtttattggaccctgaatgtgtgagacattgttgtaggtagcgtagatacagatatgtgctaaataaatacatacataagaccattatccctggagagcttttgatctgctgtgggagagaaagtttgtagtgtgatgcagaggtgtgactaaactgccatggagatgggatggagtagctgacctttgaaatcaaggatgaattctagttttacaggatgaagggcacgggtggcaggaagacattccaggcatatagtatagtgtattaaaaaagaaaaaagttctggcctttgctgatattgctgataatgatgggaactttaggatacacttttatatctttgtgtacgttctattttattccttagaataaatttgtagaaatagaattgatagatcaaagggtgtacacatttacaagtttggttatgcttgaagtttggttaaattctcttggtattttgccttaatattcccttcaccaagttgatgagaatgttcatttccctacactggaaccaacacagagtattatttttctttttagttttcgccattctgatagggaaaaatacgttaccctgtttcaattttgaatttattttaggatgatgatccttgtatgtggaataagacttaagtgagggagagattagtggcagtgaactgttgaaatggttcatatataagatgatctgaagtacgttaataatagtaaaggggacagagaggtagctgcattcaagagagattaggaagaaaaatggatgagattcgatgatagataaaagaggctaggggtttgaggaagaaagataattcaaggatgaccctaagtgttctaccttgggagattggatgcctagtcatgccattacctgaaaggaggagtaggtttggtgggggaaggtgggggaagggggaagatttaggatctgttacagtttgaattgcttgttggtggatgtttcttctaggcagttgaaaatatgactttggtgcttttgagagagtttgttgctagaggaagaaatttaggacaacagaatgtaggcagtatcatatatggaaatggatggtagtctccagagcatgcttgtcgagtgagagtgtcaagtatggctcctttaggtatttaagaagtaggcagaaaagagtccttgaaaaatcaggaggttttgggaagagaaggaggagaaaaagtatttccaacactgttaaggatagagtttctacaagttatcagccactgaggagaaagcaggcttttttgtttggcatttaggaggtcattggtatctaaattagagtaggttcagtaaggcatgggctattggagaggagatggaagagatgagctgtgatggattgagaagttagtggaagtagagttaggtgaagcggtttggataaattgccattttggtcagcaaagggactaaagaggtgggagtatagcttttgatggttgcctggatggcgaaagtaagttgaacatgtttatagacttaagggaaaaaaaaaatcactggacagagagaacctgaagataaagaaaggatgggctagtggagcaggttccagagaaggggaagggactggggtccagggctgcaggagacggctgttaggtaagtcctggagagggaaagtgagtccccttctctgagacaggaagacagttaaggatgaggcccctttccagggacagaaggtaaaaggagtacttgaatgttgggagctattttgtctgtgaagcaggttcatctgcacatatggaaggactgcagaggctgggtggaaagctgaaggataatggcaaagggttgaaaagctttagtctttaggggatgggccagtgtaggaagccaagaatttatgagatagattgctgaaccgcattgaggggccagctgaggttaggagtctattttattttattttatttttgagatggagtctcactctgttgcccaggctggagtgcaatggcgccatcttggcttactgcaacctccgcctcccgggttcaagcgattctcatgccttggcctcccgagtagctgggattacaggcactcgccaccatgcccagctaatttttgtattgtttagtagagacggggtttcaccatgttgcctaggctggtcttgaactcctgacctcaggtgatcccacccgcctcggcctcccaaagtgctgggattacggacgtgagctaccacgcctggccgaaaatgctattttaaaatgcaggttgagcatccttaatccaaaaatccaatatctgaaatgctccagaatccagaactttctaagtacagacatgacaccacaagtggaaaattccacacctgacacttgctttctgagggttcaatgtatataaactttatttcaggcacaaaattgttttaaaaaattgtataaaattaccttcaggctatgtgtataaggtgtatatgaaacacagataatttttttttttttttttaatttgagacagtcttgttctgtctcccaggctggagtgcagtggctccacctcggctcactgcaacctccaccccggctcactgcaacctccaccccctgggttcaagtgattctcctgcctcagcctcccgagtagctgcgattataggcacgtgccaccatgcccagctaatttttttgtatttttagtagagacggggttttgccatgttggccaggctgatctcgatcgaactcctgacctcaagtgatccatctgcctcagcctcccaaaatgctgggattacaggcgtgagccaccatgcctggctgaaacacagataaatttcatgtttagacttgggtcccatccctaagatatctcattgtgtatatgcaaatattgcaaaatccacaaaagtctgaaacacttctggtccaagtattttggataagggttactcaacccttacgactgccagattttctattacaagaccgggcaacccaggaccaaggctagagaaagcagagagttgagttcgtcccagtttgtgaggggaagagggcctggtgaaatactgaagaggataaagcactctcgcttctccttgacttctctctgcactttctgccctttctgtcttcctcagcttttttgctaaggagtaaaatgcatggtattggtttgccctttaactgcgcactatctcttgcctttactttctcctcttttaggaagttcagccctccaaggaagtcattgaaaaaaacccagaagttgctttagtaacaatttactcagcatatcaggttcttgtattacagaatttgtaatacaagacatgtaaaattttacagacttgtaaaattttcattaaaaattttatttatagtcatctttaggccctgggtttcttctaatttatatagattttaatgttcctgaaaaagtaaatatggatgaacataaatggctattagtgtattttatatattttaatatatgttttatgtatgtgtatatattttgataatataatttctttccttttaaaataaaacatatccaaactcaaataatgcagagatacatttaaacaaatacatacacacatgagcatttgcgtgcacacatgtgctattcccctatttcactataatgaaatggttgtttttaagttgggtttagagatggtggcctttagtagtatcttttgtcttctctattattatgtttgagatgaagtctcgctcccttacccaggctgggagtgcagtggtgccatcgcggctcactaccacctctgcctcctgcgctcaagcaatctttccacctcagcctcccgagtagttgggatgacaggcatgtgccaccacacccgcctaatttttacattttttgtagagagggggttttgccatgttgcccaggctggtcttgaacctggtcttgaaccagcctgggcttaagcaatttgcccacttcagcctccccaatttcttcaattcaggtgtgagccaccttgcccggcctctacagccacttttgcactcttacttccctctacttcatcatcccctttcctttcaaagtaatgatcatattttaaaatttaatttactattggctttgggatcaaaccaattgaacactttagaattaactaatatttctcttggctgtgcctcccagcaaagatacttaatgatgcattttattttaattaatttatttttgagacagagtcttgctctgtcgcccaggctggagtgcagtggcatgatcttggttcactgcagcttccacctcccaggttcaagtgattctcctgcctcagcctcctgagtagctgtgactacaggcgcgtgccaccacgcctggctaatttttgtatttttagtagagacagggtttcgtcatgttggccaggctggtctcaaactctggcctcaagcgacctgctcacctcggcctcccgaagtgctaggattacaggcgtgagccactgcttccggccttaatgatgcattttaacttaaaacttatattgaggtcgggcacaatggcttatgcctgtaatcgcaacactttgggaagccgagatgggggagggtcgcttgagcctaggagttcagaggttacagtgacccttgattgcgccactgtactccagcctgggcgacagaatgagaccctgtttcttaaaaaaaaaacaacccctcccaaaacccccctaaaacacctatattgatttcagaagttaaggattaacaaaggttttgtcgtaagtatatagaggaactatgggctgatttaatccatgatagagaatgtgaagataccattatcggtagtcaactttaatgcttttcatattatgatgagagatggtagtatttctgaatcttatatttattaaacactctatctttaggtcagaaatgtggccagatgtccaagtactctcttttctactctcttctttaaaaatttcagtaagttactggatctgagtgtctaataaacagcttttacaatgtctttagtatccatcttggcaggtttcttccctctgcacgtctcatttaaaatgatgatgggccaggtaaggtggctcacacctgtaatcccagcattttgggaggctgaggtgggaggatctcgagggtaaggagttggagaccagcctgggcaacatggcgagaccccatctctactccccacaaccccccaaaaaaaagattagctggtgtggtggcatgtgcctgtggttccagctgctcaggaggcagaggcaggaggatcccttgagcacaggtgttcgaggttgcagtgagctgtaatcataccattgtacttccgcccgggtgacagaacgagaccccatctcttaaaaaaaaatcaaaaaccaaaaaaccacacaaaacaacaataaatgatgatgaagcagtcctcattctttataatatcatggttgtgtatatagacacagatgttcattgtcacagtatatagctacctttgaggtcaggatgactgccttcttcagtctttgcaatctagattttatgattggcttctaagttaattatatgtttcttgaggacaggaactatttactgcatctttgctgcttatgtatcttccccatcacaccgtatgtatattaggtatgaaataaatatttgttgaataagtgaatatatgaatgttatagctgaaagtccgtgtacatcatgcctcatccaaggcattaacgataaatttcttccctaccagtagctattgtctcttgataaaaataggtaatagtaaatcttcaataaatgatatctatgtgccggaattgaaaatatagttagtttttgagatgagatctcaccgtgttgcccaggcatacatacatacatacatgcctgtagatgtgcagtggctatctgcaggtctgatcatagtgcactgcagcctcgaataatagcttctccaaggtcactcccagcagcattagggtgaggctttgaaaccagttatgttttattccaaagtgtccactcttaattctcttattggccccccctttctctctctgtgtctctctctctgtgtttgtatgtttgtatgtatgtgtgtataatttaatactacaaagcagtagagttcatgataaatagtgcttattggtagatgggggaggcaaatagaattccaaagataactacaatttacaataataatgaattccaaatttcaacaatgttaaacaataatttgttgggagggtttaagcattttttttatttaactcattctagcagaagcccagacagcttccaaaccccatcctgttgtttttctaactgaaaagtattaatttttttcaaatttgtatttacatgagaaaaaggaatcatatatacgctatcacttttactcttgccagtgttgatttttcttttgccttcattcattcagaaaacatttattgatcagccataatgagctgcgaacctcactaggggttggagataaacagcaaagtccctggctttttaagttcacagtctgggagggaagataaacagaaacaggcaattacagttgagtgtaggaaggtatgtaaatagatatagaaagtactttagaagcactaagaggatggggctgggcacggtgactcacgcctgcaatcccagcactttgggaggccgaggcaggcggatcacgaggtcaggagtttgagaccagcctgaccaacatggtgaaaccctgtctctactaaaaatacaaaaattagccgggcatggtggtgcgcacctgtaatcccagctactcaggcggctgagtcaggagaatcgttcgaatacgggaggcagaggttgcagtgaactgagatcatgccactgcactctagccactgcacgctggtgacagagtgagactgtctcaaaaaaaaaaaaaattttttttttggtacgcttgagggagacaaatgctacaaaagcgttataaactgaagttctatggaagctcacttgaagatattgaccaagtttattttatctcctattcattttcctccctcctgtattttaagcaaattccacataacatttttttcataagtatttcagtatttgcttttcaaagacaaggattaaaaaaaaactgttttcaaagctttaaaaaataatttgagatgaactcaatctgaagggtgtataaaataaaatgttcatgaggtggctgaggagggaagaaaggcagagagatgtgagacatcattgagtgttcagagacctattctttgggtgctaataatgtctggtgaggaggatggaggaagtggtgagaaagaagattggcaaatagggcccaaaacataaaggctcttgaacatagacgcctgctttactttttggacgtgggaagctgttaaaggattttaggcagattaataataacatgtttagatttatagtttagaaagataatggcaatgttcagggcaggcgcaaggtaagagcgaattcagaaacaaaaagtacatttcggaaggttattgtggtagtctaggtaagaaacagatgataatagtttgagataagtttgtgttttgtttttttgagatggagtcttgctctgtcacccaggctggagtgcagtggtgcgatctctgctcactgcaagctccgcctcctgggttcaagcgattctactgcctcagcctcccgagtagctgggactacaagtgcgtgccaccacacctgactaattttttgtatttttagtagagacggggtttcactgtgttaaccaggatggtctcgatcttctgacctcgtgatccgcctgcctcggcctcccaaagtgctaggattataggcgtgagccaccgcgcctggcctgaaataaggttttatcggtagaatttagcagaaactgattcatgacatatgtaggaagtagaatttggattaaatttagggttgaggaagaggggagggtttgcagctcacttcttggtttccagcttatgcaactgggcacatggcaaaactgttactagaagaggagcagatggacatgctaaagatttatttacagggttgctgcatacaactacaatgtaaagggactcctgcaaatgtgtaatgaggtggccctggtttgccctggccatctagtttaggtattttgaccagtcattctaatattagctcctaattaagcatgactttggtcatagtagacatccaataaaacgtggttcagggagcgaataaatacataaagtccaaacccctatgtttaatgtataaaccctgagggtcaacacaatctgatagttgattgattgattctagggactgttagcacagaagagatagtaaaatatttactctttcattccatgggctaattattggctaggtatgtattttaccattatttttatgtatgtaccctaccagtttttttaaaccagggagcaaataaatacataaagtccaaactcctatctttaatgtataaactctgagggtcaacacatcctaatagtttattgattgattctagggactattagcacagaagagatagtaaaatatttactcctttgttccatgggttaattattggctaggtatgtattttattatttttatgtatgtaccctaccaattttttaaaaaccatttgataaaacacaggaaaaagtttggaatttgaaaactatatatctacatgggaatatttctgaaatgtgagaaaagtgttatttactgaactaaggatattttggagaaggtgtattgaagatttttaaaatttatttcattattttttaattaaatttttttagttgcccagtaaaaatggtatatatttatggtacacaacatgatgttttgaaatatgtatgtgttgtggaatggctaagtgaagctaattaacgtatattacctcacattcttatttttttgtggtgagaacacttaaaatctgttctcagtgattttcaagtatacagtacattgttattaactgtagtcacctcaagcatctttttaaagctttttcagataaaattcgaaaagtggttattttaatccatctaaaattgtatctttactgtaaactgaaatttatttagaaatcaacactacaattaatgacttaagagttttcagtataatgttcaatctaggtgttggctagctttataacaagaataaagcactcaaataaggcaaagatgttttagtttctcccttcccctgccaaaaacaaggttgggaaaaggtctctattttgaaagcattacaagcaattggagcttcagactggccttgtggttaatatttactgtttatctgctgaaacctagacaaaaatgtcaccctgccctttgaacagatatatgattactttgtgaggtaatgggcttggggagggaagagaaaaggagagagggagagagagaacatacctctccttgcctatcttagagaagcaacatctggtatatggaaactcagcttgcagctgagtcaggcagccttggatttggataccagctctgctactcattagctgaatgaattcgggcaagttaactaacctttttgttttagcttccttatttgtgaaatggcagtaatactgcttgacttccagggtggttgtgagaatgagagatcctgtcagtcactgctagctgttgctgtggttatcatccagaggctttcagtcagtagcatccattgggctagcaaggctcaatctcgactagcttcattatgacctttctgttgtcccatcagggaattcttcctgggtaagggcaggtacagggtgggattgtaacagttattccttttttttcctcctgaatgtataaagaaatcagttattgttttactagttttagacctattcaactatttttcattacttaggtctctgacaccatgctacagatcactctaacttaggacagggacctgactggcactgttcctttaattcctcgtctacggaatgaggctaatttcactaaacctttgaatcgctctaggaatgtttcaagaattaaaggagatcagatcgtacccaattctttcaagtctcttataggctatataataaaaataaggtggaattttaaccccacaaagagggttcctgaggaggaagttaagagaggaaggtctaagagtgaaatttaaatgtatttatctactaaagcatttgccttcttgacagaatacttcctgcaagttactcagtcttttaggtgctctgttttcacatatgtcaagtagagacagaacatctaagttctggggttgtcgtcattgatttcataataaaatacagggaaactacttaccatagtgcctgggacataatagttgctcagatatccttttaggaggaaatacccatctttgatatcttcattggatttttttttttttccgagatggagtcttgttctgtccccccaggctggagtgcagtggtgcgatcttgactcactgcaacctccatctcctgggtacaagcgattctccttcctcagcctcccgagtagctgggattacaggtgtgcgctaccacacccagctaatttttgtatttttagtagagatgggggtttgccatgttggccaggctggtctcaaactcccgatctcaggtgatccacccatcttggcctcccaaagtgttgggattacaggtgtgagccaccaagcccggccttcattgagtattaaatagccatccacacagggaccctgaggatgttgaataatatcaagtctatcctacagtttttcttttgattggattttggggttagaggtttaaaaaacattctggtaattaggtagtaagactattagacttgccatagtaagttagaataggctcattgttcacagaacctaattttatcttagcaatagtgaggtgtatggtaaggaaaggcctggtttccctcattgacatcagtcccaagatcacaggtgtgaatcttgttaaaactttagaaaagatttgtgtattcatactgccccttgaggtaacttacttaggaagtaaaatcatctttatttttctctcagattagcctgtttaaagatttatcaggtgtctggaaggctgggatttagtgaatgaatttatgtctaccttgtgagtattggccgtaggtttattgacttcaagtttaattagagtttgagactgattgtgtcctcatggcatagattttccctcttgtttgtgcctcctagataatttcagttgttctcaagacgagcacaagatcttttcaatctttattgaaatgtggcaatcagtgttgcagtgttaagattttgaagcctggcacaatggctcacacctgtaatcccagcatttttggaggctgaggcgggaggatcacttgagcccaggagttcaaactagacttgacaacatcgggagaccccatctctagaaacaattaaaaaaagaaaatagctaggtgtggtggcacatgcctaggaggctgaggtgggagggttgcttgagcccagaaggtcagggccacagtgagccatgattgtgcactgcattccagcccgggtgacagagcgagaccctgtctcaaaaaaaaaaaaaaaaagattttattggagcttattttaatgactgtttaatgacttctcttttctgggttttatttaagagatcatttcttatctttcaggtcttgttgtttcttttatacttccaaaggcttagtacttccatgttatgcccttctagtgtcattagcagacactagtatattggtttaaagatgtaaaaccagatgggccattgaaaacatgttcacacaaaaacttctgcacattcatagcagtattattcacattagccaaaaagtgatgacaaccttgatgttcatcagctgatgaatggataactgaaatgtggtatatccatacaatgggatatcattcagtcataaaaaggaattaagttttgttgaatgctgcaatatggatgaacctcgaaagcgttatgcttagtgaaagaagccaggcgaaaaagaccacatgttgtatgattccatctatgtgaaatgtctagaagaggcagagccatagagaaagtagagaagtggtttccaggagattgggggaagaatgagttgggcctgactgctaatgggtatggtgtttctttatggggaattagaagggtgctgatggttgcaccacagtgaatgtactaaaaatcacttaattgtacactttaaaatggataattttgttatgtaaactatatctcaataatgataaaagccaaatgggccaagcaacaatcccctagagcctttattattagcttttctatttactaaaggtcccaaattagcttttcctctttaagcaattacttttttcagtaaaatatcttcaggtatcatgagggatgtttaaaaaaggagaggtgatagttgtggaattgtggcaaaagcttttaatttagtttttaaaattattgttttttaattataaaatacacctacaatttaccatcttaacaattttttaagtatacagttcagtggcattaagtgcatttacactgttgagcaaccatcagtatcatccatccccagaactcttcatcttgcaaaacaaactctctatatccattaaacactaactccccgatcccctcctttcagcccctggcagccacccttttactttctgtctcttaggaattcgactaccctagctacctcttataagtgggatcatacagtattttttccttttgtggctggcttatttcacctagcatgatttttcaagatttattcatgttgtagcttgtgtcagaatttccttcctttttaaggctaaataggattccattgtatggatagaccatattgtgtttatccagtgaaaaactattttaaagcagtaatcctttgccttacctaccctttgttcttcctggcttacccttctcccccccaccaaagcaactgtagcaggtcctggaataacacgttatttccttataatgttgatgagaaagaaaatcgactttctgttggggccactgtccctgtggcgtttgcacattctcctcatgtccatgtgggtttcctcccacatcccaaagctgtgcacattaggtttattggcatgtctacactgtcccaatgtgagtgagcatgccctgtgatggttcctgcctggtaccctgagctgctggagaggctcctacacccatgaccctgatctagaatcactgggcaaataattatcttgtttttactactctttcttaaatatatgtgtagcccacatttatttccatgtttaatgctacaagtgttttagactatatttagaagtttggtgatgtttttgtgaccagaaatgtgccataggaacttaactcttgtttatatcaattagcctacagtaaaaatttttttttttttttttttgaggcagagtctcaccctgtcaccccagctggagtgcagtggtgctatctcgggttactgcaatctccacctccctagttcaagcaattctcctgcctcagccccccaagtagctgggactacacgcatgcaccaccctgcccggctaatttttgtatttttagtagagatgggggtttcaccatgttggcgaggctgatctcgaactcctgacctcaagtgatcctcccacattggcctcccaaagtgctgggattacaggcgtgagccactgcacccggccaaaaaactgcttttgttatatactacgttgtttggctgaaagtcacaatttccgagaacctaccaatgacattacgtgaggacttacactgtacttctctttcagctatttctaatggtacttatctatatgattgtaaataatacgctttcttgatttttttttgagacggtgtctcgttctgcacccaggctggagtgcagtggcgtgatcttggctcactgaacctctgcctcccaggttcaagcaattgtccctgcctcagtctcctgagtacctgggattacaggtgcctgccaccgtgccaatttttttttttttttgagatggagtctcgctctgttgcccaggctggagtgcagtggcgcgatctcggctcactgcaagctccgcctcccgggttcacgccattctcctgcctcagcctcctgactagttgggactacagatgcccaccaccacgcctggctaactttttttgtatttttagtagagacggggtttcaccatgttagtcaggatggtctcggatctcctgacctcatgatccgcccgcctcggcctcccaaagtgctgggattataggcgtgagccaccatgcccggcgtgcccggctaatttttgtagttctagtagagacgtttcacgatgttttgccatgttggccaggctggtctcttgtgatctgcccaccttggcttcccaaagtgttgggattacaggcatgagccaccacgcccggccactttcttgatttttattacttctgttttatatgttctttcttcacgtcctgttgtgatagctgacaattttgctcacttttgttctcacctccctttcccgtgacttttcatgataagtgtgttacaatttttggttctttgccttttagaatttaagtaatacattaacatctttatttcttgttccatcaaatgtggacagtatcttttgactcctcctttttaagatgaggatatcagtgcctttgccctccactttccttgagctgttcagcctaccttccaatctatgtttactttgtattgttgaggctgatccatctaagtttattttttttgagatggagttttgctcgttacccaggttggagtgcagtggcgtgatctcagcttaccacaacctctgcctcccgggttcaggcgattctcctgcctcagtctcccgagtagctgggattacaggaatgcaccaacacgcccggctaatttttctatttttagtagagacggggtttctccatgttggtcaggctggtctcgaactcctcacctcaggtgatccaccttccttggcctcccaaagtgctgggattacaggcatgagccactgcgcccagccaatccatgtatgttctataaccattagccttccaataaagtagaaaatcagtactcagtgcttacattattttgattgtgaaaatatcatttgcagcataaccattgatcactttgattacatttttgcatacagcttttttcccctagaaattttaattgtctcctttcccccttgtattacctttttttttcttttgggagacaggatcttgctctgttgcccaggctagagtgcagtggtgtgatcatggctcactgctgcaaccttggactcctgggctcaaacagtcctcctgcctcagcctcctgtggagctgggactgcaggcatgtgctaccacacccagctaatttattttatttgtagagatggggtctcactatgttgtccaggctggtctcaaacttctcgcttaagtgatcctcccaccttggcctcccaaagtgttgggattacaggtgtgagccaccatgtttggctgtaggttggtttgtttgtttgtttatgcattgtattttcatgcatgggagccctttgaatttggagatttcctctaatagtagccactagccacatatttggctaaataaagttgttaaaatgaattaaacatacagttcctgcgttgcaccagtcacagttcaagtactcaatagctacatgtggctagtgcagagcatttccttcatcaaagaaagttctgttggttagcactgatctgcaggctcagtgaaattgcaaacaatatgatgtctttttaaaaacttgagacaggccaggtgtggtggcttgtacctgtaatcccagcgctgtaggaaatggaagtggaaggattgcttgaggccaggagttcgaggccagcctgggcaacacagatcccatctctaccaaaacaaaaacatttatttatcatatattacaaggcaataggggcagttagagtagaaattgacaaaattcagaaagaagctgaagagaaaaaaatatgatcaaggtaaaagccaccagagaagcaacaataagaaaaaatgtatcttagcatatagccaaggacagagggattgggctttaagaaatcacaaaatgaaattgtaagaaaataaaattgtgaaaatgcttatggagaaggaggatagatatggagaaagataaaggatacaaacacacataagtgaaattccagaagagaacaactaatgaactagaaaaatatttataatgggagatttttttcctgagataaagattaggatctttcttgttccaagaaattgtcaaaatggtaaaacaagcaaatcataatcatactgttatttagtgaactttaaggatcaagaattacagggacatccacacacaaatgctcaatgctaggagacagtggaacaatgtctgcaaagttctgaggaaattgtaacctaagagttttgtactcagccaattcattcttcaagtaaaggccatggaccaacattttcaagtattcaggaattcagggactgtagtacccattggcctttcttgacagggatgggggaactatttggtattgaatctagcagatgaaaggatcaatcaatagaaagaaccctagaatggagaaactgattttaaaaaaactagaaatgagcagtgaattcatttaatataaaactagctataaaatatttgggggagtggagaagtcaaaatgttaacttccacatctttcacatagtgacagtagatgctggctctaaaacttatttgtgtattataggcaaaatatggatgcttttataatattttttcttttatttattttttgaagtggggtttcgctttgttgcccaggctagagtgcagtggcacgatcatgactcactgcagccttgacctcctgggctgaagtgatcctcctacctcagcctcccgagcagctgggaccacagccccataccaccatgcccagctaatttaaaaatttttttagagatggtctcactatattacccaggctgaagcaatcctcccaccttggcctcccaaagtggtgtgattataggcgtgagccactgcacctggctttgttttttttttttttttttagagggttaagaactaatatcttaatgaccaaacatttacttgaagattagcattcatatatttaacgaatgaatgttgcttgcttactctatatgctgggcagtattgtaggcacttggaatacattagtgaacaaaacacagggaagtttctttcccttatagacattacattctagcagaggtacacagatataggtgagtaatacagcatattataaggtgatacgtacttagggaggtaaaaagcagtataaggaggatttgggttataagtatggtcagggttttgctgagaaggtaacatttgagcagagacttatttttgagacatctgatagacaccaaagaggaaatacatgtacaaatctgagttatggagacaggtctagagtggagatgtaaatttgggagttgttggtacatagatgaaatttaagccatcagacagaaagagataaccaaaggagtgattgtagacaaactaagactaaggactaagccctggggtttgcagcattaggcggtaagaggaggctccagcaaaagagtgaggaggcatggtcttggttagtgaggtgagaggaaaccaagaggttgggtcaggggagccaagtgaggaaagtaaatcacagagagtgagcatctgtcagatgctgccgctgcaagtcacacgagggctgagaattggtcacgagtgaccttgatgaacagttttggtgaagttatgggcaaagaatgacctgattgaagtgaatctttttttttttttggaggcagggtctcactgtcacccaggccgaagtgcagtggcacaatcacagctcactgcagcctcgacctcccaggttgaggttgtcctcccacctcagcctcctgggtagctgggactacaggtgcacactaccatgcctggctaattttttaattttttgtagagataagggtctcgctgtgttgcccaggctggtctctaactcctgggtttaagcaattctcctgccttggcctcccaaagagctgggattataggtgtgcaccgctgcacccaaccttgaagtgactttaaaggatgaaatgaggctaatttgagaaatggaggtggtggagaaatgggatcaagagtttttgcttagccgggcacggtggctcatgcctgtaatcccagcattttgggaggctgaggtgggtggatcacctgaagtaaggagttcaagaccagcctgaccaacatggtgaaaccccatctctattaaaaatacaaaattagccaggtgtggtggcgcacgcctataatcccagctacttgggaggctgaggcaggagaatcgcttgaacctggaaggcaaaggttgcagtgagctgagatcgcaccattgcactccagtctgggcaacaagagcgaaactccgtctcaaaaaaaaaaaaaaagtttttgctcgttttaagcaggggagaaagaatggcttgtttgtatcctgatgagaatgatccagtagaggatgcagggaaagagaggggagaggtgctcaagcagtgaagggccttcagaaagaggggatgggcgataggaaggaacacaatggtttgtgggaacaggctgaagacagcgtttatgggcttagttgctggtaggtggattagatgtgctagcaaatcttctcttctgattgtttgaattctaggtgaagtaagaagtaagtgatgatggggaggtggtattagacatttgaggggagatgagaatagggaaaagaggagagaacagaaagtagcagaaatggctcactgcaggttcagggttatgaatttaaagtgaaaccatctgctgggtgtgtgtttgtgtttctgtgtgtttccagccacatttagctacataggtgctagtgcagaggcaaagaggcaaattgtaaagtgtctgattgtgccaagcctgtgtgatgaaacaaaagaaggggtagggaaagggaattgagatcgtgggcaagggaatgggatcgactttggagttaaaattgttttgttgttgagtttaaattctaatgttgtacctttgtttaaaaagagcatgttacaatatcttattttcacaaaaaaatctctgttctttcttccatccttttatttgtagtatgcgtggagaaatgtctaatgatctgtaaattctgttgatagttcccagtggcaggattttgagcacattttcatttctttcagaagatgaagataaaggtctgagttctaaagacaggcacctcactttctcttccacctctcacttagtagctcactgactttgggcaaatcacatgccatttcagagcctgtatttctttatctggaaaagatgagaatcagatgtaataaaaaaatgtagaaatgctaaggatattacaaaatgccatgcaattggtagttattattagaagtagtcttaatttccagaaattatgctcttctattttggagaagccttattctaaagctctagttcttcattactacattaggagaaggcacttatgcaggaatcataggtaggatgactcaattttatcgaagccttctttgtctgtttttagaaattcatttttaataatggtagctttaaaatcatagtgaaattttgagtacttaacaggaccataaaagtgtcttttttaaagataaatcattcctgtaacatttcatattcagaataattttatagattgagttagtgggataaatgttcaaggtgaaaatctgaaggtgaattatatttatgtaatagaatagctttgctaccaggtaagctcatatatttggaatgtgttttccctcacatttgtgaaagcaaacaaagggcttttactccaagttacaggtaaaaccatgacattttgcaagctctaaaatgattggattttctagtcatcagaggtttaacctgaagggtacagacaaattgacatgcaaaaacaacaagcctggccctgttctttgtaaacacaaggacattggattttccagtacttgttagaatcagttttgacaagccttgtcaaaagaggccagctttatcaacaacatcaaactgtttcgagttgagttatccaaagatgttacagatttctgcctagtttggtgataactttatccctccactgctacctcagtttgaaattccaaaccacctttaagaaaataaccttggcccagttagccgggtatatcataaaaatagctttgaaaaagggtaagtacatatcagtccagaagtaagaacattaatattgactctttctccctacaaaccatttttataaagcataatcaaaatactttaatttagatagttatgtccagcgtttagagaacctgtagttgttttctaactgcaaagactttaaccagttggactctttaagccttcatatcattaagcttgtcctggatcactcattttctctagtttctcaagctcttaacccagtctgttgttttctcactgattatccaagttcttgcctcctgtttcatacctatgattgaagccaccagccatgaactacaactttctgcattatcaccttccctgcttccctaaacccagcatagctacattctcattcaagtctcagaaggatagcatgtttctcttctatttaaggaaaattccttcatctttgctcctagtttcatttatcccttttcctctgagatctggatcccaaaatttcatcatgtgctctggcttcagtctctcactttctattccgttttctcccacagactgagcatgcttgagtatttttatctattaatactaaacggaaaagtccttgactctgcaacccattctagttattgtccttttgtttgcctttttacatacttgaagaaattcacatgttccattgactcctcagcccactctagtctgaccccctacagccttcactccactgattttaaccaagaacatcagcgacctcatgctactacggtggacattcctcctccacgttccttcttgtgtggtgctgcattattgccatgggccttactagggttcctgcatcttttaactccctagcttccttcatgcccttctactgccctctccagctttcccttctctggtttatgaactactcttgcccctcccttcaactgtggcattccccaggactctgtcctcacactgcagattctcactgcatgatggcaaagcttagttaacacagttgagggctccccaaagtgtgtcagccttccaatttcagacttgaatattaagcagctggcttcacatctcattcattcagtgaatcgttgattcatcaatattctgatcatctaccatcaccagactgggtcttaaaagactgagtaatgaaaatacaggttctgctgtgtcaatgggaaagacggggagaaaaaccagacagtggccacacagtgaatcacatattccaagagaagcaagcaaagggtgccgtgagcacaaagcaatagtgacaatcactggttcttagggcttttcaggacgttattcttaggaccttaagttaatcaaacatgcaggaagagagatccttttcctcatttctctcacatttcttaccccagtcactcagtcacctaaatttaaacccagttatccttggcttcttcgtcatgttgggttttcagtcagacaccaagttctactcatttcagtcccaagataggcctcaaatccagcccactccgccagttgtactacctccgtcctgattcaaggcctcgtcatctatcacctgcattactgcagtagactcaggtcagctccatgctttgatctcattggatctacctttccaaggccagcaaaaacgggcacctgacttagtcactgctccgtgtgaaagtctcccagtcctgcagcagatgttctccagcctctcatcagagtcccagaggcagggcgcccctaaatctgtctctatatagcgggtcccagcgctgcagattctaattctgtagagctgctggactggatgctttgtttttaaattccctaagagattttgacacctgaccagattgagaaacccttggcctgcaaggataaagtcggagcccttctgcctgtgcatgaggcccttcatgacctggcttcagcttagcagtcggctgcatttcctgccatgtcctgtgccaccctttaccctcacattccagcaatattgaaccatgcattcccttaccatcacgccgttttgtgtctcccttcatttgtcccctctctttctcttcacctgagtgaggtatctttcctttgttcccatggcagcgatcagtgcacagtgatatttgccagtcatttcagactctcatcctctcattttctgtatcagtttattaaagattgcattagagggttcaacattaatgtcatcttacaatatacataaataagcttttgcttttttctcataaatgaccttcatttcaatttatgtaggaaaaagtataatttatcaacaagtgcatttttaagtgacttgtttggttttgaaactgaaggtatattaaaatgtagtttgttgattagtgatatcaaaaatagaccaaaacaacaactgctttcagtgacccagagtttgggaatcttgaactttgcatttgaaacaagctgattaaattttataatttttatgtttgtaaatgacaaaggtttggggctgccattttcaagcttttctttgcaagtaatttgggatgtggatggtcttgattctcagtaagtcagaagttaagttgacaaattgtcactgtatttttgctttttaatgttggcttttgagatattagattcatcttgatgttctgtgtaagaattttgattaggtaaacacagtttttggatctgatggagatcacgacagaactttgcagaagtatcatttcaaagacgtcagaatctgagttctgtcttggtataactggtgtaaattacacaagggatgactgtgaattttaaaagttatagtggtcagaaccaccaccacctagccttggttgcaatactgattatgcctgcctgagtcatgagcacattcatttgtttttcacgaaaagaaagcatgtttagatagttacactattttctgatttttcaaaaatcacagttgcctctaccaatttaaaccccatgctccatattccagaagttgacgagccctgattgggactaacgtagcttgagatctgaattgcgtgactccagataagttactcaacctctctaaacttcagtttgctttgctgtgaaatgtagagaatattgtaccacctgcctcacagggttgttgtaggtattaagtagtacttaccataatcacttagtaaatggtagctgcattattattactacatttaaaaatactcacctgtttacttgtccactttgccataagactgtaaatttctggagcccttgactttttcatatttgcatctccaatacctgcctagagtctaatgtagttgtgattcactgtttgttgaactgaataaaacaatgtccatccaaaaggaaaacagatatgtctagcagaggaacaccagaaagggaactaaaagggcaaaggggaaatgaaaaggcttgttgttgcaggtattacagacaagctcaatgagccttcttttctgggcctcggtcctgctcccctctagttggtcttccaccatgtcagataggccagctgggcctagagcagagagaacattccttcagtgtttcactaatggactcaacattgaaaaaacccaactttttgtgataaattaaattgtattgggtgctaacttttcattagtctttgccacactttttgttgagctagacatagcagtgagtgtccataagtgacatgtaatgtaaggctacattatatggggattatgcttttggtatttattcaaatccagagtctgttatttgaagacaccattttttgcagctttattttccaggtcctgtgaataacaggacacttattttcttggctactttgtaaagttttaaaaaatgtgatgtttggctgggcgtggtggctcacgcctataatcccagcactttgggaggccgaggtgggtggatcacttgaggtcaggaatttgagaccagcctgaccaacatggcgaaacctgtctctactaaaaatacaaaaattagctgggtgtggtggcgggcatctgtaatcccagcttcttgggagactgaggcaggagagtcgcttgaacccaggaagcagaatgagccaagattgtgccactgcactccagcctggatgacagagactctgtttcaaaataaataaataaaaataaaataaaatataaaaataaataaatgtgatgtttgttgtatatcccctgagtctctactattggaaatcatatgtacctcttttttttttaaatttttttcctctttttctccccttctgtctctctctgtttgttcattttttaacacatacaggctattataccttcattaatgagagcaatgggtatatgagaatatgtttaaattcacgtattgctgcatttgccagcaaggacctagactcattattgtcataaactaaagttgtgtgtgtatgttatgcatatttacatttaagcagattgaagctgaatttccattgaccaatctcattgtggtgtacctttctggcaatcatgttttgattattttcaaatgtattattctattgcaaatagatcatatcaagtgatattcaagaatagtgaccacgaagtactgcttataaaatatttatatgaagactatttcttgattttacttctaggacattcttctaagtttttttgttgttgttttgagacagggtctcactctgtaacccaggctgtaaccttcacctcccaggctcatgtgatcctcccacctcagcctcctgagtagctgggactacaggcgcatgccaccatgcctggcgtgtgtgtgtgtgtgtgtgtgtgtgtgtgtgtgtgtgtgtgtgtgtgtgtattttttttttttttggtagagatgggggtcttgccatggtgcccagcctggtctcaaactcctggtctcaagtgatccacccaccttggcctcccaaagtgctgggattacaggcatgatccactgcacctggctggttcttttaaggttttagtattagaagatctttaatataagagtgcttttaccttatggcttagcaaaggctgttaagtatattcttttgtatttacagttttctaggctaccaggagttttctctatgtatagtattttttgctttaatatctgattctgtttttagaagtctttagaaatgtatttattgaatcttctagttgtctaggtaaaatccaattttatgtgaatcaagttagagattatatttgtaaaagaacttttgccgggcgcagtggctcacacctgtaacccagcactttgggaggctgaggtgggcagatcacgaggtcaggagatcgagatcatcctggctaaaatggtgaaaccctgtctctactaaaaatacaaaaaattagccgggcgtggtggtaggcgcctgtagtcccagctcctcgggaggctgaggcaggagaatggcttgaacctgggaggcggaggttgcagtcagtgagctgagatcgcgccactgcactccagcctgggtgacagtgagactccgtctcaaaaaaaaaaatttttttttttttttttgcgaatagtaacattttatttaaatatctgttactatttgtgatttatttccttcctttttagtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtaagaagaagtgtttagacattatacatcctcatccaaatgtttcagcctgattacttttgggttatttagattgagaacatttggagtctcttctgaagtaacttttatgtaagaattccggtgtagtaataccaaagtttgtaaaaagtaataagaaaattatgtaaaaagaaataggtggaaatgcagttttcaaataaattattgaagctgtcttcttccctgattgataggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaagtaagtaggtggcctttttgtgggagaaaattttatgtttctggagcttttaagtggccagtgtttgaaataagtagcattattttagagattattatgctactacattccaagggaaacatctttgactcttttatatatgcttatgatgttgctttaaaaccaagttatggtgaaagccaagaagtaaatgattcattcaacaaatatgtattgagtgcttactacgtgaaagctatgttctaggtatgtaatatttggaccatctttccattttgtctattaactgaattcaaataaaaacgtgtttcctgtgatctctgtaaacctggtcacagaagtttttgtaactttctacttagatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaagttgcccagcagctcttagcattgaagaagttggttcttaaacatgaatccatgattgaaaaatggtttctgtggtcttaggtttcagaagtctgaaataccagtatcctgtaaggattatttgaattgaattagagtataaagtctactttttgtctttatttttaacaggaatttccttcatgtgtatattatgtagaaggaagtactgcaagaagtacacaggctttcaggctgaaagttttcatcttgattatgtttggcccatgactttttcattttgggagacaacaagggagtccatggcgcaaaaatgctgacatgtgttttttagctttggaagctaggcgtttcctacggtctcgcgataataaatgtgctcataaaacccatgacctagaatggggaatttctgtcattcatgagtatcatggcttacttttcgttgttgtagttaatgaagaattcctaattctttaaaatttataatactgtataattttgttttttaatacacattgttaggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacaggtgagggcgcacgagttccatggcgcagcgtgctctgcgagctctcagaggaaactctagtatgtatccacaggggtgtcacaatggcattttagctgctagaccatatatagctttgtctattgaacttgaaaatataattttcagaattcagtgatattcatgaatgatttccttggataaaaagaaacaggacatggctgaaacatggatgagaaaaattgaaaacttggatgatttttatgtgtacatggaatgaaatccctcaaatatgttataagcattaactttttaaataaattaatacatttagagaatctatgtcagcataaagcaggcataatttacagagcagcaggataagtactttagttcatatgacattcctattcttgtatgatgatttgcgtattaaaaattttatgggtatatttaaactttgctgtaagttaacgtaagttatgttttttggaataaacagtggaaatttttgtcaccaaagtttatttttatgaataattttccaccagtttatttacttatttttttttgaggcagaatcttgctctcttgcccaggctggagtgcagtggcgtgatctcaactcacactgcaacctctgccccctgggtacaggtggttctcctgcctcaaccttccaagcggctaggattacagatgtgtgccactgtgccccactaattttcatatttttagtagaggcgggttttcagcatgttatgttggtcagggtggtctcgaattcctgagttcaggtgatctgcctgcctcggcttccgaaagtgctgggattacaggcgtgagccaccgtgcccagccaattttccaccaatttctaaattgctgtaggtttaatcactaattgataaaagttacatattcattaattttattaaactagagggagtgaaggcggtacagtcttcatgaaggaagtttccagaccattttctctatgactaggttgctatatctcttgtgttgaaaaacagtaaaaggaatgttaagcagcaaatagtccaatttaggagtccttggccaacagtggtcagaacccacactttatattcgcaaagaaactggaacagaacttggtttgagcactcatactcctttcttttccttttttagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttttaa

SEQ ID NO: 17594 - DNA, 70323 bp, Human
gatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccaggtgtgtcacataggtgatttgcttgctccctgggggagagggtggagtgaaatttttgcatttgtgtcacagccaagtcactgccacctccagcatgccccagtttttagttcttatgtaattttgtgcaaaattgaaaatttaaatacattgcaaagaagatctaaaataaatatttgagctgctggagtctttttttttttttttttttccttttccattcttgtccttggaatctgaatgaattgcagtgagggtaattttgagagtctgataaagaagtgaggggttgttttttgtttttgtttttgtttttagctaagaaatttagaaaacaggtttgtgtgtgtgcgtgtgtgtgtgtgtgtgtgtgtgactgattttaagattcttgttagagttgcttaaagttggaagcctaaagtcagtgagaagttcacaaatcaggactttgtaatgccaatttgaaaatttagcttttgacctcaaaaaacattttttatctagtttgggaatttctaagtgttagaaatcaatattatattgactcattcattgttgctgatgctgtttataaaagtgaatagatagggaaatactgattcatatctcgtgaaatgaaaatgaaaggctttttagtgacttagaattttaaatatttctacataagagagcagtagtatatttagaaataacaaagtaactggcaactgtttaaaactgaagttaattcacagctatccagtgcaaaacttcacctcaggtgatacacttttgacaggtaatacatacagtaagtgtatttttagggaaacagtttcattgttgaaccaagataatcatcattagaatgttgtatctgatttaagtgtctttaaacttaccaaggtattagattttagtttgaattgtctggagtagcggtagcggttggcacatttgttcttaaagggccagaaaataaatattttaggctttatgggccatgtggtttctgccacaagtcctcagctctgttcttttagtgtgaaagcagccatagatgatacctaaatgaatgagtatggctgcatcccaataaaacttcatttacaaaactacatggctggcctaagctttagtctgtctgcctagggagtagtttactgagccactaatctaaagtttaatactgtgagtgaataccagtgagtacctttgttaatgtggataaccaatacttggctataggaagttttttagttgtgtgttttattacacgtatttgactttgtgaataattatggcttataatggcttgtctgttggtatctatgtatagcgtttacagtttcctttaaaaaacatgcattgagttttttaatagtccaacccttaaaataaatgtgttgtatggccacctgatctgaccactttctttcatgttgacatctttaattttaaaactgttttatttagtgcttaaatcttgtttacaaaattgtcttcctaagtaatatgtctacctttttttttggaatatggaatattttgctaactgtttctcaattgcattttacagatcaggagaacctcagtctgacgacattgaagctagccgaatgtaagtgtaacttggttgagactgtggttcttattttgagttgccctagactgctttaaattacgtcacattatttggaaataatttctggttaaaagaaaggaatcatttagcagtaaatgggagataggaacatacctactttttttcctatcagataactctaaacctcggtaacagtttactaggtttctactactagatagataaatgcacacgcctaaattcttagtctttttgcttccctggtagcagttgtagggaaatagggaggttgaggaaagagtttaacagtctcaacgcctaccatatttaaggcatcaagtactatgttatagatacagagatgcgtaataattagttttcaccctacagaaatttatattatactcaagagtgaaagatgcagaagcaaataatttcagtcactgaggtagaatggtatccaaaatacaatagtaacatgaaggagtactggagtacccaggtatgcaataggaatctagtgtagatggcagggaagtaagagtggccaggaaatgctaagttcagtcttgaaatgtgactgggaatcaggcagctagaagcatgagcggcttattccaggcagaagtatgagccaaagttagaagcagcatagggagtaggggacaataggcagttgaggacttttagatcataaactagctgagaggtaggaaaatgaagaagataagatgtgatagaaggtattagggagtcagcaaagaatttgctcagtaggtagatagtaagtttgtcaaacgtgtatttttaataaccttgcaagagagaaaggattgaagagaaacgtgtggtggtaaggtagttcagtcagtgagagccttgacaatgacagtggtataataggaattcaaaataaatttttctggatttaagacaaatatttaggacatgaagtaagtaagactttagtgatttattgtgaagactaaagatgtttcagataatagaggtagtaattatcaaagcaaagtttttcgaggtattaagggttggaatgaaaaatacaggtgtatctctcatacaggtaatataaaaaaagaaaaatgcagatatagtgattgaccttgaataagaggaaagatgcccatctaatgaaattagaacaaggaagtaaagatggatgtgtgatattaattgtaattgtgggtgagggtggaaaaatcaagatttttttactgaaaatattggaaccttatttaaatgccggtatatattgtgaatctgcaagaaacgactataaaatgtatttctcaaatttatgtgacccaaccatgtgacttgtcttttaagctttaaaaaattgtagtaaaatacacataatgtaaaattttccatttcaccatttttaagtatttggctcaatggtattaagtatattaatattgttgcacagtcacgatcagaactctctgttttgcagaactgaaactctgtacccattaaacaataattcctcatttccttatcttcacagcctctgacaaccattattctactttgtgtctaattttgactgctctaagtaccccctataagtgcaatcatacagtttttgcccttttatgattggcttattttacttcgcagtgtcatcaagtttcatccatctttagcatgtttcaaaatttgcatcctttttcaggctgaataatgttttattgtatgtatataccacattttgcttatccatttacctgttgatgagcgctcaggttgcttccatgttgtagctattacagataatgttgctatgaacaggaatgtacaaatatctttttgagaccctgctttgaattgttttcccagaagtggaattgttggatcatatggtaattttatttttaaaattttgagaaactgccatactcttccagagcaactgtacctatttgcatttctaccactagtgcacaaggggtccagtttctctacatccttgccatcacatattgtgtgagagtgtgtgtgtgtgtgtacttcaatagtagtcattgtagtggatataaggtagtatgttactgtaggttagtgaccacgaaactttttatgaaacattttttaataatattttgtggaatacaaggtttgtttagaggttttgagaagactgaaaacttaggaagctactgaggggaatgggtgaagaagtggatcagaagttgagagtcttgactggctggctacctgaaatcagaaaccgtatcagagtaggagaatctcattccactgagtgactagttaagattaaagactttatcacatttgaaatttaaagacttttctccaatagccagaagattatgcatggtattttagggttggatattagcagagctgatggaacagaatcattagtggcatgtgcataagatgttaacattggagtatttgaatttatatgctgtggatgatggccatgattggaaaggttgggatgccagaccaaagtgttgagttgttttaagaaaagcctgaggtctagataacagcaagatggcagactagcactttgcagcactcatctcattgtagaaccatcaatttgaacaactgtctacacacaaaaatataagagctaagaaaccagacgagagattacctgaatgtggcacacagataagaaaagacacattgaaaagggtaagaaggacagttttacattacttgtgtcacacctccctcagtccctgagatcccagcatggagagagagactgttcacctgggggaaggaggggaagtgtacaccagacttagaccctaacattgagctcgccccagtaaaactcaatgctaggcaggcccccatggccccaaacttcaggccaatacccacaaaccaagcttggaggcccaccccagcaccaagctggatcccacagccctaggctctaagcctgtctagtgctagggtggtccctgcagccctgccctctagatcggcccctgtggcctcacatcactgcagaacaagggtccaaacccagtacttggccagccccttgtgatccaaattctaggccaacatccacctacccagccttcacactggtccttgcagatccaaggttcaggctcactctagtagaccaggatgccaggccagcagcacctgtgtaccaaggctccaggacctaccctgctgacccagactccaggccagccccggtagactcaggctgcataatctctggacaggctgactggtgaagggctttacccaataaagtcactctgcaaagactggaacaagtctcagcttcttcaaatgtgcaggtgccaacacatgactacagggatcaagaacagtcagggaaacgtgacaccagtcaaaggaacacaataaggcacctgaaccaaccataaagaaatggagatatatgaactgcctgacaaagaattcaaagtaattgtttaaggaagctcaatgaatttcaagaaaatgcagataaacaattcaacaaaatcaggaaaacagcaatcaaaatgagaaattttgagattgaaattattttttaacaaattctgaagctgaaaatgcaataaatggaatgaaaaatgcaaaagagcattaaaagcagaattgagcaagcagacaaaagaatctgaactcaaaagacaggttatttggctagactaaggaaaaaagagatgactcaagataaaaaaaataaagagttgtgttttttgatgataaaagcaacaagtctttagctagactaagaaaaaaagagatgactcaagttaaatcagaaatgaaagaggaaccattgcagctgataccagagaagtacaagaaataagaggatcataagagactgaacaattatatgccaacaaattgattaccatagaagaaatggataaattcctagacacatgcaacttgtccaagcttaatcatgaaatgaaaaatgtgaacagtccagtgacaaggattgtatcagtcataaaaatatctcccaccaaaggaagcccaagacttggtgactttactgctgaattctagcagacatttaaagaagaactagtacagattgttctcataattttatgagaaatttaagaagagggagtaatttcaaactcattttgggagatgagcattacctagataccaaagccagacaagaactctccaggaaaagaaaattacagacccgtattcttaatttagatgcagaaattctgaagaaaataataactaaattcaacagtgtattagaaggatcatttactgtgatcatatgggatttacctcaagggtacaaggattatccaacagacctgaatccataaaatgtgatatacaacattaggagaacaaaggccaaaaccatgttatcatttcaatagataattgagataattgagaaaaagcatttgacagaattcagtattctcttgtgctacaaaattttaaaaaattaagtatagaaggaatgtacctctataaaataaaggccatattgacaaacacactgctaacgttatactgaatgttgaaaagttaaaagcttttcttttgagatcaggaagaaaacgagaatgcccacttttgccatttctattcagcacagtaccggaagtccttgcaagagcaattaggcaagagaaagaaaaggcatcccagtaggaaaggaagacattgttgtccctgtttgaagatgacatgatcttgtatatagaaaaacctaaagactccaccagagaattgttagaactgataaattcagtaaagttgtaagatataaaatcaagatacaaaaatccgtagaatttctgtacattaatgacaaattatctaaaagaaaaatcaagaagacaattccatgtataataggtaccaaaaacaaaacatgcagtggctcccagtatcagtggttctgcatttgcaaattgaaccaacatttggatgaaaatatttgagaaaaaaatacaacaataaaaatactgttttcttatacaataaggaaactacagtatagcaactatttacatagcatttacgttgtattaggtactaagtaatgatttaaagtatacacgaggatgtgtgtaggttgtatgcaaatactataccattttatataatggacttgagcatccatggattttggtatctacaggagatcctggaaccaatatcctgcagataccgagggatgattgtacttagaaataactttaaccaaagagttgaaaactatgtaacattgattaaagaaattgaagatgatacaaataatggaaagttatcttgtgtttatggattggaagaattaatattgtaaaatgtttttattatccaaagcaatctgcagttttaatgcaatcctgatcaaaattccaatgttaaatttcacagaactagaaaacagtgctaaaatttatatggaaccacataagatcctaaatagccaaagctgtcatgagtgaaaagaacaaagctggagacatcacactatctgatttcaaaatatagttcaaagctacagtaattataacagcatgatagtcacatagaagtagacaggccaggcacagttgctcacacgtgtattcccacactctgggagactgaggcagaaggattacttgaaaccaggagttcgagagcagcctgggcaacatagtgagaccctgtctctaaaattaaaaaaaaaaaaaaattttaaagccaggcgcggtgctgtgtatctgtagtcctagctacccgagaggctgaagaaggaggattgcttgagctcaggagcttaaggtggcagtgaactgtgattgcatcactgcactccagcctggatgacagcgtgagaccctgtcttttaaaaacaaaagaaacaaaaaaacagacacatcgacccacaaaacagaatggagagcacagaaataaattcgtgtactatcagttgattttggacagggtgcaaagaacacagtggggaaagggaagtctgttcaataggtggtgttgggaaaatggaatatctacatgcatgagaatgaaatcagacctgtatctcacatcatataccaaattcaagttaaaatggattaaggtcttaaatataagacctgaaactgtagaactaccagaataaagtataggagaaatgtacatgacattggtttggacagtgatttttttggatatgaccccctcgaagcacaggcaacaaaaataaaaattgatgaatgagatcacatcaaactaaaaagcttctgcatggcaaaaagaaaaaatctacagaatgaaaaaactcacagaatggaagatagtatttccaaaccatatatctggtaaggggttaatatgcaaaatatataaggaactcagacatctcaatagtaagaaagcacctcacttaagaaatgggcaaaggacttgaatagacatttctcaaaataagacatacaaatggccattagaatggctattaaagtatgatgaggatttgcagacaagagatatattgcgcatggcaggaatgtaaattagtacagcatttatggaaaatagcatgacgtttgctcagaaattaaaaaatagaactaccatatgattcagcagtcacacttggatatatatgtatttatatatatatataaataaaagaataaaatcagtgcgctgaagagatctgtactcccatgttcctttcggtatcatttgcaatacccatgatacagcatcagcctaagtgttcatggataaagaaaatgtggtatgtatacacagtggaatatacttcagccataaaaaggaggaaatgctgtcatttgtgacagcagggatgaacctggagggcattgttgaaagtaagccagccacagaaaggcaaatactacatctctcttaaatgtggaatcttaactcagggatgtaaaatggtggttaccaggggctgggggtgagtggactgggttgcagaggtgttggtcagaggacacaaaatttcaattaagaggaatttgttcaaggtatctattgtacaacatggaaactagttaataacagtgtatttttggaaatcactgagagtagattttaaatgttctgccataaaatataagtatgtgaggtattgcatgtattaattagcttgatctagccattccacagtgtatacatattttggaacatcatgtgaatacaataaatatgtatccttttttttgttttttgtgtgttttttttttttttttttttttgagacagagtcttgctttgtcacccaggctggagtgtagtagcatgatcttggccactgcatcctctgcttcctgggttcaaatgattctcctgcctcagcctcccaaatacgtatcatttttatttgtcaccaaacctggtgtcttgacaggtgaaaggagatatgagtatgagtgaaactcttacaaagatagctgagatgatcattgtcagaggttttagtatgtctaacaaagacaagggagtgatttgctgaaatgaggaggtgaagatgtctcaaatttagaaaggcaaatattttgggggcctagagtattgggatagaaccatgtacagggacattgaagtcactttgctgatgatgtaactgggggcaaagtggaggcttaaatatgtgggtttaattgaccagaacagggagggaaagagaaggcattcggttagatgacatgagtttcaaattacaagctgtttttttgttgtttttaatacagggaattttgccgtttatttttaatacagggaattagaagaataatggtggacttaggagttttaggagtcacataaaagggttgcatgataggcagtgcctttggggaggagccaggctttcatgaaagctaagaagttgaggggccattatgtaaagtagttgaagatgggggatagcctatgggtcttcagaaagcctctgggtttctagagatctttctggaagaggttaggaggatgagtcaagtttagaatggaagaggatagatgaagcttgcatttggtagtaaaaaccaaggatgaatgtgtgaggcatgattatttgtcacaagtttccaggtgacactctggcactcagtccttgttgaattaagcaagctttcttactgttttacttggctgtgttaaagtagagtaacaggaaattagacttcccataatgtctcaatagagctgtttaagtttctagccataattggtatgggaatatagctctaaaccttcaaggctgctaccatttctcacattcctatatctagaaactgtagccaggcagcactttcagtgaggtgagtgggtccaggtttgttcaattacttttgtaccaacctaataccttaatagtatttgtcctaatttacaaaaataggtaatgaaggattcttggttttacctcagagctaactgtccattaatggcaacatcccacatttgttgaagcatgattttgttgtttgtactttgacatgcatttgatattttaagtaacgccttgaatgcatcttaaataataatttatatacagttaacactcctgtttgtttttaggaattcttagtgttgccaatttcctaggatgtagaagagcatagtaaaaaaaaaaattattaatactcttaaacaagtgtttttaacaactggacaccattttgtagttaagcctagaaacagaactaatgcaataacccagatcttttcatttattcatatgtttattttacctggatttactttagttttttgttttgtttgcttgttgtttgagatattgtcttgctctgtcataagtgatacagctagagtgcagtggtgtgatcagagctcactacaactttgaattcctgggctcaagtgatcctcatgcctcagcctcctgagtagctgggactacaggcatgtgccaccatgccaggctaaaacagtgtttttgtttgtttgtttgttttttgtagagacagggtctcactatgttgcccaggctggtcttgaactcttggccccaaagtaatccttctgccttggcctcacaaagtgctgggactacagacgtgagccaccgtgcctggccatggattttgtttaaatttataaataccgtgttgtagaatctctttgtatgtattaatttagacaccttagttttcttaatgatttcataccagtttctcagtaacttcagattttttttttgagatggaatcttgctctgtcacccaggctggagtgcagtggcgcaatttggctcactgcaacccctgcctcccaggatgaagcaattctcctgcctcagccacccgagtagctgagattacaggcatgtgccaccatgcctggctaattttgtatttttagtagagacagagtttcaccatattggccaggctggtcttgaactcctgacctcgtgatctgcctgcctcggccttccagagcgctgggattacaggcttgagccaccgcacccaaccagatcagattttttatgtttggtatttactctttacctctaacactaaggctatgtttccagatgtataactataaatggagcaggggtaaatacaacaagtgatttatggttcagtaaagcaagttagttttaataaatgctcagtttactgtaaatgtcagaaatgccccaggactctgtctattgacaactcttctatttccatcgtcagctcttgccctctgaactgtagactgatttatccaacagttaagtctggttctcaaacttaacctgtcctaagtggagctcctgattttcatcatcccaaacctacgtctctcataatattttgccatctcagtcaataacagcttttttcccctcctgtgcagccagaagccttggaagcatcttttaatttctctatgtcacatactcaaattattggtaaatcttgttggctacaccttcaaaatacccataattcattttattttttttaaccattatacttctgtttactctgtttaaaggcatcatcttttggcaaaagaaagaaattgtttcccaggagtcttgtgctttacagtgtattctctagtagcagccggaatgatctttttaaaatctgagttaaaccatgttatttactatgcacagaacttttcagaggcttcccatcttaaaagtaaaatctggagatttacatggccctgtgtgaactggcttcctttcatttctgtgatctctctaccgcacttgctcatctctgtctaaaatggctgtatctttgtcatcttaaggcttgtaactattgtctgtgaccctgtgacccttctctgtgataatccatgtggcttccttcctcacttgattcagagagctctctgctcaaatgatgcttttcctgaccggctgcatcaaagaatgatcatgttcttctgcattccccttaacttgctgcatttttcttcatgggatttaatgtcatttgacttcttgcatattgatttctttgttgttttgcttctttaccactagaatggaagcctaatgacagtgcctggcatacagtaggtagtcagtaactacttcctacatgaaagaatgaagctagtaaatttatgcaaaatgtttgtttctgcctttttaattatcttgcagaaatgtaggaagaattttttaggatcagtttatgtatatatataaactgataagtatgtacacagcctgtagaatgtgggtaataccacctatcatctttttgagcatttaccatgtagcaagtgactgtgctccataatccacatgcattatcttgaatttgataggagagctgagctttttaatcagagtagaccatagaaatatagcttggatgcttttatttcctatatgacttcttcggtgtacttacacatctataagcatttatgggtcaagtaacatactgaaatattttctgaagtaaaagaaatctctttaatcaaataagtggttctcctataggttctcatatcatattcttggtctccagattgagaaggtccttttgtatgcttccagtatactcgaaaccaggaggtagtctgacatctatttcccttcaaggtcaaataattagagaaaggtttaattgacactgttatcgagacagtatcagaagagaaattgaaaaatctctgttgagactctgtaatttgctaggttctgaggatacgacagtaaataagttattaggtcatatacctcagcttcccatttaattaataggcagttattatatataatagaataggtactggttggtatgagactacagaggaagaatacctaattatcttaaaagtggtatataagctgaaaccttgaggatgcttgggaatagctaagaatcatactgttctaggcaggaagaataacacctggaatcagagaagacagcagaacaagtccactgagtagtaagaagttccgtattgcagtaatgtagagttagctgatgggagaaggtgtgaaaaaatgcatttggatgtagaaagccaggagcacgctaaggccctttgctttcttctgacagacacaggagcccatgaaaggcatcacgtgtggaaggaagtgacacgagtcatagtctgccctgcttttctaccacctgaagcatcatataaacctatatcttctgtttcaaatgtaaggaaacatacttctagttcacagtagggatagttgaatggatgaactgtttctggctgaatcttctcaaagtagaatgagcaaaacatggctatattatgagattatctaaggaaagatttttataatcatgtgaattttgaatttctttatatcttaattattccaagagatttttgggaacattaatgagaatagtttacctttagtacatagaacttcttgtcagctataaatgaggatcaaacccaaaagagattaacaaaaataaaagggatgctatttccccaaattagcagaactttttgattcaccgagttctttgttttttaactgctgtctgcctcttaacataattgagtattcagtgatataatataaataaatcacttactaaatgctgatgaacgcttgtttttactaacatctcagcttgtagcatatcttgttgcccataccagaaaccctacccattacctctagctcttccagcttatttacctcttacaaactacttattttaaatatttcctgggtcaatttcatctttttttttcttcctactgctacattatttgtccggactattacagtagtcattacctaactggattgcttgcctccagttttgcccactttggtttcagttattgaaaaggcaaattttgtcagtcacttaacctgcttaaaacccttcagtgactccttgtgttttagttcttatctaatggtttatgaatgtagtgggttacgaatcttccggaagagtgcatttgcactcctgaagtgtgcatgtatttttatgaggagaagatctttagcttttattagattactcctcttttggctaaaaaaagaattacttatcatggctattgaggtcttccatgatctggcttttccctgcctctccattttcatatttttgaaacttttcttgaactttaggctcttgaagtgcttggaattgtcttataatatcatgttttcaggcccctgtgcttttactcattttcctctatctgaaacattcttcccctgtctgaaacattcttcccacccatagtgtcatcagctcctagtcatcttttgtgattcacctctcctaagttgcctctctttttattgctattcctctgtagtcatctctgtgatattgaaatcgtggctttctctttctttagacatcataattccttgaagagccctttttatgtagcctgacaagcagaatttatactgaagtagacatttggaagtcatttagttattgctcaatccttgaaagatgaaactgtccaaagggaaatttaaaagggaaagtatctaatagctgatccctggagaatacaaatgtctctagatttggaagggaagtctctgaaaaacagccagagagaagggaggaaaccaagaaatagtgtcctagacccaaaagtcaataatttccaaaaggtctatatttcttaggaaggccaagtaaaataagtagtgaaaagtgatgacctgactagagcagattcttcatttccagttacagaagctaggttataggtacagtaagctctggacatgttcttttcccacatggaacgttattcgtgttctccactgctgctttgaactattccttttactctctcagcataaaaatccctgctcctttgaagcttatgccttctggttttgtcttcctctgtctgccttcagtgagctatcagtttcttctcggtttttgaggactgctacctgaacttattcttcttcactctttcccaaatctgctgccatctttatttatatgattaacccctcagtccctagcaagtcaaattcccatccgtttttatctacagtaatgttcacctctgcatcactgctgcttcccatgtctacaggcatgccaactcaaaactgttttaccccaaaagcttcagtgaaaacaccttacctcaggttgccgtctttgaatgcttttctactatcttaaacttgttttctttcattgcgccttttcttccttctcttagagacttgtcctatggctcttctactgtcttccagctacaattccctcttgttcctgacatgtactgctcagagccaggagatggataagtagtagtatttcacatgtacttttttctctggggagcagtagtcatacaataattgattaagataaaacaggtttttatcagtttatataagaggtaaagaaaacaatggggtagagttttaaaaattgtcaaaaacaacacattttaccatattaatgatttgaagtgtacggtacaattgtggtaactgtgcacattgttgtgcagcagatctctagaactttttcatcttgtaaaacagaaactctacattcattgaacaactcttcttttcccccttcttcctattccttggcaaatgccattctactttttgcctctaaaatttgactgttttggctacttcatgtcagtggaatcattaagtatttgtcttttgttgactggcctatttcacatagcaatgtcctcaaggttcatttgtgttgtagcatattacagaatttctttcttttcttttaggctgaataacattttgttatatatgtataccacattttctttaaccatttgttgatggatgtttaggttccttccacttcttgaatattgtaatgttgaaataaacatgggtgtacaaatatttttttgagaacctgtttttaatatatttggaagtatacccaggtgtaggattactggatcatatgtattctatttttttttagattttttttttttttacaggagttctaggttcacagaattgagaggaaggtacagagatttcccctgtacctccttccacacaaatgtatagattctctcatagccagtgtgcatctcccaccagagtggtacatgtctttctgatgaacctatattgatacatcataattacccaaagtccgtagtttatattagggatcattcttagtgctgtacgttctgtggctttgaacaaagtacaatgacatgtatctaccattatatcatacagaatgttttcactgccccaaaatcctctgtgttctgcctatttatctttccttccctcccactccttggcaatcaccgatccttttactgtgtctctaactttgccttttccagcatattatatacttgtaatcatacagtatatagccctttcagcttgactatttttacttactaatatgcattaaagtttcttccatgtcttttcataggttgttagtacctctctttttccattttctggacatatcacagtttgtgaatgaatattcacctaatgaaggacattgtggttgcttccacattttgctaattatgaataaaactgctgtagatatcggtgtgcaggtttttgtgtggacttaggttttcagcgactttctgtaaatactagggagtgcaattgctggatcttatggtaaaagtgtttagttttgtaggaaacatccaaactgtcttctaatatgacgctatccttttacatttttcaccagcaatgagtgagtgtttcttttgctctacatcttcaccagtatttggtgttatcagtgttctgaattttgtccattctgataggtgtgtagaggtatcttataattttaatttgtgtttctctgatgccatatgatgtgtgggacatcttttcatatgctgaattgccatctgtatatctttggtgaggtgtctgttaaggttgttggccaattttttaattgggttgtttgttttcttgtggaattttaagagttccttacactgtctctgtctgtcttgtctgtctgtctgtctgtctattgagacagagcctcgctctgtcacccaggttgcagtacagtggcacagtcttggctccctgcaacctctgccacctgggttcaagtgattctcctgcgtcagcctcccgagtagctgggtttatacccgtgcaccaccacacctggctaatttttgtatttttagtagacacggggtttcactatgttagccaggctggtctcgacctcctgacctcaggtgatccacccaccttggcctcccaaagtgctgggatgtgagccaccacacccagcctccttacacattttagttaatagttctttatcagatgtgtcttatgtaaatatttcctccctatctgtggcttgtcttttcatactcttgacattgtcttttgcaaaagacaacaatttttaagaaacaagtagacaattttaatgaagtctggcttatcagttcttttcttcatggttggtacctttggtgccgtatctaaaagtcatcaccaaacccaagatctagattttttcttatgttatcctctaggagttttatagttttgagttttacatttaattctctggtttattttgagtttatttttgtgaagggtgtaagacctgtgtctagactcttttttttttttgcatgtggatgttcagttattaccactgtttattgaaaaagactattttcttcattgtattgcctttgcctctttgtcaaatactgccattgctcctttgactatgtgggtccatttctgggctctctattctgtttcgttggtctgttttgtcagttcttttgtcagtaccacaccatcttgactactgtagctttacagtaaatcttgaaatcagtagtgtccatctgactttttctgtcaatattgagttgtctctcacgggtcatggaatagctcttcattatttagttatttgatttctttcatcagagttctaaaacatttttcctcatatatcttgtactaattttgttagatctgtacttaaatatttcattttgggacacgctaatgtaaaatggtattgtgtttttaatttcaaattcaacttatgcattgctggtttacaggaaaggtattaacttttttatatgaaccttgtatcctgcagctttgctataatcacttattagttctaggaggtttttgttgtttttctttttctttttttcaattcctgtctatgttctacacatatagtcatttcatctgcaaacaaaggcagttgtatttttttgttccccgttagtataccctttatttccttttcttgtcttagctaggacttccagtatggagtggtgaggtggggatattcttttcttgttcctgatcttagtaagaaagtttctagtttctcatcattaaggatggtgttagctgtatgttttttgtaaacgttctttatcaagttgaaggtgttccctctattcctagtttactagtttctatcatgagtgggtgttaaattttgtcacatacttctctccatctatggtatggtcatgtgatttttcttctttagtctgttgatatggtgaattgcattaattgattttccaatattgaaccagtcttgcatacctgggataaatcctactttgtgctggtgtatacttctttttatacattgtagtaaaatttagtttgctaatactttgctaatacaaagatttttgcatctttgttcatgacaaatatggatctgtagttttcttttctgataatgtctttgtctggtttgggtattagagtaatgctgacttcatacaatgagataggagcatctcctttgcttctgtcttctgaaggagattgtagagaactggtgtggtttcttccttaaatgtttagtagaattcatcagagaatccatctgggcctgatgccttctcttttagaacattattaattatggatttaatttctttaatatatgctttttaatcaagattatttcttcttagagttctaatagattgtgtcttttaaggaattgattcatttcatctaggttaccaaattcgtggccgtaaagttgttcataatatcccttgattatccttttaatgtccatgagatctgtaatgatgtccactcttttcattctgatattagttattttgtcctttgtctctttttcttagcctggctagaggcttattgattttattgatcttttcagagaactagttgatttctttgatttttctctattgatatcttgttttcaatttcattgatttctgctctaatttttattacttctatttggatttaatttgctttttctagtttcataagttggtagctcagataattgatttttagatcattcttttcttttcttttttttttgagatggagtctcgctttgtcgcccaggctggagtgcagtggctcgatctcggctcaccgcaagctccgcctcccgggttcacgccattctcttgcctcagcctcccaagtagctgggactacaggcgcctgccaccacgtgtggctaatttttttgtatttttagtagagacggggtttcactgtgttagccaggatggtcttgatctcctgaccatgtgatccacccgcctcagcctcccaaagtgctgggattacaggcgtgagccacagcgcccggcctagataattcttttctaataaatgcatcagtgttgtatgtttctttctaagcgctgctttcactgtatcccacaaatttggataagttgtgttttcatgatattttcaatttataatggtattgggacacaacccaataagtaagtttaggagcatttgtatgcataagcacaattgttgacattattttgaacaaattcttatttgttagatcaattaagtataagaaaaataaaaggttttattttactttcagtgtttccttcttttgatgctctatatatgtagatttcagtttctgaacttcccaacacttattgcaaggcaggtgtactgacaacaaatttccttaatttttgtctgagaaagtgtttctttttaacttttgaataataatctcacaaggtagagtgctaggtttatggtttttttttctctcaacactatgaatatttcactctttttcttgttggaagtcacatgtattttttcttttttttctttttttcctctacaggtaaggtgattttttccctctggcttacttcggatttttttcttatccttgaatttctgtaattacaacgttttatgcccagatgtagttttttggcatattttcaagctcagagattcttcatccatgcccagcctactaataagcccatcaaaggcattcttcatttctcttacagtgttctgttttttgtttttgtttgtgttttatctctagcacttccttttggttcttaggattttcatctctacttttttaacatgttgtttactcagttcgttagggcccttagcatattaatcatagttgttttagattccaagtttgataattccaaatccctgctgtatctggtcctggtgcttgttttttaccttttattatgccctgtaatttttttcttgatagcttggacatgatgtactaggtaaaaggaactgttgtaaatgagcatttagtaatgtggttgtaaggtgtagggagaggagaagagttctgtagtcttatgattaggtcagtctttttagtgagcttatgcctctggactgtgaacttcacaagtgtttctcaatcccacccctccctcattcccttagttagaacaagatagctataatggcctgaagttgggttatttctcttcccccacatcattttggctttgctacaaccccagcaggttaggctctggttaactagtttctcctgaggacaaaccttgttaagactggaatagtctagtgtacttgaaaatcatttctctttgcctcccctgctgagggttgaggatttttctcctatatttactgtgagaagctggtcaattgcctggatgtaaaacttagaaaattgtagggctccccctataattgggtaactctggagtttttagctttcagagttgtccacactgagccttcatcaatttgtctattacacttcaggatttcctaccccgtggaggtttctgcttgtgtttttcatctcagataaatggtgatgctatgtgttcacctgttctctgctctcacaggcagtcatttgccctgtgacctcacttatcctatctcagatttgtttatttttaagtttgtcattttttacttgttgttaggatggagtggtgacttccaagctcttcatatgtggaactggaggtaattctatttcaaattttttgagggaccttcatgttgttttccacagtgcctggcaccattttacattttcaccagtggtgcataagggttccagtttctccatatcttcaccaatacttattttctgtttttttaatggtggccatcctaatggtttcagatgatgtatcattgcagttttaattgacatttctccctactgatcagtgatggtgagaatcttttcatgggcttattgcccatttgtatatattctttggaaaaatgactattcaagtcctttgtccactttttaactagattttttgttgttgaattgtaggagttatttatatattctggatattaaccaaataacagatacatggtatagaaatattttctcctgttttgtaggttgccattttactccatttactgtttgctttgtagaaatttttgagtttatgtatccccagtttgtctatttttgctttggttgcttgtgcttttggtgatctattcaagaaatcattgccaagtccaatgtcatgaagctttttctccatgttttcttgtagtagttttataattcgatgttttaagtttaggtctgtaatccagcttgagttcatctttgtatatggtgtgagataaggctccaacttcattcttttgcatgttagattccagatttcccaatacagtttgttgaagaacctcttttccctatttctgtgttctctcttctgctcacttggtctgtatatctgtctttatgccagcaccatagtgttttgattactatagctttgcaatatctttagaaatcagggaatgtgaggcctctagctttgttttttgtccagattgttacggctattcagggtccttcaagattctgtattaattttaagattttttttttctgtttctgtagaaaatgccattgggattttgatagggattgctttgaatttgcagattgctttgggtagtattgccatcttaacagtactaaatcttccaattcataaacttggatgtctttccatttatttgtattgtctttaatttctttcagcattgttgtataattttctttttcttttttttttttttttgagacagagtctcactctgtcaccaggctggagtagagtggcgtgatcttggctcactgcacctctgcctcccaaattcaagtgacaactcctgcctcagcctcccgagtggctgggattacaggcgcgcgccaccaagcccagctaatttattttgtatttttagtagagacagggtttcaccatgttggccaggatggtctcaatctcttgacctcgtgatcagcccaccttggcctcccaaactgctggggttacaggcgtgagccaccacgtccggcctatgttgtttaattttcaatgtacatgtctttcatttgcttggtgaaaatattccctaagtattttttactctttgatttcattttaaatgggtttaaaaaattaatttcctttttggattcttcatttttagtatttagaaatgcaactcttttcttaatattggtttttatatcctgtaactttactgaattcctttattctaacggttttttttctttttggtaggctagagttttcaacataaaagatcatgtcatttgctaacagaagtaattttacttcttacttttctcatttaatacctttcatttctttttcttgcccagttgctaactctggcaggatgtctaacagtatgttgaatagaagtggtgaatgtgtgcattcttgttccatttgtgatcttagagggaaaactttcagtttttcatcattgaataacattagctgtggtctttctatatatggccttcattatgttgaagtaatttccatatctttctagcgaattgagcgtttttgtttttgtttttttgagacagaatcttgctcttgtcacccaggctggagtgcaatgatgctatctcacctcactgccagctccgcctcccgggttctcaagtgattgtcctgcctcagcctcccgagtagctggaattacaggcgcccaccaccatgcccgattagtttttgtatttttagtagagacagggtttcactgtgttggccaggctggtctcacactcctgacctcaggtgatccacccaccttgcccttctaaagtgctgggattacaggcatgagccaccctgtctggcctttttttaaatcctaaaagggtgttgatttttgtcaaatgcttcttctgagtcagttgagattattggtttttgtcctaagaatgcagtgtattaaagtgatttttttgtatgttgaaccatccttggattttatgaataaattccagttgagaatttatgaaatataatctttttaatgcattgttgaattctgtttcttggtattttgttgattttttttgcatcagtatttattagggattcttttttcttgtaaatttgtctgatttcgatatctaagtaatgcttacctcataaaatgattttgaaagtgttctgtcctctagttttttcaaagagtttgagaagggttgttagtttttaaatgtttggtagagttttcagtgaagccctggcgttgttggacagttactgattcaatctctaatagttataggtccattcagaagttgtatgtatttgtggctcagtcttggtgggtttgatgtgtctatccgttctcaaaggttatcaaatttttttgggtcatagttgttcatattagtcttttaaggtcctatttatttctgtggcagcagttgttgtatcgcctttctaatttccagttgttgctgtttgtgtctattctcttcatttcttaatctaagaatttgccagttttgttgatcttttcaataaaacagctactcctaattttgttgattttttttctattgcaaaaattttctatttttctctattttattttagctgtaatttatttttattttttttattttttggtaagtttgagtctcatttgttcttcatttcctaattccataagatgtaaagttaatttgttgatttaaggtttttcttcctttctaactgtgaaatatgacactgtaaaacagattttcattttacagatgaattatgtaaatatttagttctacaattttacttttttttttatcatatatcacgcattctggatattgagactataaaaatgaaaaaaacagttcttttcttttcttttttttttttgagacagagtctcgctcttttgcccaggccacagtgcagtggctctgtctcggctcactgcaagctccgcctcccgggttcatgccattcttctgcatcagcctcccaagtagctgggactataggcgcccaccacggcgcccagctaatttttttttgtatttttagtagggacgtagtttcaccatgttagccaggatggtctcgatctcctgacctcatgatccgcctgcctcggcctcccaaagtgctgggattagaggcgtggcgtgagccactgcacccggccataaaacagtaattgaaggttaacctatatttcaaacaactgaaaatactgatttgttcatatttattttttcatgaaaatcgtcttgttctatatttaataggtttttgttcggttcatggtactaatgagttcacaattgtaggtttagtcttgaaataatctaaattcacttcatcccattgtaacagaccctacatcatactgaatatagttgtgtcacagatgtctcttacagtctatttctacaaggcctagaactatttaggataccgttgctcactcttacaaattttaacattaaaaataactttgagatggaatggagttttgcaacgtctcagaacaaagagactccacttacgagaaattactaagcagtggttcctagctttatagactaattatataagccttcagttgtttctattttatatctgttttttagattcctcacatgttcattctgctttaccttctgtataatataaaggtcactctacttacagtcacattttccttttaatctttccgtttttattttttattctttgctttgttcaccattagtttttatattgcatctcacagttcatgtttcttttttgtcatttctgattctaattgtaattctaatcttacttgtttggcgttcactgtcacatcttcactttctggcagctgtttctatggcttcatcttcttagtgcttgtattcattgcttatattccagttgtcttgtaaattcatttttttagtgaactaagccagacacggaaagacagatatcacatgttctcactgatatgtgggaactaaaaaaacattgaacacaaattttacagctgacacacatatgcctgccacctagattctgccattaatacttacattgctttatcgtataaccatccttgtatccatcaatccatcttaatttttatgcctttcaaagttaattgctaacattagtacacatccctctaggtgaaaccatttttaaactgattgctgtcaagttgtctagagtaaactctgatcttccaagtatgacttattccataggacttctgtttgtagcactgtcccattaattcaatcatagaaataaataattggaaagtattgtctgttttaaatggataagtattttcatgtgtctgactttagaggacttttactagaaggtctcacttgaccttcattgctgactaaataagaaaagtttgttttattttaaaaatcaacacattataacatactttgttttttgagtaataagaaaagtcaatggaatgtgaagaaattatagcaagtaagctgttgttcctcttctaggaattttgattatgaacagctgataaggtattactaagggatctcatcagggaaattcctttctttccttctttttcttttgcatcctctccctttcctcactttcttttcccctttttcccttttcccctctcctcttcttttctttaatagtacttggggaaaggtataccttttattttacggatttgctcagggtaaagagagagttaagaggccaaatgattagatggcagggtcactggagggcagagataaataatagatcctaaactaagggttggcaaacattttctgtaaagggcaggtggtatttgttttaggttttgcaggcctaaagtactcaactctgccattgtagtatgaaaaacagccataaactatatagtatattgtattagtcctttttcacgctgctgataaagacgtacctgagactgggaaaaaaaaaagaagtttaattggacttacacttccacatggctgggaaggcttcagaatcatggcgaaaggtgaaagacacttcttgcatggcagtgacaagagaaaatgagaaggatgcaaaagcggaaacccctgataaaaccatcagatctcgtgagacttactaccacaagaacagcatgtgggaaactgcccccatgattcagattatctcccagggggtcactcctacaacacatgagaattatgggagtacaattcaagatgagatttgggtggggacacagagccaaagcattatcatatatagtatatttataaatcaatgaacttgggtatgttccagtacacttgatggatactggaacttgaatttcttataattttcacgttacaaactattattatttttcaaactttttccagccatttaaaaatgtaaaatattctaagcttgagagacataaacaggtggtggactcgatttgacttacgagctatgatttggtgacccatatggtacaaggatttcccttgcgcaggaactataccaaaaagtcgttattagtgtatacttttccaacgtagaggcccttttatgtgctctaaattttgtatgccttttacatatcctaaattagatagtgatgcagatgaggtcagataaattaaggtgtcattggagtgaggaaaaaagaagaatgcttaatatagttgattccaccattaacttggaggttctggcatggcttcctttagtcctgtctcatcagtgtagctgctatttgttaaacttggcacagaaaggcagatcaaatatagagggctactttcagatcctcctcttaatagttattaaaagctcaagtttagtagctgagttcaaatctcttattagatgtatgacttatgtaatttctctgagcatcagcagaatgaaggtttatagtgctaactcatacacttgtgagggtgatagtaacaattacaacaataatagtagtagctaacactttcatagtgcttagtatgtgccaggcaatgttctaagcactttatatatattaacacatttaattttctcacaattggtaatgtgaagaagaataatactctcaccatgataatgctcgtagatactaccatttaaattacgaggaaacttacgtccagaaagatcaagtaattcattcagggtcacatagttaattaagaggtagagccattatgtgaacttgggcatctggcctcagaatgcgagctcttaactgttaaggtttattcccctctaaagtgggaatgtctataaaatgcatagcacataggtcctcaacaaattagagagaaattaactttgcagaatatagtggttccatttcctcaagaaacttggtctgcctttgtggtaccagatagatgcataaatgtgaggttcacgttatgattcttcagatttttttcccagttgcacattagttatgagatttttttccatagaattcttcagtattactcatgttaaaaaataattattttgaaatgaatcaccttctgcaaaacaatatagtcaaaatgacttagactctgaagctgaaagactcctggactcctattcttgtcttggttctgtactttctttgagatcttggtttcgtgatttgactccagttctatttctctctttggctgtggactgaagataatcctcaatgtcatggtattcaaatgagataacccatgtcaaagtgccccgcagtgtgtgtaataagttatcaggcatccagcaaatactagtttcttgctcacctccctattacataaaataactttaaaattagaactgaagggactcataaagctgggaaaactgaggcccagacaattgtttccctaggatcctacagctgcttagggacagaaggatgacacttaatgcagatcttctgatttttcagtctcgttctgtttgtgctgatcactctcctcctatgtagtatataaagaagtactatgtatctgacaagttttggggaggttattttagtataaaagctcacattaaaaatatctattttggtattttgacttttgtaatttttttaaaaatcagagacaatttagtaaatctcggggccattcaaatcatgtatatgaagttttataactgctattgttttccccttatagttattaatttttaatatgcaagtagcatccttactatggaaagaataaataagaaatcaaaagatggaagaagttttaaaactcacttaatcacatcatccagagaaaatgctattaatgctttgaaataacaatgggttcatcctacacctgctactttttaactgacttttgtcagttagtgatatatcaggaagactaggcagttctttgtcgaattcaaatcttgatagtttttattttattgtgtgacctattatcagttcatttaagtaatcttttattagacatgtttttttcagatatagaaacaatgcatttttgtaaaattgtcaaattattttccacaagtaggatctcattcacacggtattcgtgtttttaagactttcgatacatgttcactgttttcctccagaaaggaaatacctacttacattttcaccagggaagtcactgtagtttgggagaacatgacattatctccctttctttactgaagggtagcaatatatattttaaattttctagattctgcatttccattttatttttacatgttttcactttcatattttgcatagtgctaaatctgtgataacagtttttaattttcaggtggggtttatagcttcatagatagcaaaatgtctttaagtcatgtttatgcaatttttacatgtgctttgtgggttttcttttttctctgtttgcatgcagtgagtggtaaatttgcatggaacatttgaaaaataagcaccagaatgaattgaatgtgtgtgaattatcactttttgtcacctacctggacagagagtgaaagttcttctgttgagacaaaattggatctcgtgtgtttcttcacttacttgctgccttgttaattgttgagtttctcatgattagcaagatgtaaactctggcattggtcatctagtcctacatgttagataattctgtgaatgttttgaaaatcagctgaactatttttcttataattttgattctttgtagttgttatttccatgcttgtgaatttgggaccaaaaggaatggctatgacttatgtttctttggatccagtagtttattctactgaaattatggtaattttatcagttagtagaagcatagactctttagtgttgaatataatgtcatctaacttcttacatggtcacataattcctccctcagttttggtagctctcctgaaacagccataataggacattaatctgtgtactttaagttgacagagtaaaaggaatataagatttcacgtgatggaacttaaaatattccatcttgtgacgtggaactaatgaggaggtttagtgacaagttttagatttaagattctacactttggagcctctttttctttttctttttggtttttgtttgtttgtttgtttttgagacaaagtctagctctgttgcccaggctggagtgcagtggtgcaatttcagcttatggcagccttgactctcaggctcaagtgatcctcagcctcccaagtagctgggactacaggtgcatgccaccacacttggctaattttttttaaaaaagtttgtagagagtagcctcactatgttgcccaggctggtgttgacctcctgggctcaagtagtcggcctgcctcagcctcccacagttatgggattgattacagtcatgatctgcctcactcaggctgcagccgctttctttcagtgtaacactatctttggatattccacttacaaatttatttttaagtctcccatgttgttgataattgggaaaaatagtttttattccagatagatattctgtgttaactataagtcaaatgtttacaagctgttaaaaatgaaatactgattatgtaaaagaaaaccggattgatgctttaaatagactcattttcctaatgctaatttttaaaatgatagaatcctacaactcttagctgtaaaccttgtgatttttcagctgttgtactaaacaacttaagcacatataccatcagacaagcccccctccccccttttaaaccaaaggaatgtatactctgttaatacagtcagtaagcattgacattctttatcataatatcctagaaaatatttattaactatttcactagtcaggagttgtggtaaatagtgcatctccattttctacttctcatcttcatacacaggttaatcacttcagtgcttgactaacttttgccttgatgatatgttgagctttgtacttgagagctgtactaatcactgtgcttattgtttgaatgtttggtacaggaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaaggtaagatgttttattttcaattgagaattgttgcctgaaaaccatgtgggagatttaaatgtattagtttttatttgttttttcttctgtgacataaagacattttgatatcgtagaaccaattttttattgtggtaacggacaggaataataactacattttacaggtctaatcattgctaattagaagcagatcatatgccaaaagttcatttgttaatagattgatttgaactttttaaaattcttaggaaaaatgtattaagtggtagtgaatctccaaaactaggccacaacatctatttaagttatagaataactggactaagtatctggcatgagttctggaacctcaggatgatgtgatgaaagaagcagaaagaggaaacagtgggttttttccatttttgaaggcaagacaaaattttgtgatagttatgtgagaattctacgtttccttcagatatatgcttctcactctccttccggacatttggtacagtcatgctgccaaggatcatgacctaccaatgacagtcttcactcaggtcttttgttttctaaatggtcctacgtccaaaattcagaattcgattaccttgtcgctaatactaaaactccaagttattttcttcagtgaaggtaattagtaacaaagtaatcaaatttttgaatgactaccagggcttagcgcccctccactctcacccctacacacacccagaggcaattgtattttaagagagaaagctttttttttatgacatacaagtcagagaattttagaggcatttgcctctaaaactttcactaacatcatttgaatcaagtttgaaagaattagtgaagtggcattgtgttataacctctactctgtttccacaataaaattattttcgtcactttacacaactttgttgcttcagagtgtataattctgtttcatgaattagttcacacactatgggaaaataggtaaatgttgtctgtatatatagtgtgtcagtataatgtggaagctgcattgactttattgtacacagttctccagtaagtgtgcaccagagagtaccagtaactgaatgtagagtgctggcacagtggaatgcagccagctgcgggggatgtggtacatgaggaatgtgctcatctgctcttttggccacgtgctccatcttagaggtgcttattgtgtggctttatccagtctttatgccccctcctctttttgctcaagtctgcattatagcagttgtgacctttccttatccctgttttctaatatgctactgttactgttccctgttcgttactggtttttttgtttttgtttttgcattgttctatagttactattgtatattggaaattagagatgctttctgtacactagtactcttattttgattattaattatgtttgttaacactaattacaaagttgcataagtattaagtagtctgcaccaaactgtttttgcgtaggaggtttttaagtgcaaaatttaaaagattgagtattttcagggacacatttatcacaagaaatcttataaaaatgtctttctcagtagaacacctgtatcaataaaccaaactttttgaatgttcatatctaattacagtgttttttgactaatttttatctatatacctgaaaaattcagtttaacatattaaacactacaggccaggcacagtggctcacgcctgtaatcccagcactttgggaggctgaggcgggcgaatcacgacgtcaagagatcgagaccaacctggccaacgtggtgaaaccccctctctactaaaaatacaaaaaaattagccagttgtggtggcgtgcatctgtagtcccagctacttgggaggctgaggtaggagaatcgtttgaacccgggaggcagaagttgcagtgagccgaaatggtgccactgcattccaacctggcaacagagtgagactccatgtcaaaaaacaacaacaaaaaacactccttggaaaaagtataggtacattctatataggattagtagactgtcagaatcacttgaagatgttccgaaagcatgacatatcaacaaaggacatgtgagtctagaatggtgatccctaggacaggccatattactgcatgcaaagcaagtctttgttaaccttatgacttgctcaggaagcaaagtgtttcatgtcctaataggatagtagtattttctgttatgttacattttaggaaattaggagttttgcattgtcttgtaagaaggtattttaaaaattttcaatgaaaataatgagaaataggtttccagtggttttatgcttttggggaagaggttactgatgtttagcaaaagatgcttatatattcttaatagaacaaacctgagaattagttcttaaagagttaaggcccataaaagaaactgtaagtgttggtactcttgtagctgggccacagatcagatccttagtatgataaaatttggtatttttgtgcttcaatttttggagaccattcaatgatcacttacattttatattgtctttcattgtgaaacatatattatagcagaggtgggagtcattaaaaattctacatgttgtacactacatgtataagggtatatttggcgcaatggaggtaggattgtctgtgtgcctctaaaattaacctctcaagtagttaatctgatgatgacaagtatgtcactttattgataaaagggagaattaagactattctcagtattatgttggtcagtacacaaaatatatcatttgtttttacctgtgaaatgaaatatctttcatcctattagccagaagggagaaagccttggcctgaaaataacacttatctcaaaaagttgggaaatgtggtccaactctgtgcccaggaaaagaggaaatagattttgatgactacatagtctctgcactgcttgccagctcataagtttacttctttgcactgtttgttttcattgctcaaaaactattttctgtcactctatgagatttagtctaacctgattcctggctgtggaaagcagtttctacttaagagccgatgagaaatggtatattcttctcaatcactcacagaatgactaccctggaacaaactaggaagacccaaaatgaaccagtttgattttaatacatacatagatgctgaaggagcctttttttaagaccttgccttcttagtctttggagaacagagtactgaaacaagaaaactcacagattagtagtatttctgtgtgttctacagtgaggttttaagagctgtattatgattaatcagtacatgacatattggttcatatttataattaaagctatacattaatagatatcttgattataaagaaagtttaaactcatgatcttattaagagttatacattgttgaaagaatgtaaaagcatgggtgaggtcattggtataggtaggtagttcattgaaaaaaataggtaagcattaaattttgtttgctgaatctaagtattagatactttaagagttgtatatcataaatgatattgagcctagaatgtttggctgttttacttttagaactttttgcaacagagtaaacatacatattatgaaaataaatgttctcttttttcctctgattttctagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccgggtaagttgggctgctagattaaaaacctaataatggggatatcatgatacagttcagtgaattcattttaaaagtgactgaaaaaaatgataccatatagcataggaacacatggacatttctgatcttatataagtattatacttttgttgttcctgtgcaagtttatagatgtgttctacaaagtatcggttgtattatataatggtcatgctatctttgaaaaagaatgggttttctaaatcttgaaaactaaatccaaagtttctttcattcagaagagaatagagtgttggacaaagaccagaacaagagaaatgtggagatacccaataataagtgtggatgtgcagtcttgaactgggagtaatggtacagtaaaaccataccataaaattataggtagtgtccaaaaaattccatcgtgtaaaattcagagttgcattattgtggacttgatgaagtgaccatggcagatcagtgcctgttgccagtaagagttgagtcctgctgggccacttagaatatccctgtgtggacggcactgcctggctgtggtagtttcttcccacttaaaaattcatagagacaactctgggtcttggaacttctggaaaacagcagctattccaaaaatctggggattagtggtgcctgtaacatcaagtccagggagattgagcagggaaatactggaaactcaggtactcatcctaacttcctggttttccagatggggttgccatttgttccttttctttcctccacaagataattttagtgtatctgtttaagaatataagagtggccagaagacagaaagcagtcgtcagtcacatttcaccaaaatttacatttgtctcaggtgcattatcgcagagctttattgtatttctagtattagctatccctgtcattgctgctacttttttatcatcttcaagtaaaatttaatgtcaacaaaaattaaggtagttaataatactatagtatactagtaaagttgtctgacacagacaactaggaaatgtgatttttactttaaaatgtattttagttttagaatgtctaaattttagttttagaattgtctaaattcgagaattcataaagctgtagcccggtggaaaaagttatttgacatctcagaaattaaaaattgcagagattttgtgtgttttttttttttttgttactggtttgttttttttttttaatgtcagatatgtttatagtgttggagaaagattctgcattatttaagcaactcaggtggttttctagcagagacaaaagggggctttaactgcctgaagtcattattattgcttgctttctggtaccctttttatttcacttacatagttttgagacacatgaataattaatacacttaatgactgatcataaggcagccagcaccttactttacatagtttagcagaatgatagggtattttataagaatgtgagtgatgttttatgaaaggtatgttgaggtctgtctatgactatccattgttggagcagaactgcaaatgccaaagctacatactttatgtttggcttcttgaggtgagatcccttcagctgtcttcatcaaaagctatgtctagcctttaaaaggcaatgaaattacactgtaagaatcattccagggttcaaaaaattgtctaccttccttatctgtctttcgctcagaagtctactcagtcttattttcctcagtcccccatttttttctctagtaaagcaagactaaaaacaaaagtttaagtacttggtatatactttattctatattttaaattctattctagaattttaaggaaacaactgcttttaaagccttaggtgttagtgtaaaattaactgtgagctctttaattatggtaacttgtttttagcaagttctgcttaattatatcaaaattagataatatagtgtggcctatcataaatcaggattcactagatagtatatgtacttgaatattgccagcccacaaaagcagttcacttcagaaatcatgtgtgttaggcagtttaataaactgtgaaaatagaaagagatgatgcttacagagaagcttccttaggggctctgaatgctcacactaagcagattttactcttaactttctttctcccttgctttttcttccttttcttttttttaaaaaaataacagaatgtgaaaagactagaaaaaccagcatcgaaataggtcttataagtaaaattgataacctgtgtaattttttgaagtaagtattcacagcaggtgatgattatgataaagccacatattttagtaacacatagtagaagttctataatagaaagtggtttaagattattctctcatatgaaagctcaaaagtgatgaatttttcaagatcttatttcccaaggatctctgctttttaagcctcattcttatatatcacagtgaacaaactagtggccacttttttatgacttgctaattttggaattgtatagcagggttgggtggaaaagaagaaatgagaaactttgtggtaagcttaatattgataaataaaattatgggatcctaggctttaagagctaaaagaaaccttagagttatccactccttagtttagaaatcaagcccagaaaatagtgacttcatatatgagactcttgtatgttttctgttgaggagtggtaacttgaattaataattgtggatttttttaaaaaagaaaaatatattcattgcttttatatattgtgaaattcaaaccagactagcagcttttttcctgaggtttttagagaaattgtctttgatgacaagagaagaattcatgttgatagtattttcactaatctctgattgtaggaaacactatcattttattactgctaagacagaaaaataccagcaattcattgtaagatgctatcatttgtatggtgtaatctgatttcagagataatgtgaaaaaagtgaattttagaatcaatagaatataagttgtctcttcacaaataccttagaactgcttaagaacacccccaccctacccgtttaacttactgccatagttcccctaggacttattttcagtattttttcgttattgttccttagaaaacagtacagtgataaacatgagcttagacttcacctttcatttgaatgacattcctaatgtgatgaggtttttacaaatatgtaaaaccatatttacaaatttacatttttaatataaatatgtaatttaatttaatatgtaaattaatttaatttaaatatgtaaatatttgcatatttacaaatatgcaaatatttgcatatttacaaatatgtaaatatttacatatttacaaatatgtaaatatacccatttgtgtgttcttttacaagtagataatttctcatttttcttagatgaagcacttccaatgatagtatgtattaagattttttaaattacttcttaaaggagaagatagaggttataagtttatggaagaatatagtattgccatcatgaggtccctcaaactgccttcacatctgaatgggaaaattgtttaaaaaaaataaataaataaataaataaaatccagggccctaacctctagaggtttagattagaagctgtattgtagagcctatgaatctgaacttctggtaatactccacaaatattttgataaagccagactccaatatttgggaagatggcctttggttcagctcaggtgggggtgtgtgtgcatgtgtgtttatgtgtgtatgtgtgcatatatagagagaaagagaaaggccattttgatatacaagtatgtttatgtgttttggaaactcagatttttaagaggatcatggggacagcaagcttggaatagaggatgatgatgatgtgaaacttggttccaattagtcagggagttctagcatttcacataaatatctaaaaaccaaaaggaatggctgagatgtggaattgaatagggaagttcaaaaataggaattagcacagataaaggtgattggcacagataaaaagccccactaccaggaggttctgcaaaatcccctctaaaagtcactggccctttttatctggtttctaatagcctagtctaacccagcttccagcattttcagctcccagcttccagcattggtgaacactcttactagtgaaacatgaacgtaattcttttatttattcattgactcacagagctttaaaaatgagattattctgtgctgcactaggtatgtttaattttgtcttacacatacactatattgtggttaacatgtaatttccattgttctttcttgtgatttattctaattgaaatcaaaaatgaaaccaagaaatatgcttggtttatgccctcaaagtaatttctcagaaactgaatgagagaatgaagcctatatatacatagatcctcagcattatataataatttaagacaatgaaacatcaaacttagtattacatgtgaggaaaatgaaatctaaaagagattccagcctacataaattaatggcagaattggaaatagaagtcaggattccaggtctcatggacgaacgtgattatgtgatttggtgttacccaaacatttaaactacatttgagatataacagacttttcttcatgtgtttatcgtgaacatgaaaaaattaatttggataatctggaaatctcaagcaatagtttaagcctcaagttgactgaagtagttgaagctagcctttctttctttttcctctttttttttttttttttttagacggagtcttgctctgtcacccaggctggagtgcagtggcgcaatcttggctcactgcaagccccgcctcccaggttcatgccattctcctgcctcagcctcccgagtagctgggactacaggcgcctgccaccatgcccagctaatttttttgtatttttagtagagatggggttcaccgtgttagccaggatggtctcaatctcctgacctcgtgatccgcccgcctcggcctcccagagtgccgggattacaggcatgagccaccacgcccggccttgaagctagcctttcttagaaatcccaggcattcttaagtattagaggtctcttttatctgattattgcttctacttaaatattcatggtattaaggaatttttttaaaaaattatgaattgatttgatgtaatagctcagaaaactataagattttaagtgataaggttttccttttgattcctgtaagtctagtaatatcatattttgatattaagatgtcatcctgctaggtattctgcaaatgctttgatatcaggtcagattttttttttaaaaaatgaactccctaggatttcatcatcatggccaattaaaaagttcagaaattaaaaatcattttatccagcaattgatgaaatcaagagtcttaaagaagaggaagttacgcagtgaagaggtagatatgattatatccaggatatttttgtttatttttccccagtaatctctgtctgttgctagtctccatgttaaataaatacaacatacactgtacttttaaatatacctaaaaattggcctggcgcggtggctcacacctgtaatcccagcactttgggaggccaaggcgggcagatcacaaggtcaggagaccgaaaccatcctggctaacacagtgaaaccccatctctactaaaaaatacaaaaaaaaatagccaggcgcggtggcaggcgcctgtagtcccagctactcgggaggctgaggcaggagaatggcatgaacctgggaggcggggcttgcagtgcgccaagattgcgccactgcactccagcctgggcgacagagcgagactccgtctcaaaaaaaaaaaaaaaacaaacaaaaaaaaccctaaaaatccacgtgtgtattgtaaataaattcaggcatgcatgcacgttctccttttcagaatgtttagacatagtcctccaaatttcaaatatcctaatgcatttaaaacaacttctgacttaaaaaatacagttttatggtgaggtttgggtttaaacaacaacatacaattttaaataatatagctattatgtaaagaatacacctttacagtttatttgttaaatcttttttaaattgaccgaacaattgatggaggttatttttaagaaaaagaattatcagtacagctgtttatgcaataatggcctttatcaaaatggttattgctaaattttatgtgttaataatttaaaataaaatagttttaaaggctatttatgtattctgtttttactattttatttattttaatttttgagacagggtcttaactctgtcacccaggcctggagtacagtggcacgatctctactgactgcagccttgacctcccacctcagcctcccaagtagctgggatgacaggcgcatgccaccaccccccactattttttatttatttatttatttatttatttatttatttatttatttatttattagttttttgtagaaacaaggtttcatcatgttgcccaggctgatctcaaactgctgggctcaggcaatctgcctgcattggcctcccaaagtggtgggattacaggtgtgagccacggcgcccagcctttattcttaagtggtacagtattttatgaaatcacttatgtgtaccagaatggtaatctaaaataggtaataacaaaatttttgcctacagaattcagttaccaactacttttcaaattattctttttacatatttatatttgaacacattctgactctgaaaaatgtatttgttgtaaaaaatggaaaaatatggaaaagaataaggaaaataaaaatcactcataatcctaaaaaaaaaatttttggtcgtcattgaagagagtgagtaaagcatagtagttaagagcttgtttcctggattagtatctctgttccacaacttactgtgacttactgtgacttgaagttatttcacctttcagtatcttggggtccttatctgtaaagtggagttaatgtttccttcctcataagggtgttgtgaagattaaattagttgctatgtgtgaaatgctacaaaagtgctatatattattgttgctgtattcatggaatatttttgttctataatgctatggtaggttttcagaaaatattttagaaccaataaaataacagcaacaacagctagtacttttaagcactaactttatgcagggaattaatctaagcagttcatacattaatttattactatattattatggttattttacagatgaaataagagaggtaaagttgtatgtttgcatttacaatagaacatattgcattgcattacattcttttggcaccaaggtggggagcatagaatagagatcagtggaagtggacagacatgtaatattttatggagaataaagataaatttgcttcagttatcatttgacatgtcttaggtagagctaagactagatagaacacagggcctctcaatcctgtagaaattcaccaccacatcctttaaaaggttttacattgataaggagtcagctctcatctatgaatgttagtggggaaaagctgtagaatgcacagtctaaataccagataaccttttttttccccactttggaatacattatatttgataaaagcaagtatacctttggatgtaaaggtaaatataaacactgacttacatctttaacacctagccagttgggaactggcataaggaaactcagaatggattacatggcaatatggaatgttggcctggtcccacatttgagctaagatgttaattctaattttagtctcctcagaattctgtatactccgtagcttgaaacaggtttccaactgaaactatttttttccccaaggttattttcacatctacatttgtttgactctagatcttggaactagtctatatcaagttcctttggggacacaaaattgcaaatctgttgttcagagagcaaaactattttaaaaggtaacactcgttctcatatattcttaataagccttcacaacttacagtatgttgaggaaactgaggcttaattgaatcgcgtgctaaagtttaaaggttaaaagttatggtaagtgagagttgggactagtaaggtgaattctgactgactcttggtctttccataacaaaacattgtctaaaagtaaactgtgtggcctaaaaatgattttgtaaatattagagatcggtgttgaacaacaacagacattatttaaagctaaagactaaattcacagaataggaccctaaagttgaagatacccagaagataatttcagctagttttgtcaaactctttgactgcaatccctagtattttacatagcatcccagtacatgcttatccatctgtacatctaattgaaacaaaagtttcacaaaacagtaggttccattactatgtggaatgcattctgattttcccattgctgattgcaaaccactaaatggattagactacccactaatgagttgcaggtgacaagtttgaaaaaacaatgctctcgggcaacctgacctgatgcgttaatttatgagattttattttttgtagacagactagattgtccaaatgagtattattactttaactactatagtgctgtgttacagttgtttcagtgattattgcatttttcaaaaccatttttaaaattctgtttgaaatagttggaataacctgaaaacatttaatatcctgttttggtaaattttcatctccaagattaaatttttttaaccagccaacagatgtttgaaggcaagttaggagatatgatggatactggatacagtatccatccatgtactagatacagtatccatccatgtactggatacagtcatactgttagcaaattttagatacataaagtaaaacaaacaaaatgcagtataaacagttaatattggaatctagtgttgattttatgattaatctcaatgaggttactgtatattcataattctataggtacacaaaaatatttggtaaaagatttatagttgagaaaatgctagacactaaagtttgttaacttacaatttaagaataagggctgggtgcagttgctcacgcctgtaatcccagcactttgagaggctgaggtgggcggatcatgaggtcaggagttcaagaccatcctggcaaacgtagtgaaaccccatctctactaaaaataaaaaatttagccaggcgtagtggcgcctgcctgtaatcccagctactcaggaggctgaggcaggagaattgcttgaacccaggaggcggaggttgcagtgagctgagatcgcgccactgcactccagcctaggcgacagagtgagatttcatgtcaaaaaaaaaaaaaaaagagtaaggacatgagtaaggttatgtctcacctgtttttaaggaaatgtggatataagatgggttctagtccattaaaaggtggtaatttatactaagtcttactgtgagagaccataaactgctttagtattcagtgtatttttcttaattgaaatattttacttatgacttagtagatactaagacttaacccttgagtttctattctaataaaggactactaatgaacaattttgaggttagacctctactccattgtttttgctgaaatgatttagctgcttttccatgtcctgtgtagtccagacttaacacacaagtaataaaatcttaattaattgtatgttaatttcataacaaatcagtaaagttagctttttactatgctagtgtctgttttgtgtctgtctttttgattatctttaagactgaatctttgtcttcactggctttttatcagtttgctttctgtttccatttacatacaaaaagtcaaaaatttgtatttgtttcctaatcctactccttgtttttattttgtttttttcctgatactagcaatcatcttcttttcatgtttatcttttcaatcactagctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtaaatacattagtaatgtgattatggtgtcgtatcatcttttgagttagttatttgtttatcttactttgtaaatattttcagctatgaagagcagcaaaagaaggatttggtatggattacccagaatcacacatcatgactgaatttgtaggttttaggaactgatttgtatcactaatttattcaaattcttttatttcttagaaggaatattctaatgaaggaaattatctctttggtaaactgaattgaaagcactttagaatggtatattggaacagttggagggatttctttgctttttgttgtctaaaaccatcatcaaactcacggttttcctgacctgtgaacttcaaagaacaatggtttgaagagtattgagagactgtctcacaagtatgtcatgctcaaagttcagaaacactagctgatatcacattaattaggtttatttgctataagatttcttggggcttaatataggtagtgtttcccccaaactttttgaactccagaactctttttctgccctaacagaagagttgttattgaacacagtttgggaaaggctgatgggatttggaaatttgaaagtgaaggatcagaattttagttttttcccttttgtgataaagtagaacagggaaaagatgcagtcttttgggtagtctacttaacttcataattctgaactggttcagtttctactgtaaatataaccacttagtaactgagcttgcttacgtttaaaattgagtacatgacaattacaggaaaaggtttccactgaaggtaccatcagaattgtgaggagtgtgcatagaataatgtatgtcatttcccttcagctttgagatttgagctgttatagcctgttgattctaattgagttgacctttctgttactgttcttagtcacacacacacacacacacacacacacacacacacacacacacacacgcatcccttatctataatctagctagtgttttattaataactaaaaagctatgccatttgtatgtagtttgttctaagtaaatcagagatacataagacgacgccctttttgagatagaaaattataaacttcataaagttcttaaatttggtaaaccttagctctagcttttgatgtatctagaaatgttaaaccttagctataaagcatacttgcattatatgcagaaatacttgtaagaaaaaacatagattaagcagttccagtaagataactgaagtgatggcagtagaagtatcaaaaaggagtattttaccaggaggttatggtgcttttctccctggaacatgagaaaatgtgcctaaaatggaacttcagagttatattctgattaacttatagcttgttgctcttggttccaaggaagggcatttgtgacattttattaaattcattaattttttagacacaccattgtcagcttgaacaaatttattaattgtaattatttgtcagctgttcttgatcctgttaataccatacttataactaaaagcatttccatggatgttgtaacttggcctgtaaaaaaaatgtttagatagaaaccatgaaactcaaatatgaattgtttaattttcaaaccattttgcattcagaaaatgtcctaagcttaattcatactcctagtgatcaaggaaacatgttaaagctccttatttttaaacttaaagtgacaatgacattttcaaagattttaaaattcttataaacaggttaaaatacttatatactgtataatttgatttctgatttctaagctctacttttctattggaaattacagatttttttcagacttaattcttaagatgttttcattgtttcacagtagcaactaaacatgtagtaaaatgatttaaattcaattaaaatttttttccttagtcatttaaaagggaagaaatcaatttttagtagtactcattccaaagattccaattttccttttttttaatcttttattttttggtggagggaggcaggatctggctctgaggcccaggctggagtgtagtggttctgtctcggctcactgcaacctccacctcccaggctgaagactcaaaccatccccatgcatcaccctctcaagtagctgagactataggcacatgctaccacacccagcttattttttgtgtttttgtagagatggggtttctccatcttgcccaggctggtcttgaactcctgagctcaagtgatctgcctgcctcagcctccccaaagtgctgggattacaggtgtgaactaccacaccgggccccaattttccaatgagtgatataaaaaaggcctccacgcaggcgcctgtagtcccaactactccggaggctgaggccagagaatggcatgaacccgggaggcggagcttgcactaagctgagtgctgctgcactccagcttgggcgacagagcgagaccgtctcaaaaaaaaaaaaaaaaaaaaaagcctccatgattggggcttgcatagtgaagaccatgtgaaattgaaagactacgaaactacttttcttttacgtattggcccataattaacatgtgtattgaatagctttgtttatctaagttcatcagatttatccaggtttatgtatttcagatcatctgattttattaggaaaatgctagaaaaatttcatggcaccattgtctaattttgaaaaaacgaacctttctttactgtgattaaaaattgttttttaggccaggtgtggtggctcacgcctgtaatcccagcactttgggaggctgaggctggcagatcacgaggtcaagaggttgagaccatcctggcaaacatggtgaaaccccttctctactaaaaatacaaaaattagctggcgtggtggtgcacacctgtagtcctagctactcaggaggctgaggcaggagaattgtttgaacctaggaggcagaggttgcagtgagctgagatcgtgccactccagcccaccctgggtaacagagcgagactccatctcaaggaaaaaaatgaaaaattgttttcaaaaatagtacgtgtggtacagatataagtaattatatttttataaatgaaacactttggaaatgtagccattttttgtttttttatgtttatttttcagctatgggtggataaagcatgaatataacttttcttatgtgttagtagaaaattagaaagcttgaatttaattaacgtatttttctacccgatgccaccaaattacttactactttattcctttggcttcataaaattacatatcaccattcaccccaatttatagcagatatatgtggacattgttttctcaagtgctaatataatagaaatcaatgttgcatgcctaattacatatattttaaatgttttatatgcataattattttaagtttatatttgtattattcatcagtccttaataaaatacaaaagtaatgtatttttaaaaatcatttcttataggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagtaagttctttgtcatttttttaattcagtctcttagattttatttaaatgcaaaaatttaatttatgtcaaaattttaaagtttttgtttagaatctttgttgatactcttatcaataagataaaaatgttttaatctgaccgaagtaccagaaacacttaaaaactcaaagggggacatttttatatattgctgtcagcacgaagcttttgtaagattgatttcatagagaagtgtttctaaacattttgtttgtgttttagtgaaatcttaagagataggtaaaaatcagagtagccctggctaagggtcttggtagttacaacgagtgtgcctgctcctaccacccccacccccaccttgagacaccacagaatttctcatagagcacagtgtgaattctattgctaaattggtggtatggggtttctcagcagagaatgggacatcacagtgactgacaatctttcttttataggttggaaactatttgggggactggagggatactgtctacactttttacaatttttattgataagatttttgttgtcttctaagaagagtgatataaattatttgttgtattttgtagttctatggtggcctcaatttaccatttctggttgctaggttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggtaataaatgtttttatgtcacattttgtctcttcattaacactttcaaagcatgtatgcttataatttttaaagaagtatctaatatagtctgtacaaaaaaaaaacaagtaactaagtttatgtaaatgctagagtccacttttctaaatcttggatataagttggtatgaaagcacacagttgggcactaaagccccttttagagaaagaggacatgaagcaggagatagttaatagctaagtgtggttgtagtataaagcaagaagcagggtgtttcttgtattaagctgtaagcaggaacctcatgattaaggtctttatcacagaacaaataaaaattacatttaatttacacatgtatatcctgtttgtgataaaaatacatttctgaaaagtatactttacgtcagatttgggtttctattgactaaaatgtgttcatcgggaatgggaataacccagaacataacaagcaaaaaattatgacaaatatatagtatacctttaagaaacatgtttatattgatataattttttgattaaatattatacacactaagggtacaaagcacattttccttttatgatttgatacagtagtttatgtgtcagtcagtacttccacatttttgctgaactggatacagtaggcagcttaccaaatattctatggtagaaaacttgggacttcctggtttgcttaaatcaaatatattgtactctcttaaaacggttggcatttataaatagatggatacatggtttaaatgtgtctgtttacatacctagttgagagaacctaaagaattttctgcgtctccagcatttatattcagttctgtttaatacattatcgaaattgacatttataagtatgacagttttgtgtatatggccttttcatagcttaatattggctgtaacagagaattgtgaaattgtaagaagtagttttctttgtaggtgtaaaattgaatttttaagaatattcttgacagttttatgtatatggccttttcatagcttaatattggctataacagagaattgtgaaattgttaagaagtaggtgtaaaattgaatttttaagaatattcttgaatgtttttttcttggaaaaattaaaaagctatgcagcccaataacttgtgttttgtttgcatagcatattataagaagttcttgtgattaatgttttctacaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccgggtaagaaagcaggtgtctgcaaaaagtcatgtatcgatttattgtttgtaatgatacagtagtatagcagataactaagacatattttcttgaatttgcagaatctagatttccaagcactagaagaaactacagaatatgacggtggctataccagggactctgttctgattaggtgaggtacttagttcttcagaggaagatttgattcaccaaaggggtgtgtgattttgcttcagacctttatctctaggtactaattcccaaataagcaaactcacaaattgtcatctatatacttagatttgtatttgtaatataatcaccatttttcagagctaatcttgtgatttatttcatgaatgaagtgttgttatatataagtctcatgtaatctcctgcatttggcgtatggattatctagtattcctcactggttagagtatgcttactgctggttagaagataattaaaataaggctaccatgtctgcaatttttcctttcttttgaactctgcatttgtgaactgttacatggcttcccaggatcaagcactttttgagtgaaatggtagtcttttatttaattcttaagataatatgtccagatacatactagtatttccattttacaccctaaaaaactaagccctgaattctcacagaaagatgtagaggttcccagttctatctgcttttaagcaaatgcccttactactctactgtctacttctgtgtactacatcatccaattctgaaagacataggcttccccatcccctgctaagactggttcaagtggcagctactgatggattgcagtgagaaggcatgcaaacacgtaccttcctggaagttgtctccaaaggctattgctctaagactcaagtatataaacactagaatgaatatcaactctatctagcaataaatgttatttttatattacagttgacccttgaacaacacagctgtgaacttcatgggccctctgacatgcagattttttttctcaactaagagcagattcagtattggtgggactcagaacctgcatatacagagggctgactttcatacatgccagtttcacagggccaactgcagaacttgagcgtgcatggattttggtatacacacgtggtcctggaaccaatccctgtcacatataccaagggatggctgtatgttactttatattcatttgttctgttattttataaggttgttcgtcgtggtatgtgggaattcaccagtatttcttctttctggtgcaccgttggtcatttctggcagcagtggtgaatgtatttactcttagcaacctctgtgctgctacctgttctgagtttcaaaggtgattcattaaagggttgggataacatggtgataggaaaaacccccctcatcagtcacaaggagtataacagcaatatctctgtaatatgattgatcatagatataatttctagtaggaaaaaaagtcatatcttgatgcatctctgagaatagttgaacatatcttgtgctattctttatagagaaattatctttgaaattaaagtcttaattttacttctagctttttataacaacataatccctacttggtatgtatcttaagatcatttttaaatgtatgatttgaagggcaaactagtgttatgtgaaaaatgacagataaagtagcttccaactcatcctcaagagttgatgatattctaaaccttttctaactaaattcagcttcttaattttctcaatataaatatgatgaaaatattaattcattaaatagtctacaagtattcggtagttgaagacttaaagtagtgcttgtaataacagaagagaaaaaagacattacaggcgtatctcactttattgcactttgcagatactgagtttttttggtggcaaccctgcatcaagcaggtctaccagcaccatttttccaacaaaatgtgctcacttcattagcatttttagcaatgattttaaattaagataatgtacttatttttagacaatgctgttacacacttgactacagtataatgtaaacgtaacttttataagcactgggaaacaaaaaaatttgtgtgactcactttactgccataatcactttatttgccatggtctgaaactgaaccggcagtatctctggggtatgcctgtatagatattttggttggtatttatttattgtatgcagaattcataaaaataaaaactgcgaggctgtttaatacatttcaactaaaagttgccagcatcattaatatgtaaaccactagaaataagattttgttaattttttgtttgtttgtttaaacagtcttgctctgtcactgaggctggagtgcagtggcgcagtctcagttcactgcaacctccgcttcctgggttcaagtgattctcctgcctcagcctcctgagtagctggggttacaggtgcacaccactacacctggctaatgtttgtatttttagtagagataagggttttgccatgttggccaggctggtctcaaactcctgacctctggtgatccgcccgcctcggcctcccaaagtgctgggattacaggcgtgagccaccatacctagcaaaatcaactctgaatctgaatcaaacctttgaaacaaaaattaccaatcaaaaaaacgtgcaatccctgctcctaactttgaaaaagtgacaaggaaggacatttggaaagatgtctctaagcagtcaacaagaaatgaaatcagggagagctttttcagcacctgaaaaaatacatgcaaaaacgcccgaggcgggcagatcaccggaagccaggagtttgagaccagcctggcaaacatgggggaaaccccgtctctactaaaaatacaaaaattagctgggtttggtggcaggcagctgtaatcccagctcctcgggaggctgaggcaggagaatcgcttgaacctgggaggcggaggttgcagtgagcctagatcgtgccactgcactccagcctgggcaacagagtgagattccatctcaaaaaaacgaaaaacagattcagagtttatttccttcccaaatacttcatagatgttggtttgtaggaataacttaaaagtctcactcgctttctgtcttttctagtaatttttatcgtggattctgattgcctagatctgctaattcattgagggttacaaaattgtgatactcgaattctttattcctccttcctttattacctgtaatacttcttaagaaaaactctttctcatcaactctatgactaccctaaattacagatccacatataggatctgtatacatgtatataaatatgtacatatcatatacgataatgcttaattctttcccattacttactaattttcaaaataatgtgattccctaactgctctctgaatgttatcaatgtggtggtaataatggtggtgtcgatgttgtgtggggtaaaatttgaatacagtgaaatacccagggcttaattgggttagtttttaaaaattacatttatgtaaccatatttcagtcaaggtgtagactatgtccatcagcacagagttcccatgttttcccttccagtgaatctccatcccccattagaacagacaataactgtcctaattactgtcactgtagcttacttttgtctgctctagaatttcttatgaatggaatcttatgtacttgtactgcatgaagactctttagattcatccatgttattgcattgatttatagtgccttttaaaaaattatagagtagtgttgcattatatgaatacgcaaagtgttttttttttacctgttggtggacagttggattgtttccagtttgggactattgtgaataaagctgtgtagtcttattgtggaaatgttttatttctcctgggcaaacatgtaggagtggagtttccaaagcatatagcaggtgcatatttaactaaaagtgtcttttcctcatttttaatattggatttttgtatttctattgactatagatattttcttaaaatatagcagtatgtcttatccttagttttgcttttttttggtttcagttatctttggtcagcagtggtccaaaaatatttattaagtagaaaattccatgaataattcagggtttttgatgtatgtgtgtgttggcgggtgcagggcagggagagttggttggttggttcgttggtttttttttttttaaagagacaaagtctctgtcatccaggctggagtgcagtagcatgactacagattgttataaactgaaactcctgggctcatgcaatcttcttacctcagtcctctgagtatctgggctcatgcaatcttcttacgtcagccctctgagtagctggtactacaggtgtgcagctaatttttagttggttatttttttgtagaaacagggtctcactatgttgcccaggctggtttcaaacccctggactctagcaattcttccacttcagccttccaaagtgctgggattacaggcgtgagccactgcacccagccaacaactcttaagttttaaattacatgctattctgagtaacatggtgaaatctcccacctttccacccagggcatgaattatccctttttccagtatatcgttgttgtctagactacccaccacttttagtctactggttatcagatcgactgttgcagtatcacatgcttgtgttcaagtaacccttattttacttaataatggccctaaagcacaagagcagtgatgttggaaattcgaatatatatgccaaagagaagctggaaagtgcttcctttaaggaaagaatttaaaaatcatatgttgaggttgctaaaatctatggtaaaaatgagtattgtatctatgaaattgtgaagaaggaaaaataaatcatgcatagtatatacagggttcagtactatttgcaatttcagacatcactggaggtcttggaacgtattccccatgggtaagtggggaatactgtatattctatataaaaggcccatttctgataagtagtttatgattattttctccaagttttcattttcttaagtgtcttctggtgagcagaaattattcattttttgaggtctaatttattttttcttttatggttttttatgtccttttatatctttgcctagcccaaagccacaaatatcttatgttttcttctaattgtgtaatataggtttaacttttatgtgtaaatctgtgatccaccaccaataaaattttgtgatgctgttagacagtggatgtcattcattttctaaatagttttatttatttgttccagtaccatttgttaaagagacttttctttccccattgaattgcctttgcacctttgttgaaaatcaatctgtgtgtgagccgtgtttctggattctccattctgttctattaatttgttttgtccttttgccaaaatgacactgttatggttactgcagcttcaaatcagatgctgtgagtcccacaactttttcattaggttgctttgacttttatttgcatataaatattagaatcagttaatttttacaaacaaaagggcaaagcctgcagagattttgatttgggttgccttgactggggcaggtcaatttggagagaattcacattttaacaatatattcttccaatccttgaacaccgtacgtctctccatttatttagatgtttgttagtttatctcagcactgttttatagtttttaatgttgaaatcatgtactctttggttaggaataaacttaaaatatgtttctaatgctattagtggtattttttaaatactgcttttcacttgtttattactatcttgaaataaaatcgatttttatatattgatcttatatcctataacctttctaaattgacttattctagtagttatttagtagatttcatagggttttctagtaaacagctatgtcatctacaaatcaagacaggtttctttctttccaatgtttatgttatttattactgttcctctattgcactggctagaacctttggtagaaggtattcttactttattcctcattttattgagagagactataatatttaccattaactgtgatgttacttgtaaacaaaaagtttgtatttctctgggattaaaaaccaagagtccatttggttttttactgttgagttttaagggttccttatgtattttctaggtatgttcttccttcattgaattgtttttttcacatacgttaaaaatcacttgagaatatttatataggtctgcttctgagatttatctgtttatcaggttttgtttcatttattttgaggctctatcatttggttcatacccatttagaattactatgtcttggtgattggtcctttatcattatataagttttttctgttttgcgattttctttgctctgaatctgatatgagtgtaaccatttgtttttttttaaattaatgtttgcatgatctgtcttttactatcattttactttcatcctgtgttgctgaatttgaaacgaatctcttgtaaacagcatatagttgtcattttaataaaaactgttagtctctgccttttaatttttttatttagaccatttatatttaaggtaattattgatatgttagggagaggtctgccattttattatttgttttctgtttctgtcttctgtttatggttatttatttattgccttccatgattacttgaacattttttaagatttttaagacccttgatttatttagtgtttgggttttgttttgtttgtttgtttgtttttgtttcgagacacagtctcgctctgttgcccaggctggagtgcagtggcacaatctcagctcactgcaacatcggcttcccaggttcaagcaatcctcccgcctcagcctcctgggtagctgggactacaggcacatgccaccacacctggctaatttttgtatttttattagagatgaggtttcaccatattggccaggctggtctcgaactcttgaccttgtgatctgtccacctcagcctcccaaagtgctggaattacaggcatgagccaccatgcctggccttctatgtgttttttatagttgttttcacggtcattgtgggtatcacattatagataatgtgacttaccaccattcactgccatcaataccattacatggaatgagatatggaaaccttaatttcagttgggtctctttccccacttttaaatagtattgttttgaggattaatgctattacagtttttgtatcagttatccaatatgacttatagaacttatcaagggagtgatgctctgttgtatgtacccatgtttctgctatttccattattttttccaagattccatcttttattacttccattagccagtcttcaaaggcagttctgctagtgagaaattctttttgtttttctctttctgaagatgactttattttccctttattcccaaagaatagttttatttgtgctatttggggttcgctcagcttcttgaagctgtaagtttgtgtcttttgccaaacatggaaaattttcaaccattatttcttcaggtgttctttcagcgtcactcttttctccattctaggcctctaatgatacaaatgttgagtcatttgttactgttccacatggacctgaggcatggttcatttttcagtctattttctctcttttgttcagatttctctcctttgtcatcttcactctactgttgagcccatctaatgattatttttctcctattgtattttttaggtctataatttccatttgcttttttttccttgtaacttgtttccttgctgagattttctattgtttcgtttttgaaacagtagaacttgtaattgcttgtcaaatcatttctctgatggcagcattaagatccttgccagataatttcagcatcttactcatcccagtgttggcgttttctttccttcatgtaattttcctggttcttggtatgacagataatttttggattgtgtctcggacattttagttattatatcaggagactctgtactttttaaaaattttaacttcagtagtaacctgttaaggtatagcatgtaggtactagcatatatttgtgagctgtggttccagtgaccatttttcagaggctttatggtgctgttttggtttgttgcttttatctcagtccactggggctcgcactggttcctagtagtgctgcttgaggggccttctccaggctgagctgcgcagagtgtgtttgggtgagggaagaggacccccactagattttcgtgggctggagagtgcttcctgagccttgtgcctgttgtggcaggctcccccttgctggtgttcctggcagtgctcctgaccacattgtgtccctgggctgtggaacacttgcaggaaaggtgaacactgccaggaccaattatagcagaattcctcctgccagtacacagcagcactgtggctctggaccagcaaggagagtctcaagcatgggtttgtttctttttgattttaagatttttcttctgccttcaggttctggtattattgttctgttttattcacctttatgtttcttctagtttagttttagtttctttgtatttgatgggatttttttccttgcatttctaattactccttagttgtgtcatgtcttcctttttttcagttaccctcattcagaaatttcccatttctaatgatttgttattttttaaattctttttagctcagtttgaaatttgtttacagttttcatgttttatttgcatattgtttcatgtactttgattttctgtagggacaccattctcatgtatatgcacatactttttctctaataattacactgtttcactctgttctgttatttatttatttgtgtgtgtgtgtgtgtgtgtgtgagtgaaatgagtttctcatacttggacgagggagagatgggccaggataacttttttcgctttttagggacgaggagaagtctgtgtttttgtaaaatggtcaaaaatatgcccttgtgctttctgaaactgccttctttactcctctatcccacacatatatttgaacttttttttggtttttattactgacctggtccatttggaagttattcccagaagtttttcctcggtacaaggtttgtttctggtgggggtttggtattcgggtgttttaagggcccagagcttactacatcatgatccctttgtaatcatctgcaaattagatcctgtagaactttttaaaactttaagccctgttttcagattggcctgtgctttccagtgggttggcagtgttctcagggctgtcagaaacccagtcagttaccttgcatctgcttccttactaaccagtcttgtagttgtcagagctttgtttctgtccaattatatgcaatggttcatggttttgttgtagataatgtctctgggtctttggttttctcattcagtttgctgtttttgtaggggaggttgggagggaataaaacaaaaaataataataataataactatgtcgttgccatcatcatctttccagaacctgctacctgcccttcacctgattttcgtatttatcagtatcattaccttaatctgttatctcattggggattgcaaaatggctgtttggggaaaaaaaatttccatctgcttgtcctacatatatacctggcattcttttttctcatcattgggtgccatttgattaccttgaaaaacagttctacagaaaaggcatgataaaatagatttaaggtttttagagtaaggagttaatgtaataattttaatagtgacaatttaattttgttttttggttggtttttgctgcctttttgaatattacgaactaatgaatgtttttgtatttaatacgtttcacagtcattactctaaatgatattcaaattgcttagctatcgtgtgcttttaaaatgaccctattagattttgagatttctaactaatctcgaacattcattctcaggcctggaataagttatttttccaataaattgttggagaatggcatttagaagtcagattttagatgcaaagtatggcctttgcttttgaacgttactgcttgtaggccttatcagaggacagaactaggaaaataatcttcctagtgtatcctgagaatcatcccacattattgcagaggtgttttccattttgttttgtatgactgaatactgctcctttgtgtggatgcagcatagcttatcaatatttatgggcatcgaggttatttttaaccttttgctgttagtactaatgtcacagtgaatcctcttaatgttcatgcattattccgtacatatgtaaagtatcattaagataaattgttagaagtgggattgttgcatcaaatggtagatgcatgtgtaattttgctagatactgccaaatcctccttcacagaaaaataacattttgcattcccaccagcagtttacaacagtatctcttttcttaaaactttccaaacagaatgtgttgttaaatgtggatgtttacttatttgccaattgagaaatggtattttactatagttacaatttttgagcttacctcaattatgaatgataatggacattttttcttgtagagctgtttatagttttatatagtcttttgctcattttgctgctcagctggtcgttttcttcacttttagaaactttatatgttaaggagattagtcctttaacgctggtaaattcgcaaatattttttcccagtttgtcatttgtcttttaaccttgcttataggatttttttgccaaatgaaaggttttatgtttatgtagttagctattaatctttttcgttattatgctttgatatgcatttctttagttatgtttattttattcattttctttgttttttaattttctagagtctgtcctcagtagaaattttagtcatactgcttcttctttggtcaccttataataaaattagcctttatttccaaagttaccttgcatatttcttcagtattttttagtattcttatttttatttaagatgtgctcatttctttctgaatttgtatttctcatcactggtggtctgtcttgtctgctgctgcattctccttttgtgttggaatgtggtgttactagtttcccattgtttatgactgaatttttctggtctacttttgtctaccggaaagttttgcttctcattcgccagactcttcccataataactttatttagacttccgaattctgtttttcttgtttatgtttctataacagatgttacttttttctggacctgttattactagacctcatggtggagcagggaggaattgtgtggctttaggggtcttggttgaagggatccctcttctgttgctttagtaagggcagaatcaccactttctgatttttcagctccatgtagcttaatgaagactctttttcattagctgcttccacccctttacagccgcttaagggacacttctgcttttgaaggtaccccccttcctttcgtgcatggtgccttcctgagcctgccattgctggacccaagtacttttctgtagtccttcctttaaccaccctgttgccagtgctctaacctacactcagtagtgctctgttgaggggcaggtggtggagggggtggggtctggccttgggtgatccctaatcagtatgattccgcacaagccactcttcgatgtagctcctgctggaccctgctcatttccccacttctttggtatttggagtttattgttctgtctcctagttttactctagacctaagtcataggttttttttttattttcccctttttgatccgggtagatttttagagatgtgagtaggatgtgatcgatacagccaccacttttatgtggaaacctggaagcttcttcgtgttttcttcagctttctaaatatatgcattcttgtttaattcaaaatgttaatgtaacacacataacacttataggaatagagatgcattttgttccctgttttcattgtataaaatttttaaaggtttcgtttaaaagtccaaagaaacagctccgtaataatatagccagactggtcattgtgaccactgctgatctgccacttcctgcagggtctgtctctgttcttcggtggtgctctttggtctacctccttaggtgtagctggttcagttaagcttcagagccctcctgcagtgtgaggaggctttattaccacccactgcagggcagcttttctgctatgttggagggttctgtgctacagcagacttgttttctcttgtcagcctccccaaaaggagtatcatgaactggggtccgattcctctcctccttacctgagagatgctcctgcaagtttcatgtccagttttctgttgttgtgtgtttcttttttgttttctcttgctgactggtggatttgtaaaggggcagggaagggaagtggcaagagattggagaaagccaagaattctaataaaacttttaagttatttcagataaatggtgttgcagcaccaaaaatgccagcattttggtaataaaaatagtatgttgggatattagaatatcaaaaggtagaaaattgtaattactggtttgggatgtgtgatgttctctgctaacattctggaattttttttttttttttttttgagatgaaatttttttttttttttgagatggctcaaaatgtttcccaggctagagtgcaatggtgtgatctcagctcattgcagcctccgcctcccatgttcaagcaattcttctgccttggcctcccaagtagctgagattacaggcatctgccaccacgcccggctaatttttgtattttagtagagacagggtttcaccacgttggtcaggctgatcttgaacccctgacctcaggtgatccactggcctcagcctcccaaagtgctgggattacaggcatgagccaccacacctggctctggaaagaactttctaaataactattaaaatgcattttatattatataagcaactaaaaatacttttaattttttttttaattttttaatcttaacattatttagctataggccaggcgcggtggctcatgcctgcaatcccagcactttgggaggccaaggtgggcggatcacgaggtcaggagatcgagacccatcctggctaacatggtgaaatcctgcctctactaaacgtacagaaaattagccaggcgtggtggcaggcacctatagtcccagccacttgggaggctgaggcaggacaatggcgcgaacccaggaggcggagcttgcaatgagccgagatcgcgccactgcactccagcctgagcgacagagcaagactctgtctcaaaaaaaaaaaaatttatttagctatgaactagtgtatatatgttttatagatgcctgattattcaaataaacttcaagattgcactttatgagcttgtatttcgttttttagaactcaaactaacataagtgtcattaaaacatagcttttattacatagattttaggaatgccacaggataaatcattctcttaaaataactgcaggtggcagaaatgtcagaataattctcctcctccatacacagcacatattacttgtttaaagtattctagttcatataaaaattgaacttttgtattactgctattaggtatgtagttgtttgcatttggggccagttggttggggcagggggtctttttttcttttgtccttaatctgtatcactttttcctcccaaagttgagttaaaggatgagtagaccaggagaataaaggagaaaggataaataaaatatatacccaaaggcacctggagttaatttttccaaatattcatttcagtctttttcaattcataggattttgtcttttgctcattactgactgcataatgtgattataccatagtttaaatagtcacttcctgttactacacacttgggttttctcaattttttactattgtagtactaatattttactatattgtaatctaatctaaatttttacgtattcagagctgttcaggataaatttgcttggaaatttttaaatcaccagaagtgatactatcctgataattaacttccaagttgtctcttaatatagttttaatgcaaatcataagcttatgttagtaccagtcataatgaatgccaaactgaaaccagtattgtattttttctcattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggtaggtaattattaacttgtgactgtatacctaccgaaaaccttgcattcctcgtcacatacatatgaactgtctttatagtttctgagcacattcgtgattttatatacaaatccccaaatcatattagacaattgagaaaatactttgctgtcattgtgtgaggaaacttttaagaaattgccctagttaaaaattattatggggctcacattggtttggaatcaaattagtgtgattcatttacttttttgattcccagcttgttaattgaaagccatataacatgatcatctatttagaatggttacattgaggctcggaagattatcatttgattgtgctagaatcctgttatcaaatcattttcttagtcatattgccagcagtgtttctaataagcatttaagagcacacactttgcagtcttgtaaaacaggtttgagtattttctccaccttagaggaagttacttgacttctcagtgacctaacctctaaagtgcatttactgatgtcctctctgtggttttgttgtggaaagatttagttaaatgaactgtaagaattcagtacctaaaatggtatctgttatgtagtaaaaactcaatggatacagtatcttatcatcgtcactagctttgagtaatttataggataaaggcaacttggtagttacacaacaaaaagtttatgatttgcattaatgtatagtttgcattgcagaccgtctcaactatatacaatctaaaaataggagcatttaattctaagtgtatttcccatgacttacagttttcctgtttttttccccttttctctatttaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttat

SEQ ID NO: 17595 - DNA, 117838 bp, Human
  misc_feature (1)...(117838): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctatcctgtgtagtgtctatatcagccacttcctcttccagcactagggtggccatgagagagacagggatggagcagggaagtctaaggagacagaacagggcatttactgggaagtttttaatagagtcagaatcaaggttcaaactcagatttcccagttctcagtgctgcctctacagctgcgtctttccattgattttttttgttctttgggtttctgtccaacacatatttattgtgtgctactgtgtgctagtgactgttctagtcagtggatatccagcagtgcgcaaaccgagtatggctcttctctcatggaacttatattctagtggcagggagacagataataaacagataaggtggtgaaaagtactttggagaaaaataaagctgggtaggagagaaagaattctagggtagggttagagagtgaatgagggaagggatgtgttgcttttaatgtagaatagaagggaaggcctctctgataaagtgacatttgagcagaggatatgccatgggaatgcctgaagaaagactgtgtcaagagagggcactactcaaaggtgccgaggcaagaacatgcctggtgtgttggatgaacagcaagaaaaccagtggggctggagtgtagtaagagagggtagtgtggtaggaagtaagatcaaagtagttaagggagtcaaatcatgtaggacttttaacctatgtaaaggattttgacttttcctgtgagggaaggggaagggattggtggggtttatgtagagaagtggcatatatgacttatattttataagagaaccattgtggagtaaaattaggggagaagggacaaagcagggtgactgtggcatttttgttgcagtaatccataggattagctgatggattggttatggaatataaatgattttgatgatttgagcctgagcaagaggaagaaggaactgccatttgctgagatgaagaccatggaaggagaaagtttggagtagggatgaagaaagcaggaattggacttcattgactcttgaagtgttagagttggaagagacttcgagtttatctagtacagtcgtttccttttacaagctagtaatactaaatactgagaggttaaatgactttcccagagtcaaacagcctatactacctgttgtgcagcataaagagccctggagttgtagtcatgagatgtaagttcaaattgtagcttttttgtttcttagctctgaaccttggtcaagtcatttattttctccaagtctgtttttcttccatcaaaaaggataataaagacttccatttcctgttacgatgttgcaaattgcaacagttgacattattgctcccactctggtagtgagaaaagtcagagaaggtacaaaatcataattttaaaaaacctatcagagttgacacaaaaaaatctaaagaaacaaaaatctggaaagtaatgagtgagccttctcaagagaaaaaaaaaagagatacataggtactttcatctatggtggaacagcaagaggaagaatttgcaatagatagttaaagagaagtcaacagttactgactgcacataggctggagtgacagtttggaatcctgaggagttccagctacagtgcaggactacacctacctgccaacttttcccatgggccttcaattagtacattggaataggagttcggatgctggggcaagggaaagagagctaagaagggtcctgctgaggtgggtggattctgctgaaggttgggggcagggcaggagagttaagagaaatccctgtagtgcaccagggggtttatgaaatctaagcctgggcgtgcaacaggctgggggcatggcaagacagctaagaaatctctttatgattatctaggcttttactgaggacaagccagcctttgagaaggcatagtcagggtaacagagcaaagagagatctcctcaaggcacagaaagcagaaggtgctactggagaccaaggacaacaccctagctgaaagctggaatgtgaggggagggcagagaggagggaagatatctcacagttaagaaaccttgcataggttatgaagctcagagatctgtgaagcttcaacagtgctcagattttagcttctcctgaaggtaaagttctgatttcaccctgaaattattataaggcaatcatggactaacactacaatctcaaacccagctcaactatagattaaaaggattgagcctccactgcccagtttcccagcaacttaattgaagaaggaactttcctttatggagataaattaatgttcttttatacgcagtatctggcatgaaataaattatgagatatccaaagaaacaagaaaatgtgatccatggtcaggggaagaaagaggcaacagaagcagtctcagtgatggcccagatgttgaacaacatggataaacagagaaaatttcagcagaaagatgtaaagtgtgaaagataaagatgtaaactatttctccaagtagaaatgctagaaatgaaaaatatattagaaatgaagaattcatttgataggcttaatagcagactgcacacagcagaagaaagcaccagtaaacttagggacagatcaataaaaaatcagcattcaagatctgtgggacaatacaaaattgtctagtatatacctgtaactagagttcaaggagtggaggaagagcagggacagaagtctgaactgaggtacatcagattcaactttctgaaaatcaaaaatttttataaaggaaatcttaaaaggaggtagaaaagaaaaatatatataaaggtgaacagtaatatgaataattgacaccttgtcagaaacagtgcaggtcagaggacaatgaaataattttttttttttttgagaccctctcactctgttgctcaggctggaatgcagtggtgtgaatatagccgactatagccttaatgtcctgggctcaaggaattctcccaccttagcctcctgaatagctggaactacaggtgcatgccaccatgcccgactaattttttaaattttctgtagagacagtgtcttactgtgttacccaggctggtctcaaactcctgagctaagtgatcctcctgacttacctcccaaagtattggaattacaggcgtgagctactgtgcctggcctggaagaacttttttaaagtgctgtattttttcttaagcaaatctgctaacctggaattcaatattcaaaagtgaaggagaaataaagatatttttgacagaagcaaaaacaatttgtctacatcagacctatattacaatgttaaaagaagttaagttgaagggaagttataataaaggaagttcagatctgaaggaatgaattacaccaggaagggtaaatatatggataaatataagggaccttttaaaatatgtttctttaatacatacatttattttaaaaatatggactatttaaagtagaaataataacatattatttggtatatagtagaagtagaagtaagctatccaacagtaagtgcacaacaagcaggggaagtcaagtgaagttagactgtgataagttaaagatgcactctataatcactaaagcaaacattgaaaaaaaatacagagaggtatagctgtaagatcagtgaaggaaacagaatgaatatcacattatggaaaaagtcaggaaagcagaatagaggaacaaagaagagaagcaaatggaaaataaatataaagatggcagacttaaaatcaaccatgtcagtaattacattaaatgtaaagaccatcatctccaattaaaagtttgcaattgtcaggctggataaagtagtgtggtacaactatgtgctgtctttatgaatcactgtaaatatgaaacacagattgaaaaagggtgaaaaagatataccatgcaaaaagcataagaaagttgatgttgctatattaacaaagtagactttaaaacaaggatcatttctagaaaaaaggatcatctataataatcaatttattaaaaatacataacaggccaagcacagtggctcatgcttgtaatcacagcactttggaaggccgaggcaggtggatcacttgagctcaggagtttgagaccagcctggcaaacatggtgaaaccccatctctactaaaaatacaaaaattaactgggtgtggtggtgcacacctgtaatcccagcttcttgggaggctgaggtgggaggatcattgagcctgggaggcagaggttgcagcgagccaagatcatgccactgcactccagcctgggtgacagagcaatcctctgtctcaaacaaacaaacaaaacaaatttgtgtgtacctcacaacaaagcttcaaaatacatgaaacaaaaattggcaaaaccaaagagagaaagaggcaaaaccacaatcatagttgaatataacacctctatcactaattgacagaacttgtgaagaaaaaaaaagtcagtaaggatataaaagatttgaacaccactatcaaccaacttgatccttggcatttatgaagcactacacatcactacagaatttgaaaaacagcaaaatggcagatgttagtccctccttattagtaattactataagtacaaaaggattaaatttactaactaaaatgtagacactggcagaatggataaaaaaaaaacaagcaaaaaacttcccacatgatccaattttatgttgtctgcaagagacccttgttagatcaatcaaaagacaggttaaaagtgagctgggttggctatactaatatcagacaaaatagactaagttataataaaaattgttacatgagacaaaggtgattatatgttgatgaaaggttaattcctacaggaaccataacaattataagcacatatgcaccaaacaacagagccacaaatatatgcagcaaagtgacaaatgcagggagaattttttcttcttttttctattttagtgatggaggtctgtctatgttgaccaggctggtcttggactcctggcctcaagcagtcctcccaccttggccctccaaagtgctgggattacaggtgtgagccactgcacctagctggagaaagtggttttataatagtaattggagacttcacagctgtcatcatagctaccatttgttaagcacttactatatgccaagactgtcttaggcactttacgtttatggactcatttcattcacaactgcccttgtggcaggttctatcactatccgtattttgctgaagaggaaactatggcatagaaaagtggcaggtcccattaatatccccattttgaggaagaggaaactatggcatagaaaagttaaatgacatgcccaaggtttacaaaggtgtaagtggaagatcttggattataagactcttttgggaaattagatttgatccttagaggtttcctagtctcatttcccactgaagaagggattcctttctctgacaatactggttctgtagactctacaggagcattgaagatgggggaatcactgcttcaacagcaagacattctagtatggcctattctaattgctagaaagtttttttttttcctgtattggggtgaaatctcacaactttgattcactagtctttgtaataacagaaaataagccaattgttctgactgttgagatatgtgaaggttttcatgtcattcaccactaaccccagcatcagttggagacttcagtaccatactttcaataatagaacatttagacagcagaataaggaaacagaagtcttgaacaacactataagtcaatgaaacctgacagagttatgtagaacacttaacccaatcacaccagaattgacattcttctcaagtgtacatggaacattcttcaggacagacatatgtaagaccacaaaacaagttccaataaatgtaaaaagactgaaataatactaagtatcttcttggataacaatggaatgaagctagaaatcaataatagaagggaaaactgggaaaattcacaaatatgtgaaaataacatttattttttttgaggacgggagtcttgctctgttgcctaggctggagtgcagtagcgtgggtcatagctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttataaatgtaaatgcttacattaaaaagaagaaaggccaggcacagtgcctcacacctataatcccagcacttttggggactaaggcagaaggatcagttgagcccaggagttcaagaccagcctgggcaacatagggagatcctatctctacaaaaaatcattttaaaaactagctgggtgtagtggcatgtacctgtagtcccagctacttgggaagctgaggtgggaggattgcttgagccagggaggttgagactgcattgagctgtgatcatgccactgtactccagtctgactgatagagtgagaccctgtttccaaaaaaaaaaaaaaaagtccagtcagtaactttgtacctcaaggaactagaaatatattagataatttagctatttaacatagtgctcactggaacttggaatacagtaggcacttactaaatattagtctcatatatccaacacaaagattcatcattgacactactttgaaaataaatgtaagttactatttatggcactatttccacttctgcagtttgttttggtggattgtttttttaatccaggttttaaaaattgagatattcatcatatactataaattttgctcacttaaaaagtacacttcagtgggatttagtatattcaccaagttgtgtgactgttacaactgtctaattcaagaattttttcataccttcaaaagaaacctcatatacactcacagtcactttccagccctaggcaactactagtctattttctgtctccatggatttgccttttctggacatttaatgtaaattgaaacatacaatatgtacccttttttgtctgctttcaatagcatattttcaagactcattcctgttgtaacatgtatcattacttaattcctttttattgctgactgatattccacattttggaataccacattttgtttatcccttcatcagctgatggacattttgtaattgtttccactatttggctattaagagtaatgctgctatgaacattcatggacaagtttttgtatggacatatattttcatttctctttagtcttgacttacaagtggagttgctgggtcatatggtaactctttttaacctttgaggaactgccagattgttttccaaagtggctatgccattttacattcccaccagcagtgtatgagagttccagtttctccacatgttcaccattacttattagtatcttttttattttagccaatcctatgggtatgatgcatctcactgtgttttgacttacccttgtcttacccttacgttgaacatcttttcatgtatgtattggccatttacatatcttctttgcagaaatgtctattcaaatcttttgcccattgtaaaattgggttgtcttttattgagtttcagaagttctttatagtttgcatacaagtgcctgctcagatctgtgatttgcggatattgtctccaatcttgtgggtttttttcctacactttcttgatggtgccctttgaagtacaaaggtcttttgtttgtttgtttgtgtttctgagacagggtcttgctttgtaacccaggctggagtgcagtggcgtgatcttggctcactgcagcctctgcctcccaggttcaagctattctcccacctcagcctcctgagtaactgggcctacaggcatgcaccatcatgccctgctaatttttgtacttttagtagagatggggtttcaccatgttggccaggctggtcttgaactcccaacctcaagctatccacctgccttggcctccccaagtgctaggattacaggcatgagctgccacgcccagccaggtcttttgttttgatgaagtccagtttatcaattttttttggatgtttatgctttcagtgtcatatctaagaaaccattgcataatccaaggccaccaagatttatgcttatgttttcttctaagggttataattttagctcttatatttatttaagtcgctgagccattttgaatttttttttatatgaagtgagatagggggtccaaattcattgttttgcttgtatatatccagttgtaccagtaccatttcttgaaaagacttctttctccatttaaatcagtgctcataaatttaagagtttatttctggattctctttattttagccagttttataattttattttagattatctgttctgttccattgatctatatgtctacccttatgccagtgaacacattgctttaactgctgtagctttgtagtaaatttcaaaatctggaagtttgcgtccttcaactcttgtttttccttttcaagatgattttagttaatctgggtcccttgcattttcatatgaattttttgatcagcctttcaatttctgtaaaaaaggcagctgtaattttgagaaagattgcattaaatctatagattagtttaggaagcgttgctaacataacactagtaagtctttcagttcatgaacatggatgtcttttgatttatttaagccttctttaatttttctcaacaatgtattgtataagttttcaatatggaagtcttattcttcctttgttaagtttatctcaaagtattttgttcattttgatgctgttgtaaatgggattgttttctgaagtttattttcaggatgttcattgctactatgtggaaatacagtttatttttatataactatattgtatatttatgtgttgtatcctgcagccttgccgaactccttgattagttctaattgatttttgtgcatttttagaattttctatatgcaagatcatgtcatctgcaaatagaggttgttttacttcttcctttccaatctggatgtcttttttatcttttgtctaattgctttggctagaacctctagtacaatgtagtatcaaatggccatgtattgccatttttatgaaacagtgataggacataaaatattttatattactcaatattagaatatggtggctgcatgaaattagtcacaccctatttgtaggacaataattggggccgttctgatctagtagtataaaaacaattaattttttccacattgattaaagaacattttcacaatttcctttttttttttctttccaggttttctcaaacaatgatgaaggccttattaacaaaaagttacccaaagaacttctgttaaggtaaatgtagataaattctggatgaagagtttagatctgatttagtcatcaagttccaagactatcttctttctcactgtgagtccatagcatagaaaaacagacagaattagcctaactgactttttgtttttgttttatagaatgctgttcagcttgttgttaaattttacttggtctaatccagaatgtactaagtatgtacatagcattggtctggattctttttgtaatgtggtaagtattgtaataatcttcagtaggtgccattgttttgttttcagtagataatcgtgatgaagtcagtaatatgaggagacattattgcaaggttgtgagctcctgaagtcataaagtttttgatgttttcagacaaatgagttttaaaataaatgcaaaaaataagcacagttatgatatgttcttagcacttaaaatgctgtcaaccccaagtattggtatgtttttattcatatgagaagtataagtgacagtagtataaaataggctttttgtcttttgtttctggcatcactgaatatacagtaaatgttattttggttgttgtttttactaagtaaagctatcagcaaacatttgttggcctggaggcacttcagttttctttagtattatgcaatcatcaaaagaaatcttattttaaggccaggagtggtagctcatgtctgtaatcccagcactttgggaggctgaggtgggtagatcacttgaggccgggaatttgagaccagcctggccaatgtggtgaaaccctgtctctactaaaaatacgaaacaattagccaggcgtggtggtgcacgcctgtaatcccagctactggggaggctgaggcataagaattgggaggctgaggcaggagaatcatttgaagctaggaggcagaggttgcagtgagcctagcctgtgctaactgcactctagcctgggtgacagagtgaaactctgtctcaaaaaaaaaaaaaaaaaaaaaagcttatttttgttttagatgttgttatattttaattctttatgaggaattaataggtgtacacatggtaatccttgatagtcattcccctaactgtttctcttatcactgatactccacaaaacaacagcaacagaaaccagattttgtgatcaaataactataggaaacaaactgtagtcctatagggttaacaaaacctataggacttcacagggccttaataggctaatgtgcatggcgatgatacaagttgggtaattgtgccatttcaaacttactgacaatggaatccttttatttttttaattttatttatttatttatttatttattttggtgagatggagatttactcttgttgcccaggctggagtgcaatggcatgatctcggctcaccgcatcttccgcctcccaggttcaagcgattctcctgcctcagcctcctgagtagctgggattacaggcatgtgtcaccacggcccagctgatttttgtatttttagtagagacggggtttcactgtgttgcccaggctgatctcgaactcctgatctcaggtaatccgcccgcctcggcctcccaaagtgttgggattacaggcgtgagccactgcgcccggccggaatccttttaatattccacagaaaatttgggggaaatgctgacatacaataagagattgaccagatgactccattccctggctgtactaaatctcactttaacatttggggaatgactatgagttttgtttaaatattgggaataattattttcatctcttcccaagttcaccacagaaccactttgtagatgccacagattactcacatttgctgtcatcaggttattaagacatttttccttcagttagaaatggggtaaggacttagcttctttgtggtagtgatcacatttcagggacttcagagggtgtttcattagtcatcaggtgttgtttgacactgttgtcatgagctccttctcagttgattaaaaaaactgagacaggattgtatgaaaaatatcaattatattttccaataagacaaatatttggataagagagaatgttctttggcatttttgacaagtttaaggtaagaaagtggtgacaagaaagaaatgtatgtttgccatataaacccaaaaggctttgctcaagcacagtaagttgttagaagcaataccgctgtgtcccggtgggcagattgtcactatacaactgcacggatgccatccacattgactacagtgtagatggtgccccctaggattatgcagtgcttgcagtctgggtctgaacatttctctagagtgggcatcaagctgtaatctaaatatggtattcttaccctggggaatcataagcagcttcaggcaggcccatgttggtcactaaacattagggtgtgattaaactccacccttctcatgcatacttctgctgtgactcaaggctactaactgaatggttttttccttctggtggggtttgcttttgtactccactgagccatagaacagtttctgtctgttgataccaaaaaaataaaaaggaattatatcactttctatggtagtgtgatttctaaactgcagtcttggaaacttcagttcttttaaagatccatgatggactcagctgttaggaattctggaggttgtcatcactacttatagcttttgaatcatgccataaagctcatacatagatcacttttcagaaagaattgccatttgtgagcaaatgttaatgtctcttcatagacttatgttcccacttgtattcttatttcagagtctgtaaggggaatttaaaatattgccactacagatcttctccaacttgtgagtctcaaaattaactctagccaaccatgtattttaatttaagaattttttgctggcctttaaatcatttctgtcattttactttcagactttccattctctgtgtagctttcccccttttcctagctatgctttcttttttttttttttttgagacggagtctcgctctgttgcccaggctggagtgcaatggcgcaatcttggctcactgcaagctccacctcccgggttcacgccattctcctgcctcagcctcctgtgtagctgggactacaggtgcccgccacaacgcccagctaatttttttttttttgtatttttagtagagacagggtttcaccgtggtctcgatctcctgaccttgtgatccgcccgccttggcctcccaaagtgctgggattacaggtgtaagccactgcgcccggcctttcctagctaccctttctaagaaaaatgttgaagaagggtttgaaccagatttcctaagcatccatcttcatcattagttaattccacaacattgggtgtaacaaagcccccacctcatgaagcttaaatctttattattttctgctcagttaaattatgtcttcattgtctacccttggcttatatttttatttcatattgtagacttctttgggacagtgtagtctgttgttcctaatcttgttgaattcctattcaccttcagtcttacttcctcaatacatgtgaattctttgactttgagacagacctatttgctttcagtccagatcattttctcttctgccacttttgactgcttctgttactgccatctttaattctcaactagcttccaatactgatcacatcaaccgaagcttcagcttcccctttggaaccattaacaagcataatctggaataatatgctgcttttcatctctctgttatcactttgaatccactcagaaaaatctatgttttcttttcatctgattttattgatagttttacgaatatatattatttacagattccttctctactacccatttttagtttgttactgaacaagtttttacagttttgctttttaaaatccagctcttgctcataaattaaggctactgaagttttttccctaccctttgctctcacatagcccaacaaacagcttttagtattattcttcctggggagtcagtcacataatttttataacagtggaagtacttaatttgttgcaaccattatctattagtgagttggagtatccttgcatatattttttcacattgttattgtccatattactgttggaatcagactttctgggttcagatttcaactcttcttatttattagttgtgtgaccttagttacttaactctctgggccttaatttgcccatctataaaatgggaatagtaatagttcttaccttatggggttgttgttcttagagtacctggcatgtaagtattaaataaatgttcgctcttattgtatattaatatcaatttttggatgcccgaatatttaataaatgctatttgacaatgcagtcagctttaatgcaaacaactgatgaatccagctcttaatatggatcttaatatatgctactgctaacaatatctcagtaaagtacctgattattaagtaactctgtgaaggcccaatgcttcatttcattaaactggacgaattcaatctcagtagaaattgcatactactatcttatattaaactgacaattactgttgcttaagcaaatgtgtggtggtgtgacacctgatttacaactgcaattaccttgcattataaaaaaagatagtctcttggagggaactcttccctttttgagaaaaaaaaatgtcttctgtgaattgaatattgacctaaaactcagattataaattataatagtaatttgactttaagttttaatttctactatggttgctttcagatgttagtgatgaagtaaaagcacatgtaaaacccctcataggagacagcaagtgatacctgcagtaaacagcttaaaacatcctgaggagacaaagctctagttagtcataaataataatgaaagaaaattactagacacatttaaaacattaaattactattattgatgtaattttctttcctttttaaatttgtgtggatacatgataaaatttattggcttgataaaggaagatttcattgccccaaatgagggatttgagcctaataattctgggcaatatgaaatcaaagacacaatttcatataatacaacagttttagtagttgaatttgcttgggaaaattataaaatgactagcacatcattttcaaattttccttttcttaaatttgtaagccaatcccatgagtgaaaatcattatggtttttgttggaatcattaagatatagcccagtgcttatcataggtccttggcaagcagtacagtaaagggctcattcctgctatgggtctcattgagtaggtcttgttgcctgctggttggtttcagcactccatgggctttttaaaggactgctgcctctatttcctgctgtctgtggtgcctgctgccttatataccagggcatcctaacaggtaagatgctcttttgggggtacatgcttcaatttcaaatttaagcatctatgcagattttccctctttgccgaagagtttttttaggttggtttgctcgctctcgtggttgttttttgacttgtgtgtggcagtgtgggactgaataaatgtgtatgttgaaatcaaatgcagaagcttaaaagccctcattttcattacctccctaaactgttatgtactgttttaaggttggcaccaaggtccaaattggcagaagcaaattttctttagtctaggttggggttatgcttgtatatgaaaactctgaggatgactttggattttatatctatattgagatgccatgaaacatcaatagagcttttctgataggaaggatagaaactagatacattttgcctcagagccttattcctagcaaattatattaagagatctattcatttaaaaactgtgaattcagtaacagaaaagattggtgaatttgactgtatgaaatcgtgaagtatggtaaaattatacccatactaaannnnnnnnnnnnnnnnnnnnataaatagtacagtggtggatgaaataattagatatacattataagcaagggcattattcttcaatatgcaaagaaaatcaaaattattaagataaaggtagattgattttattagaaatacagtttgaagaggccactaacaaaagaagaaatacaaatggctaataaatgtataaacagatgctcaacaaggcccatatttaaatacaaatcaaaataacaataagatattacccaaaagtttgataatattaggttttggcaaggagatacgagatactttaggtgggaatataaactgtagcagccattctgtagggccactggaaaaaattttttaaatgctaaatgtatgtattcacaaattccatttctagaaatttactaacatatatttgcaaaagcacactgaggcatatatacaggatgattactgcagcattttaaaaacttcagttatgcagaattggattactcataattcttggttaatgatacattttaccattgatccatgcattgccctcttttattcattttgtagtataaggaatgtacataaatgctgcccctcctcattccccaccataaaggtaatattatcaacaactttgtatttatgatttcttgcttcttaaaactttttatcttaaatatattttgactaaacaatatgtttacttttgcttgtttattaacttcgtaaaaaaagtatatggtatattcttagaaatgtttttcactcaaaattctgttatgaaaggtgattcttgttgctctgattggctgttgctcattcatttttactgctgtataatattctactgtgtgaatgtactaaaattttattttttccccctttactgagtattttggttgtttccagtgttttatcagtaagagcagtgctgctttggacatcctcgtagatgtctcctggtgcacaagtacacaattttctctgaaagtagaatttctgagggttataggctatacagatatttaactttataaagaaatattaaatcatttttccaaagaggtcttaccagtttatgttcatacaaagagtggataagagattcagtgccaaactgaatctctttccaacacttagtgttgtcgcatgtcttaatttttgccaaagaagtgtagaatggcaccttattgtgcttttgttttgaatttccctggattctagtaatgttgagcatctgttcatatgtttattagtcacacgtgtttcctcttcagtgaaacacgtatttttgtttttggcctatttggttatcggcttattgatctgtagttctttatattctcagtataatctttgtactgatattaatgtttagctgacaaatactttatcccatcttctaacttgtttttttcacattctaaggcattttttaatgaataccttttgtgaagtcaaatgtatcaatcttttcttttatgcttagcgttttttgtgctttcttaaggaacttcctccttaccctgaagacaaagagatagtcacatgtattttcttctgaaagcttaaaaattttgtttttgatatttcagtttttaatcactgtggtacatatgtttatatataagataagaatacatttttgttttcttttgcatatggattatcaattttttccaggttcgtttgttgaatgatcctttcgtttctacatagaaatgccctatcacctctgtcatgtatttatgagtctatttctagtatttagtattttctgtgtgtcaatactacatatttggtaaggcatctgtatttttgagtgaccagggcccacaaatttatttctcatactatctttatctgatttttttttgaattaatataagcctcaaagaattgagttgagcagtatgcacgtgtttttctgtcctccaaaagcatctatttgtcttggtttaattgttccttgaaagtctgttagaactattaaattatgtgaggctagaattttctttttgggaaattaattattactttaatttgttagaaatgaatagtatttttcaagctttttttctgttttttcttgagtcacttttactaattttatttttctaggagtgtgtccactttgagttttacattggtaaaactcttggtagctgtctttttattttctttgtaaactctgctgtatctgttgtaatgttactttcttccttaatatcgttagtttatgctcaagtgttccctccttgattaatctcactagaagtttacctatttcattagtcttcaaaaactagcttttggcttcattcttttctattgtttcttcgtttctattttaatagtttccattcatgtctctgtaaaaaattttttcttttgcgttttattctgttttctttagctgccttcataagttggacatttaattgcttattttttgagccttagacaattaactcaaagctcttcttttgttgcattctacaaattttgaactgtagtgtttttcttattcagtttcaaatatttatcacgtaccgcttttgcttctttgacccatacgtgtttttttaaaaagctttatcataaaatacaatatatagtcagagaactacacaaaacaaatatatgaaacaaatatccttgtagacaccacgtaagtcaataaactttgccagtcaccaaagaagcacctctgtgcccaaatcacaactgcttttttcctcttctgaaggaaccactatcttgacttatagctatcactatgtttcatttctttgtagatttatcacctatatgtgcatccttagacattacagctagtcttgcccatctaaaaaaaattgtaaatctttgaagtctcagttaatctgcaggtcccctctccatatctttctcttccatacatttgtctgttgaagaacttgggttatttggcctgtagaagttcccacagtctggatgcttattgtgtcctcacagtgcaatttcaagtttcttccatcctttatatttcttggaagattcacagttggatccagagactttataagattgattctacccctttggtaggactttctgtggtgctgtatttgttcatcaggagtcatacaatgtttggttttatcttttttcagatgctagtgtcgatgcttattgtctacatcattaatttattggggctgcaaagtggtgatactcttaattctttttcttcccacttagtggaatacttttataaacaggcacttcagttctatttgagtgcctagtgttatattttatataggaaaggtgggggaaatgcttgattctatccttttatttgccagttttagaaataatgagatatataaaggtatgatgagaaacaaaatatttacatagtttcaaatagtctttccactagataaatgttaattacaaaaggaaaaatgctaactataatagggcagtctggcagacaccacttaagcaaatgatcaaagttggcatcactggtaacaatacagatagacatcatatgcctgctcatgcgatgtagagcacaatatcatatctgtggcattcctgacaaaaatttataacccgaatctaatcatgaggaagtatcagatatacacacaaggacattctacaaagtaattggcctatttgcttttaaaaatattgaagttatgacagataaaggctgaggaagtgttccagattaatgggtactgaagagaagccatgacagccaaatgcagtatatgatcctgaattggatcctgggtcagatttttttttcttttgcattaggaccattaatgggacagttggcagattttgaataatatctgtagattagataatagtaatatattactgttaatttccttattttgataattatactgcatttgtaaaagaatattcttgtttgggggaaatatttgagaatttaagggtaaacgggcatcatgtctacaacctactctcaaacatttcagagaaaatgagagatatatatataatatattaaatatgtagagaaaacgataatgcaaatgcagtataatttagctttggcaaatttgggtgaagaatatgcaaaaattatttgtcatacttttgcaactttactgtaaatcagaaattatttaaaaataaaaactagttggtttctcatcctctgaaggtgaccacatagatttttttaaaaagttataaatttatgaatttaaacatatttgataattttcagtccattgaaattacctttattgaaaatcacattgtcttgtctttggctcctgagtccatttacatgatcttagtagggtttgtttgtttttagttttttgttgttatttttgtttgtttgtttgttgaggcagggttttactgtgttatccatgctggccttgaactcctcagctcaagcaatattcctgccattgcctcctcagtagctggaaccacaggcacctgccactgcacctggcttcttgtagctttttctggtttacttcctatctaagataggatataccaggctcatctcatatagtccctatcccagacctggaattagccatttctttagaagtattggtttctttctgtgggaaagggtatttcaagattatagtctggttgctagagatattcatgattattggactggttattatttctaggcattttcagtacactgaatttatatcatatgagaaactcataatttcatacttatattgctcattccaatttaggactacaggtatcacttaatgtcatcaatcttatgtctctatcttcttccatccacactgatagtcctagttctggcacaggagattgtagaattagaatatcctgtaagtactcatttgctttattctacattacacacataacagcctcagaatgacactaacacagttgtcatcaacatgagtactaaaaacaggcaataatttttcttcttcctatttctctcagcccccattttttgagatctttcttcttttttgatgttggtgtttaatgctatattataatattataaatccctctcagaactgcttttgctgcatccttaaagttttggtatgttgtgtgtccattttcatttattgcaagatttttgatagtttcctcttaatttcttctttgacccattggttgtacagaagcatgttgtttaattttagaaattcttctttttactggtttctagtttcataccattgtgattagaaaacgtatttgatgtgatttccaactgcttaaattagtcaagacttacttggtggcctaacatatgatctatcctggagaatgttctgtgtgtgcttgagaagaaggtgtatcctgctgctgttgggtggaatattcaaaatatgtctgttaggtcctcttgatctcaagtgtagttcaagtacaatatttccttattgattttctatctagataatgtgccattgctgaaagtgggatatctactatctctatctactatttctgtattgcagtcttctaccagctgccatttttatattgcagtctatggctcccttcagatctattaatatttgcttttatatatttaggtgctctgatgttgagtgcctatatatttacaattgttatattctattgatgaattgatcccctttgtcattatataatcactttgtctctttttacagtttttgacttaaagtctattttatttgatataagtatatagctactctgtctctctttttgatttccatttgcatggagtatctttttccatctctttcagtctatgtgtattcttgcagataaagtgggtctcttgcagatagcatatagttgggtctttaaaaaaaaatacattcagctactttatgtcttctgattggagaatttaacacatttacattaaagataagtattgctaggtaagggcttattactgcccctttgttaattattgtctagttatttcatagatccttcattcttctttttcacgcacttgatatcttcctttgtgattatatgatttttctgtagtggtatgccttcattccttacattttatcttttgtgtatatactataagcttttgctttgtagctaccacaaggcttacataaaacatcttacagttatagcacgctattttaagctgttaacgactttaatcatatacaggccaggcatagtggctcacgcctgtaatcccagcactttgggagactaagcagggaggatcgcttgaggccaggagtttgacaccaggcatgccaacataacaagaccttttctctacaaaaaggaaaaaaaaagtcacatacaaaaactctacattgtttctttcctccccttgacattttaggtttttgatgtcataatttacatttttaaacattgtgtatcacttaaaaattattgtagctatatttatttttaatagttttattttattttattttatttttttggagatggagtctcgctctgttgcctaggctggagtgcagtggtgcgatctcagctcactgcaatctctgcctcctgggttcaagcaattctcctgcctcagcctcccgagtagctgggactacaggctcacgccaccacgcctggctaattttttgtattttagtagagatggggtttcaccattgttaccaaggctggtctcgaactcctgaactcaggtaatctgcccacctcagcctcccaaagtgctaggattacaggcgtgagccaccatgccctgcttcttaatagttttatattttaatcttcatactaaacatatgtgacttatatatgccataattatagtgttagagtattccgaattttactatgtatttttaccggtgagttatactttcatgtttttatcttattaacatatattttcttttatctttaagaattatccttaattattttttgtaaggtaggtctgatggtgatgaactcctgaagctttttttcatttgtctggaaaagtctgtctctccttcatttctgaaggacagctttgcctgggtaaagtattcttagtagggagggtttttttaaaaaaaattatatatttaaaaaaacatttgagatggagtctagttctgttgcccaggctggagtgcagttgtgcaatcttggctcaatgtaacctccgcctcctgggttcaagtgattctcctgccgcagcctcttgagtagctgggattacaggtgcacaccaccactcctggctaatttttcagtatttttagtagagacagggtttcaccatgatggctaggctggtcatgaactcctgacctcaagtgatccacccacctcggcctcccaaagtgttggaattacaggcatgagccaccacacccagccaaattctatattttgactatgtcatcctattctcttgtagattgtaaggtttctgctaagaaatttgctgataagtgtattgaagtttccttgtatgtgatatgctgctttcacaatcctctctttctttaatttttgacagtctgccaatcctgtgttttggtgtagtcttatttggattgaacccgattggagatttttgagctgcttgtgtgtgaatattcatatctattcccagacttgggaagttttctgttatttagttatataagctttctacccgcccccacttttctttttctctgctccttttgggatccaccctcctataatgggtatatattacttcacttgttggtgcctcataattctgataggctttcttcactctttttcattttttttcctttttgttcctctgagtgatgaattttaaatgccctgtctttgggctcactgattctttattctgcttgatcaagtctgctgctgaagctctctgtagaatttttcagttaagtcattgtgttcttagctacggaatttgtttggctcttttttttttgagacagagtcttgctctgttcgcccaggctggagtgcagtgccactatttcggctcactgcaacctccgcctcccaggttcaagcaattctctggcctcagcctcctgagtagctgggactacaggcgcatgccaccatgcccggctaatttttttgtattttagtagagacggggtttcaccgtgttagccaggatggtctcgatctcctgaccccatgatccctcgccttggcctcccaaagtgctgggattacaggcatgcgctactgcatccatcctgtttggttctttttatgatttctgtctctttgttgaactaattttgtttatgtattgtttttctgatttcatttagttgtcttaatgtagctcagtgagctatgcaatatagatagacaactattttttattctttttttatttttattttgagacagggtctcactttgtcacccagactggagtgcaatggtgcaatcatagctcactacagcctcgacttcctgagctcaaaccatccacctgccccagcctcctaagtagatgggaccacaggagcgtgccaccacacctggctaatttttaaatttttttgtagagacagggtctcatcatattgcccaggctggtctccaactcctgggctccaagcagtcctcctgcctcagcctcccaaagtgttgggattacatgcatgagttactgcacctggcctatttctaattatttgtcaggcagtttgtaaatctccatgtttagggctggttactggtgctttattttgttcctttgatggtgttatgttttcctgatttttgtgattcttgtggctgtgcattggtgtctatgcatttgaagaagtagggacttactttgatcttggcagagtggctttagcagggagagcttatcaccagtcagcccatccggagattctgggaaggctatctggcttccagcccacatttcttaatgggttgtgttaaatctacattgttaaagcttttagctactatatattatactctctctttaacgcttatttaacttattatttatttattttatttatttaacttacttaacataaattatttattatcctaatagccagannnnnnnnnnnnnnnnnnnnnnnnnnnnnnnnnnnnnnnnnnnnnnnnnnnnnnnnnnnnnnnnnnnnnnnnnnnnnnnnnnnncctgggcaacacaaggaaaccccgtctctactgaaatgcaaaaaatttgctggcatggtgttgtgcctctgtagtcccagctacttgggaggctgaggcaggagaactgcttgaacccgggaggtgcaggttgcagtgagccaagattgtgccactgcactcagcctgggtgtcagagtgagactccgtctccaagaaaaaaaaaaaaagataagacaatattataaacaactttatgccaataaatttaagaagttagatgaaataaattccttgaaagtcacaacctaccaaaactcgcaaagaaatagataatctaaagaattctttttttttttaattttaaactccatcaagtcctggtaaactaaagatttctatacatattaaagaaattgaattggtggttacataacctttccttccaaaaacatgcaaaaccagatggtttcaatggtgaattctgtcaaacattaaaaaacaaaacaaacatcagattctacataaactcttccagaaatttgcttgtttgtttagagaatagggtctcactctgtcacccaggctggaatgtagtggtgtgatcatggcttactgcaacctcaacctcctgggctcaagcaatcctcctgactcagccttccaagcatctgggactacagatacatgccaccatgctcagataattgttttattttttttgtagtggcagggtcttattatgttgcccaggctggtctcaaactcctggcctcaagccatcctcctgccttacctcctgaactactggggttatagacatgaaccactgcatccagcctcatttaacttattcagtactcattatcagtccatattcaatttccatgttgtcattttgttttgtgattgtgatgcttgttctccagaagatatctcaggtgttaatgggaacaatattctctgagtttttatacattgataatagtttgtgccttttatacttgaaggtcaattttgctggatattaactagtggttcatattttcttttcttgattatcttaattatgctattccattttcttctggcataaagctttgctgtttaaaactctgatgatgatctaatctttattcctttatgtctctatatgcttttttatattgtttatatatccttgatatcctctttaatttttttttgctttttacttattgtgaaatatttaattgataaataaagattgaatatattcaaggtatacatgacaacatgatgatttaatatatgtatatattctataatgattaccacaatcaaaatgacacatctgtcaccactcatgctgtacattagatcctcagaactaatcttataactgaaagtttgtaccgtttgaccaacatctccccatttcccctgctttcccagcccctagcaaccactgttctactctcctcttctatgagttcaacttttttacatgccacgtataagtgagatcatagagtgtttgtcttttctatgtctgacttatttcatagtgtcctacaggttcatccatgttgtcacaaatggcaggcaggctctattatggctagagaatattctatggtatagttaaaatgtggaatctaaaaccatggtaatgaactttttgtattccgttacattgaactctacttttcttggtactttcaatggatctttttcccatttaaagttgattttgaaacatgtatcagtcatttggataatatggttcactaagttatgcaaatattccccttgttaatacattttataatattaaaatatcacattcattaatatcaccattgatctcatcagaaaagtctttaagaattgagaagctaacaactcggaagccaatacaagttttccaaaattctaactttttcttagaacttgaattttattattggtataattttccttgaagtgacatactcaattcattaatttttaaaaaatgtctgccaagtacccttgtctgaattaccataatttatgtcagttgttcttacatgtgaaaatgtgtttcatgaaaaaagtggctagtttagcttgcactgcaaacaattgcttttccttaagacaaacattttaagttcttcttgagacttttaaatttgtcacacagaaattaaaaagatgtgtgctcaaaagtcaagattcattagaattactattttgtttctgcttaaagtgaaatcagcttttttgtcctccctcccttccctgtctttcattctttcctttcttttcttttctttttctttctcctttcctttccttttttttctttcttttttttcctttctttcttttctcttatctttcttttcctttctctctttctctgtttctctctttctctttctctctctcttactttctttctttcttttgccatggcagtgaagactctaaatatgatatggtgtcactttcttgattagtgctaaggtagttttacctgccatttcttttgtattatcaatgcaaatgtcagtttaaaaaaaaaaaaagatgtgctttttccaaagttggaaaagcaagtaacatcttagtattaactgtgaacagggtccctaagagggtctacaggactggaacacactttggagactgctgccctaaggcattgtcttttttgtttactcactttggtgttcttctgtggtttttatttcagaaaatttttctttcatttataattctattcttgagttctgttatgtcatcttaaatttttctaattctgatttacactgttctttcatgtcgcttatcattttcttaaatttaacttattttgaaatagtaggttacagttttaatctgttttgtggacatatctttctggtatgttttaatcatagggatattattctgctctttttttttcttttaaaactttgcatgggatttgtgaaattagtttttcttaatggagatgtaagtgaggaaagcctttggaatttcataaagtttcctcttagtcatcgccattgttgtttaagtgtttaagaaagcagcaggttgctctcatttcctgactttcttctcatccccagcctttgacctttacatggactttactacttctttgttctctgttttgcttactttttttttttttttgagacagggtcttactctattgcccaggctggagtgtagtgacgtgatctcagctcactgcaacctctgcttcctgggttcaagtgattctcttgcctcagcctcctgagtagctggaataaaggtgtgccccactatgcctgggtaatttttgtgtttttagtagagatggggtttcaccttgttggccaggctggtctcaaactcttggacctcaagtgatccacccacctcagcctcccaaagtgccgagattacaggcatgagccaccacgccgagccaccacgcctagcctcctgcgtaatgtttttattccacccttagcagtttcctaagtgtgggatcccatcctaaaaggtagctttggcagttgtttttgagttcctatggctcagaatgcttcagccccttttagaaattagtgtggacccctccactcatgtgctatttgattagtcaaaatttcctcccagtatcatcagctgctgttctcacattagctacctgtgctctctagggtatattagctgttttgggattctcctgaggtcaaaggccccttggctccctcctgcatagacactgataatagtgggtcctgtggcacttggcggtttggccctcatccacctgtattttgaggtttgtggggatactttatcacttaggcttttttcagcagtcaaatgcattacttattgaagtataatttacagacaataaaatatgccttttaaggtaatcaattctatgagttgggcaaacattttcaaacatgtaactatcaccacagtcagtgtatagaattttctctgtttttcttttttcttcttcttttttttgagacaagatctcactctgttgtccaggctgaagtacagtggcatgatcacaactcacttcaaccttgaattcctgggttcaagcgatcctcccaccccagactcccaagtagatatgactacaggtgcatgctatcacgcctggctaatttttaaaatttgtacagcaggtctcactatgttgcccaggccagtcttgaactcctagccttaagcaattttcctggttcagcttcccaaagctatgggattataggcttgagccaccatgctcagcctaatatatgaatttttcatcaccccccaaagttccccagtgcccctgtgtaccagttccccttccccgcctctcgcaccgtgttggtgattattcttttcacagagaatacacttacacctcaacctcaagagagaaaacccaaatcccattcattcactgcatccaattcatagttcagggtctgtgggtgatatgcattcctctccatcagatctggatgtggtacttaatggttttgttactctccctcaactactgtctctcaccccatattcaggagcagggacaggataacaacaataaacaataaaacttgtaaaaaggaagaatggaagacacacatcattgttttgtagcaatgatgagattctgctaaacagatattatgaagcccgccttatcctagcagtaggggtatgtttctgttctattccattccattccctattttgtttactggagggggctcccttaccattggtcttggtgacttttaactccagcctcagaaaggtcttacttgctcattattttccatgactacatctgaagtggatgttagggaatatgcccttactggggactgtacatgttgaaaatccctaatccaaaaatcagaaatctgaaatgctccaaaatctgaaacttttttgagcacagacatgaaactcaaaggaaatcattggagcattttagatttcagatttttggattagggatactcagcccatacttatttcacagccatttcttacctgtgtagttttgggaaccttaggattagttgataatcacagcatgttttgggccaggtttctgggttttttttgtttttttgacagaatttaagaacttagtagtcttctaattaccacgctctaaattcattcttagactgtagccccagacgtcttttgttttgttttgttttgtttcctgttccccatggctgtttctcactggtatctatcttgagacatctgaaacataggtgtgggatgaaggagagcaactttaatctgatctttgctacaggtcttggttgttctgtttaacagagatttgcagctcaaagtgcttttcaatcttatttttactatgtggcatttagaaatagttgacttttctaacaatctgaggctctaagtttctcttttctcttcccttttatttctgcttgcaaaccaactagttatttgttgagtactctttcttttaatgccttgataaatataggaaggagaaaccattatttgctaaccttttggcacttcgtaatctcttctctagatctgcattctttgtctgctgtccagataatcataagcaattatattacataacatgtctttatcttgccagcttcagatgcatgtttcctgtgctgttacccactagatggacacactagacagatgtcacatattttagatttttgttcgaagtagcacctcacatcaagatatctgtttctaaattagtgtagttagagtaggctaatgtggcatatacatctaattttttaaacataactgatatttacttattgctcaactaatagaattcggtgtgtgaaaggtcagcagggcaatcctccctgctctgtagttattgaggaccttgttgaaagaaacccttctgtcttcaaccatggcttccatttatccagcttacttttcatggctagatctcagttacatggctgtacgtacctgcaagggggtttgggaaatgtagtataggtgtgtttcctgaaggagaagggaatgtggatttggtgagcagctagcagtttctaacacgaacttcattatttgtaaagcacgaatcccaggcaagatgggagttttctagattttcctttaggtgttttaagacgtcacagtcctgggatatatcaagacagaattataattttgatcatcccttttgtatcttgttcaaattttacaaactaggtactgcagtggttcagcacaaacttcaagtatgggagcccccttgtgggagtgcccatggcaagtttatctaacctaaggatgatttttttttttagtgaggacttattgaaaataattttttatatatctctttattattttaactattattggaaccatttgaatgtattgcctattaaataaattaaaaaataaagtaattcatcaagtggatgtatgatgtaatatacatgaagtatctatgaatttttaactttaagaaataattatggaaattattcctgaagacattccttcatttaacagctacttcctgaacaccactgtgcttagaatgttgaattattgaattcttacatatttacttcgatgagcaatatcacaatcatgaaaactgtatcattgcctggggaaatagaatgtgtttgttggaacttaagtggttctcttaaatgtaagaaataatacctttagcatctatacagttgattatgtattttaatgtatgagttatttccaaaagaaggtatcatattaaccatgaataacttttatttttttaaaaaattgaaatatcaaagcatttctttattcatttgatatttggtgcttattttggttcacacacttttctaggggcacaagaaggaaattaatgtcatttaggaaaatgtcactttatttttgtttcatttacctaaattcagacatccaaaaaatatgtaagatatctaaagacaaaatctcacagaagatgtgcaagtcctatatggagatagtgattcagtgttattaacagacattagaggaaatattaataagtttcaagaaatatattcatgtatagataggcccagtattacagatatacccattctccctagatctatggattcaatgcagttctaattcaaatgccatctggaattttgggggggacatttaaaaaactgactctgaatgtatatgatcaagtgatagccaagatattttgaagaaaaatagatatagggactgctctataagccatcataatttattatgaagttataacaagtaaaacagtaaggtatttggcatggaatagagaaccagaaacagaccaatgcatgggtacaggatataacacagggaaatgagggacaatatatggttctgggataattatttatatggggaaaataaagaaattggatccctacctcacacatacaaaaaaaatcataattgaattaaaaacttgcatgtgaaaggaaagactttaaaacatttagaaaaagtattggaggctatgatcttggggtaggaaagcatttctttttttttttttttagacggagtcttgctatgtcgccctggctggagtggagtggcgcaatctcagctcactgcaacctctgcctccaggttcaggcgattctcctgcctcagcgtcctgagtagctgggactacaggcgtgcacgaccatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctcggcctcccaaaatgctgggtattacaggcgtgagccaccacacctagccggaaagtatttctaaaacatgacacaaaaattgtttaccatggaagaaaagattgttatatattactacattaaaattaaaaactttattcatcaaaaaacaccctgaaaattgaaaggaaagccacaaactaaaagatacttgtagtacataaaaccaacatattcttagtatccagaatttatggaatttataaagaactcttacaaatcaataagaaaacgacaaacaatctaactaaaaaatggggctgggtgtggtggctcacacctgtaaccttagcactttgggaggccgaggcagatggattgcttgaggtcaggagttcaagaccagcctgcccaacatggaaaaatcccatctctactaaaaatacaaaaattagccaggcatggtggcacatacctgtaatctcagctacttgggaagctgaggcagcagaatcacttgaacccaggagatggaggttgcagtgagctgagattgcaccattgcactccagcctgggtgacagagcctgactccatctcaaaaaaaaaaagaaaaagaaaaaagaaaaaaaagaaaaagaaaaatgtgcaaaaagcattaactagtattttaaaggagaggaagcataaatggtggaaaaaaatatgaaaagatacttcacatcattagtaatcacagaatttcaaaataaagattacaagtgaccatctactctcgtgagattggcaaaaattaagaaatgtgacattatccacagttggagaggatgaagattcttttatacagttaatgtgtcacttaacaatggagatacgtcctcagaaatgccaggatatgttctgagaaatttgttgttaggcaattttgtcattgtgtgaacatcgtagagttgacttacacaaagctagatggtatagcctattgcatatctaggctgtatggtatagcgtgttgctcctaggctacacacctgtatgacatgttactgtactgaatactgtaggcacttgtagcagaattgtatttgtgtatctaaatgtagaaaaggtacggtaaaattatggtatcataatctcatgaaacaaccattgtatatgtagtccattatttactgaaatgtcattatccagtgcatgactgtacattgctggtgggaaggtggtcagtaccaccacttcagaaaacagtttgtcactgccctgtaaaatcaaacattggcatattctgtgacctgaattgccacttttgagtatacccttaggaacctgcaaatgtacacgtggtgactaggtgattttttttttttttttttttttttttttgagactgagcctcactctgtcacctaggctggagtgcagtggcgccatcttggctcactgcaagctctgcctcccgggttcacagcattctcctgcctcagcctcccgagtagctgggactaccggtgcctgccaccatgcctggctaattcttttatatttttagtacagacagggttttaccgtgttagccacagtggtcttgatctcctgatctcgtgatctgcccacctcggcctccaaaagtgctgggattacaggcgtgagctacggcgcctggccaactaggtgatgtttataaaaatgtttatagcagtggtattcataataacaaaaatcctagaaataaccaaatgttcattgactggaatgttggaaagcagtgagatatactagaggtttacacagttgcttggataaatcttagtcttctaatgctgagtgaaaaaaaaagttgtggaagacatatacagcatgtaccatttttataaagttcaaaatcaagcaaaactacatgatgtgtcatttaggaatgtgtaccttgtgataaaactataaagaattaaaaacagaagtcatgagcatgtatattagtggagacgtagagaaagggaataagggagagacacaaagtagatgcaattactggtaacattttggttaagtttgaggggtgatcatactgttttattataaggtgtcatatattgtgtgtgtgtcaaaatgtatttaatataatatttgttaaaaatttgaaaggtatgatgaagtctactatgttttattctttccttgatgtcttctgattactgttttttgttcttgtgcctcacagtcttgctgtatctccctttgctgtctttagcaataggtgtccctaatcttttgtttctctgtttctcattcagaatgattcccatttgctgtgttccagcctcttgaattgctaccttactaagttcactattaattcctcaaatgacttttaataaaatctaaagttattttgtcctttatggtaatttgatttgatcttaagaatacattctacctagtttttctttgcaaaagtctttctttcttaggcttaatatagtttcataatgttaactttgcaaatttttcctctccagcttcatggtgcagttttctaactggaaaatttcacatttctcatctatcagttgacttacagttttaaaatgaaccaaatcttcctttttttattattatactttaagttctgggatacatgtacagaacttgcaggtttgttacataggtatacacatgccatggtggtttgctgcacccatcaacctgccatctacattaggtatttctccaaatgatatccctccccttccccccgacgcccaacaggccccattgtgtgatgttcccctccctgtgtccatgtgttctcattgttcagctctcacttacgagtgagaacaggcggtgtttggttttctgttcctgtgttagtttgctaagaataatggtttccagcttcatccatgtccctgtaaaggatattaactcatcctttttatggctgcatagtatcccatggtatatatgtaccacattttctttatccagtctatcactgatgggcgtttgggttggttcccaagtctttgctattgtgaatagtgctgcaataaacatatgtgtgtatgtgtctttatagtagaatgatataatcctttgggtatataccaagtaatggcattgctgggtcaaatgatatttctggttctaggtccttgaggaatcaccacactgtcttccacaatggttgaactaatttacactcctaccaacagtgtaagagcgttcctatttctccacatcctctccagcatctgttgtttcctgactttttaatgatcgccattctaactggcgtgagatagtatctcattgtggttttgatttgcatttctctagtgaccagtgatgatgagctttttttcatatgtttgttggccacataaatgtcttcttttgagaagtgtgtgttcatatcctttgcccactttttgatggattttttttttcttgtaaatttgtttaagttccttgtagattctggatattagccctttgtcagatgggtagattgcaaaaatgttctcccattctgtaggttgcctgttcactctgatgatagcttcttttgctgtgcagaagctttttagtttaattagatcccatttgtcaattttggcttttgttggcattgcttttggtgttttagtcatgaagtctttgcccatgcctatgtcctgaatggtattgcctaggtcttcttctagggtatttatggttttaggtcttacctttaagtctttaatccatcttgagttaattttagtgtaaggtataaggaaggggtccagtttcagttttctgcatatggctagccagttttcccaacaccatttgttaaatagggaatcctttccccattgcttgtttttctcaggtttgtcaaagatcaggtggttgtagatatgtggcattatttctgaggcctctgttcttttccattggtctatatatctgttttggtaccagtaccatgctgttttggttactgtagccttgtagtatagtttgaagtcgggtagtgtgatgcctccagctttgttcttgttgcttaggagtgtcttggccatacgggctcttttttggttccatatgaaattaaaagcagttttttctaattctatgaagaaagtcagtggtggcttcatggggatagcattgaatctataaattactgtgggcagtatggccattttcacgatattgattcttcctatccatgagcatggaatgttttttcatttgtttgtgtcctctctgatttccttgagcagtagtttgtagttctccacaaagaggtccttcacatcccttgtaagttggattcctaggtattttattctcttcgtagcagttgtgaatgggagttcactcatgatttagctctctgtttgtctgttattggtatataggaatgcttgtgatttttgcacattgatttttgtgttgaagttgcctgtcagcttaaggagattttgggctgagatgatagggttttctaaataaacaatcatgtcatctgcaaacagagacaatttgacttcctctcttcctatttgaataccctttatttctttctcttgcctgattgccctggccagaacttccaatactgtgtttaataggagtggtgagaaagggcatccttgtcttgtgctggttttcaaagcgaatgcttccagcttttgcccattcagtatgatattggttgtgtgtttgtcataaatagctcttattattttgaggtacgttccatcattacctagtttacttacagtttttagcatgaaggggtgctgaattttgttgaaggccttttctgcatcttttgagataatcatgtggtttttgtcattgatgaaccaaatctttcttcatctagggattcaattatgtattctttaagattgtactagcattatagataaagtggattaatcattgtttaagcctcttggatttccattaaatcattggtctttcctttgaatatactcttcttgttaaaatgtttttttaaaaaaatttaatcagaagttaatttgatttatagtgtgttttatttttgtaactaatgttcaatatttatcatgaaacctttattcatgaattagtaatagaataaatggaacccagccataaaaatttctattctctaccaaaaaatataatgattgcaaattttaaaaatgtgctagttaatttagctctaacttccccttgaaaatatagagagtcaaaaccaaagtgagattgtgcatacatatcaggctaattctgctattctggtgtcatttttctctctttaaatatttatttattagattccttttaaattcaaaggcatgatagttttagcaaatcaaacaacaaaagtacataaggaaaaatataaatctcccttcagcatcccttagctctcacactctgagataacaaatgtaaatagtgtctatacttcttagttgaattctttgaagctgcccttaaagaaaatacctcatagaggccaggtgcagtggctcacgcctgtaatcccagcactttgggaggccgaggtgggtggatcacaaggtcaggagattgagaccatcctggctaacacggtgaaaccccgtctcaactaaaaatacaaaaaaaaattagccaggcgtggtggcaggcacctgtagtcccagctactggggaggctgaggcaggagaatagcttgaacccaggaggcggagcttgcagtgagccgagatcgctctaccactgcactccagcctgggccacagagcgagactccgtctcaaaaaaaaaaaaaaagaaaagaaaataccgcatagaattcaaggttttttctttttcttttcaatgatactattaaactaatacagtgaaacctccaatttaacttttgcttaaagaacacatcaatatctttgatgttctggtaaaataatggttttttattcagccgtgcaccttggtatatgagcacaggcttaatggtcttttgaaaaaaaattatcttccatatccaaacttcaaagactctagatgttttcacaaaagaattgaggctgtagtttcatctttggaggtattaccctaagttaggtagttctttcaagaacctagggcctggcatcactttttgttatcctattgatctaaagacatagagaatgtgtgtaaatacaaaataaaaatgctgaaagttgtcacattctgaagctttctgctacccttaacactcagtaattctaagcagaacaactgatgttcatgtaacaatttaaaggtccccagaattttctaaagtcctgttaagattctgcctccagcttgagagaaactgctgatagttctgttaattcatgatgtgtaccatatattctgtctaatgtttactaatgattattatcttaaaaaaagtttcttgaatacactgcagcacttttataatcattgcttgatactcaaaacagtcttttgtaaggtaaagctgttataatcatcttgattttatacatgaaaatctggaggctcaaaagttgaatggcataatcaagattccacagctgggaagaacatgaaacttggagtttaaagggtctgcataggtctgaaacttgaaccatagcctattgacttcaaatatcttgttctttcctctatacgttattgcttcttaaaaaaaaaagttttgaaactgtttgtcctataatccacccccaaaaatccctcataggttttatctatctacctataaaagataaggcatataatttttattctgttctggaaagcacaaacttccagttttacagattattcaccactacaggtcatgtgtctaatcaaaagtcaactagctcaagactaagaaaaagaagacccagataaaatcagaatagaaaaagaagatatagaaaccaaaaccactgaaatacaaagactcattagagacaattatgaacaactaaacaccaacaaattagaacacctagaagaaatggataaattttgggacatatacaatctacaaagattgaaccataaaggctttttctctaagatctagatcaaaacaaggatgcctactttcaccatttatattcagcatgatactagaaatcctggccagtgcaataattaggcaaaagaaagaaagggcatccaaattggaaaggaagaagtcaaattagtcttgttcacaaacaacatgatcttatatttagaaaaagctaaagaatctaccaaaaaaaaaaaaaactgttagaactgattaacaaattcactaaagttgcaggatacaaaggcagcatacaaaagtcagtagcatttatatatgccagtggtgagcaagctgaaaaagacactgaaaaaagcaatcccattcataattgctacaaagaataaaaattacctaggaatcaatttaaccaaagaaatcaaagatctgtacaaggaaaatctaaaacattgatgaaagaaattgaagtggacaccaaaaaatggaaagacatcccatgctcatggatcagaagaattaatattgtcaaaatgaatacactgcccaaagcaatttatagattcaatgcaatttctatcaaaatatcaatgatattctttacagaaatagaaaaaaatcctaacatttatatggacccacaaaagactccaaataggcaaaacaatcctgagcaaaaaacaaaactggaggcattacactacctgacttcaaaatgtactacagagctatagtaaccaaatctgtatggtgctggtatagaaacaaacacatagagcggtggaacagaatagagaacctagatatagatccctgtacttacagccaactcatttttgacaacggcaccaagaacataaaatggggaaaggatagtttcttcaataaatggtgctggggaaactggataaccctatccagaaaaatgaaactagacccctgtctctcaccagatgcaaaacccaaaatggattaaagacttaaatttaacacctgtaattgtgaaacttctagaagaaaacattggggaaacactccaggacgttggtttgggcaaatttgtgtgtgtgcatgtgtgtgtgtgtgtgtgtgtgtgtgtgtgtgtaagacctcaaaaatcacaggcaaccaaagcaaaaatagacaattgggattacatcaagctaaaactattctgcacagcaaaggaaaccataaccaaagtgaagagacaacccacagaatgggactaaatgtttgcaaactatccatctgacaagagattagttgccagaatatataaggaactcaaaacaattcagtagcaaaacaaacaaaacaaaacaaacacctaccttcccccgacccagatagtccaattaaaaacaggccagagatctgaatagacatttctcaaaagaagaaatataaatggccaacaggtatatgaaaaaatgtttaacatcattaatcaccagagaaatagacattaaaatctcaatgaggtatcacctcaccccagttaaaagtgcttttatcaaaaagatgatggagtaaaagatgctgacaaagatgtagagaaagaggaacactcatacactgttggtgagaatgtaaattagtacatccactatggagaacagtatggaggttcctaaaaaaattttaaaatagaactaccatgtgatccagtaattccaccactggatatatatccgaaagaaagaaaattaatatatcaaagagatatttacactccaatgtgtattgcagcattattcacaatagccaaaatatggaattaactaagtgtccatcagtggatgaatggataaagaaaatacgttatatatacataatggaatattatttagccataaaaaattgaaatcctgtcgtttgcagcaagatggatggaaccagaggttgttaagtgaaataagccaagtacagaaagacaaatattgcatgttctcactcatatgtgagagctaaaaaagttgatgggcatggtggctcacgcttgtaatcccagcactttgggaggccaaggtgggaggaccgtttgagaccaggagtttgagatcagcctgggccacgtagcaagattccatctctacaaaactttttaaaaaatgagccaggcatggtggctacttgggaggctgaagtgggaggatcagttaagcaagcccaggagttcaaggttgcagtgagctgatagtgacatcacactcaagcctgggtgacagagtgagaccctgttttttgtttgtttgtttaagttgatctggtccagtgtggtggctcacacctataatcccagcactttgggaggccaaggcagaaggaccacttgagcacaggagtttgagaccaggctgggcaacatggcaaaactctgtctctagaaaaaaattttaaattagccagctgtggtcttgtatgcctttagccccagctactgaggaggctgaggtggaaggatctcttgggccgcagaggttgaggctgcagtgagctgtgattgcaccaatcatagtccaaactgggtgatggagcaagacattgtccaaaaaaaaaaaaaatgctgatctaatgaagatagagagtagactgatggttaacagtggctgggaagggtacggagttctggggatgaagagagattgattaatgggtacaaatatacagttagaagaaataatacctgttttttgatagaccagtggagtgactatagttaacaataatctattgtgtatttaaaaataactggaagaaaataattcaaatgttcctagcataaagaaaatataaatatttaaggagatgaatatcccaagtaccctgacttgatctttacacgttatatgaatgtattaaaatacgacatgtggcgggtgcagtggctcacacctgtaatcccagcactctgagaggccaagccaggcagcttacttaacgccaggagtttgagaccagcctggccagcatggcaaaaccctgtctctactaaaaaatacagagattagccaggtgtagtggcgtgtgcctgtaatcccagctacttgggaggctgaggcaggagaatcatttgaacctgggaggcggaggttgcagtgagtcaagatcatgccactacactccagcctgggcaacagaacgagactctgtcacacacacacaaacacacacacacacaaacacacacacacacacaaatatatctatatcatataaagtatatattataaaatattctatgttgtatatatataatatatatatcttacatgtacctgaaaatatgtacatctgttatgtatcaataaaaggtttttaaatactttaaatgaactagctaatgcacccggtttcatttgctataataatggaagtacagggtagttgatattctaacctatagaccagactatgtaccatactattaattgtcataaaagaaaaaaacacctgaatttaggattctgtaactttggaatgggactagcatgaaagcataaatagaaaaaatggttacaatcaagtaaaacagagaagtaaatatgttgttaaagaaagtcatcttaggatacctgtaacattccagttacaggtatcctaagattaggcaaagcagataccaggctgtctgtaatggctagtggccctcacagagaaaggagatgaggtctttgagcctgaggaattggatatgtgaccactacaccatgcagggaccctggaaaggctccctccccctgttcttcttaaacagagaaatccctgtttcttctcagggctctgggtgaagcgggggaagtttgtcttgagaaatctagtggtatttatagatgattcagaaattccaagctaagaaattaaattaaaactgatgctagaaggatgaaacctttgggagaacttggcagaatcaaatgtaaaacaactttatagggacatttcacaaactaagattcctgagctttccacacctcactaatcggatgaaaatgagatcatgatagttcttataagttacttatggaaatgatccttgttaagggagagtaagtggattaaataactattagatcaagttgaaagggaattagaaagctgaaaaacacagatgaggaatttatacaaaatgtagcatagagagatgaagatacagagatatagaaaaggttaagagacccagatgatgggattagatgatttctaaaggaaattatagacaaagaatagagagagaatgtgggaaggataatatttgaaacaatagtggctgcaattttttagaatggattaaatatataaatcaccaaattgaaaaagcatatcaggttctggaaaggattaataaaaataaatacctaaattaaaaaaacctagatacaatataataaaatagaagaactctaaagacaaagtcctaaattaatctgcaaggtgaataagattacccaaaagggtcggcaattaaactgacaacaaatctctcatcagccaaagtagaagtggaatagaaaaatattttccatgtgccaatggaaatgtaaacctagaattctttactttgctaaattattctaaaatgaagatgaaataaaaaccttttccataatggtacagccactgcagaaaacagtttgggagttccttgaaaagttaaacatataattactatgtggcctagaaattccacttttaggtatataccccaaaaaactgaaaactccaacagtacttgtacacaaatatgcatagcagtatttttcacaatagccagaatgtgggaataatccaaatgtccatcaacggataaatgtatgaactaattgtggtatagtcatgcgtcacttgacagtggagctgtattttgagaaatgtgtcaggtgattttgcagttgtgtgaacactacagagtgcacttattcagagctaaatagtatggccttactgtgcatgtaggctatatggtagcctattgctcctatgctacaaatctgtaaaagcatgttactgtactgaatactataagtgattgtaacacggtggtatttgtgtatagaaaagatacagggaaaatgcagtattataatctaggatcaccatcatatatgtggttgatcgttgagcaaaacatcgttatgcaatgcatgattgtatataagtacagtgggatattattcagccataaaaaggaaaggactacggatacatgttacaatgtggattaacctcaaaaacattatatgaagaaatgaagccaaacccaaaaggtcacatattgcctaattacatttacatgaactaggcagagtagataaatccatggagacagaaagcatattgctgattgtcaggggctgaggggagtgggggatagggagtgactgcttaatgggtatagtgttttcttttggggcaatgaaaatattttgaaatgtggttacacaacattctgaatggattaaattgcacactttttaaaaaaacaaaatgtaaccatttgggtaaaaataagtattgattgtttaaaagagaaaatattgataataactatgtcgaggatttgatgaaacaagatggagccaaaatagtcaacaatcttagttggatgatgggaagagggtgattaaaatgaattaaggttgttggatataggtattgattaactttagactttagaaatattaacataaaatagaacttaagataatagacattattacaaagacttctgcttctacttcagaagaacatgaaagacttttgctcccatgataatcataaaagttaccaagttttaaaatcatacttgttatagggcaagtaaagagcagcagacaagaggaggtctgaaaagtctgaatttcacagaaaaataaggccttcataaatgagtagagagccacagcagcttcatacctaggggtgggtgcctggtcatggtacaagtgggtctgacttagacactaaatcacccatgccctagaggcccaaatgcaaagaggaatcatttagcctagaaattcttccccttccccaccccaccaacccatagagatttctctagagagaaatcgtctagttcttcacattctcgcagagattgattcagtgtacttgccacatttgaaccaaaaagcaaacaaaaagtatcgaaactgcagctaaacccttctatatcacttactaacaagattttttttttaatatagtggctcaagggtttgggtattgagccaaacacagctgatctaagtgtacttttagctgtgacccagctccagctcaactctagaaggattacaaatgagcagacactaaccttaacttccggacagagggaagggcttgtactctgggaaataacaagccaaaataaaattatactacattcttaactattctgtctggaatgtgttctaaaattatgagctacacaaattagcagaaaaatgtgacctattaacaagagaaaatagtcaatgtagtctgatgttttggtgacccagttttggaatttagtagatgagggccttaaaacatctgtgacaaatatgttaaataatttacaggaaagatggatgtaaggattgaagagatgagatatttcaagggattcatggaagttctaaaagaatcaaatagaatttctataactgaaaaatctcaaattttaaaaatcattgaataggcatttcagcaattattcactacacaagaaaggattagtgaacttgaagacaggttaacagaaattattcaaactgatgcacaaagagaaaaaagatagaaaaaattaacacatcatcagcaacgtgtaaggaaatattaagaggtctaacatacatataattggaggtgcaaaaaagagaagagaaagaatagggcatacaagtgtttgaacaaataatgtcccccaaattccaaatctgatgacagacaacccacagattcaagaagctcagtgagtaaatatgaaacacctatgcacactattaaattactagaaaccaacgataaagagaaagcttaagacgacagaagaaggaaggctaaaaaaattggggggaggctgggtgcagtggctcacatctgtaatcccagcactttgggaagctgaggcaggtggaatgtttgagctcagaaatttaagatcagcctgagcagcatagtgaaaccccatctgtaccaaaaatacccctccccccaccaaaaaaaatatgtatgtcgggcatggtggtgcatacctgtggtctcagctacctgggaggctgaggcgggagaatcacttgagcctgggaagcagagattgcagtgagctgagatcacgccactgcactccagcctgggcaacagagtgagaccttgtctcaaataataataataataataagaagaagaatactcactgacctttaagaaataattgaaagccaaattatatatatattcaaaattctcttctaaaaataaaagctttttaggtgaaaaaaaaaactgagaggattcatcactaacatttccacaactaagaaatactaaaggaaattctttaggtgaagagaaatgaaacccagatatgtaggaaggaatgaagaacaccataaatgctaagtatgtgataaatatgaaatcccttttacctctttttaaaagtcctttaaaagataattaactgtttaaagcaaagatcataatgatgtattgttgtcaagtaaaatatttgacagtagcacacaagataggaaaaaccgtgagccaagattgcactactgcactccagcctgggtgacagaacgagaccctgtctcaaaaaataaaaatttagaaagacaggaaaggattagaggaaaatacactgttattctggtgatagaagcataatattatttcaaggtagactgcaaaagggacgtatttcatgtagaacaaccataaaatatgcataaatatttaattatttcaaaagaggtctgaaaaggggaacaaaggaacaaaaagtagatgggacaaatgggaaacaaatagcaagatgttagatttgaaccatattcatgattaaatgtaaatgagtctaacactcctattaaaagcctggatgacagagtgagaccctgtctcagaagaagcgggcaggggagataattttgtgctattcacactagcataaaattacctaagactaaatataactttgttagatttgcaagtttaagacctaaaaaatgttgctggagagaaatttcaataacctaaataaatcaggaggtacgtcatgtttatggattgggagcctgagttacagattcgaaacaattttaatcataaccctagcagagttttttgtttggaagttggtaaactgtttctaaatgttatatggaaatagaaatgtcctagaatagccaacacaatcacaaagaacaagagcaaagttgaggacttacatggccatatgtaaaggcatattataaaactgcagtaatcaacacagagtagtatattagtgtgaggaaaaatacataatttattggcacaaaagattccagaaacagacccccatataaggatcacctgatttaccaaagtacccttacatttctatggggaaaggatgacctttcagtaaaatgtgctgggtcaattgaaaaaaaacatggaaaagaaaaacaaaccttgatacctacctcagaacatatgcaaagagtaatctgaaatagttcatagatataaatgtgaaaggtaaaacagattctagaagaaaatacacaagaatatctttataatctcagggtaagcaaatatttcgtcaacatgacatactgtatcttcataaccatttaaaataattgataaattggacttcactgaagtaggaaattgtttattaaaaaacaactgagcgcagtgactcatgcttataatcctggcactttgggagaccgaggtgggtggatcacgaggccaagagatcgagaccatcctggccaatatggtgaaactccatctctactaaaaatgtaaaaattagctgggtgtggtggcgtgcacttgtagtcccagctactcaggagggtgaggcaggggaatcgcttgaacccaggaggtagaggttgcagtgagccgagatcccaccactgcactgcagcttggtgacagagctagactctgtctcaaaacaaacaaacaaccttggcctggcgcagtggctcacgtctgtaatcctagcactttgggaggccgaggtgggcggattgcctgagctcaggagttcgagaccagcctgggcaaaacgatgaaaccccatctctattaaaatacaaaaaatcagctggacgtggcggcgtgtgcctgtagtcccagctactcgggaggctgaggcaggaggatcgcttgaacccgggaggtggaggttgcagtgagccgagattgcgccactgcactccagcctgggcgacagagcaagactccgtctcaaaaacaaacaaacaaacaaaaaaaccttaagataatgtgaaaggacagagaagacatcctatccaacaaagtgctcatatccaaaagataaaaagaactacaaatctatcagaaaaagaaacccaatttaaaaaaatgagtgcttcacaaaaacccccaaaatggccaataattatatgaataggtgctcacaatcatcacttgtagcagggaaatacattttaaataatacaatatcattatatccttattagaaggatggtgttaagaagaccaacaataccaagtatccataaaggtgtgaaataattgaaactcttgtaaattattcatggaaggataaattggcacaactgttatagtttagaaaacttttagcaataactactaaatgggaagttctagccatagcaatcaggcaaaagaaagaaagaaaagggatccaggtaggaagaaaggaagtcaaactatcagtcttctcagataatttgattctatacctagaaaaccccatagtgtctgcccaaaggctcttagatctgataaacaacttcagcgaagtttcaggataccaacttaatgtacaaaagtcagtagcatttctgtagaccaataacgtccaagctgagagccaaatcaagaacgcaatactgttcacaatagccagaaaaagaataaaatgcctagcaaaacagctaactagggaagtgaaagatctctacaatgagaattacaaaacactgctgaaagaaatgagagatgacacaaacaaaaaaacatttcatgctcatggatgggaagaatcaatattgttaaaatggccatactatccaaagctatttacagattcaatgttattcctatcaaaatgctaatgccttttttttcacagaattagaaaaaaatattctaaagttaatgtggggccaggcatggtggctcacacctgtaatcctagccctttgggaggccaaggcaggtagatcgcttgcgatcaggagttcaagaccagcctggccaacatggtgaaaccctctctctactaaaaatacaaaaattagcttgatgtggtggcaggcacctgtaatctcagctacatgggaggctgaggcaggagaaccacttgaaggtgggaggtgaaggttgcagtgagccaagatcacgccactgcactccagcctgggtgacagagtgagacttcatctcaaaaaataataataaataaaatccatatggaatgaaaaaaaaagtctgagtagccaaaactatcctaagcaaaaagaacaaaactggaggtatcacccacatggacttcaaactatactgcaaggctacaataacgaaaacagcatggtactgatacaaaaacagacacttagaccaatggaataggttagagaacccataaatagagctgcacacctacaaccatgtgatctttgacaaagccaccaataacaagcaatggggaaaggattccctattcaatgaatggtgctgggataactggctagccatatacataagattgaaactagaatccttccttttactatatacaaaaatcagctcaaggtgggttaaagacttaaatgtaaaacctaaaaatataaaatccctgaagaaaacctaggaaataccattctggacataggccctggcaaatgcttcatgacgaaggctccaaaagcaattgcagcaaaaccaaaaattgaccagtgggacctacgtaaactaaagagcttctgcacagcaaaagaaactatcaacagagtaaacagacaccctacagaatgggagaaaatatttgcaaactatgcacctgacaaaggcctaatatccagaacctataaggaatttaaataaattcacaaacaaacaaacaaaaaaacccttttaaaaagtgggcaaaggacatgaacagacacttttcaaaagaagacatacatgtggccaacaagaatatgaaaaaaagcccaacatcattaatcattagagaaatgcaaaccaaaaccacaatgagataccatctcacaccagtcagaacagctattattaaaattcaaaaaacagatgctgatgaggatgcagagagaggggaatccttatacactactggtgggactgtaaactagttcagccactgtagaaggcagtttggagatttctcaaacaacttaaaacagaactaccattcagcatggttgcagctggaggccattatcctaagcaaactaattcaggaacacagaaccaaatactgcatttttttaaataagtgagaactaaacattgagcatatgtggacacagaaaaggaaacaggagacatggaggccttcttggggtggagggtaagaggagggtgaggactgaaaaactacctgttggatactatgctcattacctggatgacaaaataatttgtacaccaaactccagtgacacacaatttacccatgtaacaaacctgcacatgtaccccaccaaacccaaaatgaaagttggaaggaaaaaaaacactgctaaaagtaaatactctccaaccctttagtctaacagtttcttcctaggtatatgttcaggtgaaataaatgtatgtgtctaccaaaagatgtgcacaaggatatttatagcagttttgctcataatagctaaaagttagaaacaacctaaatgtcacttaaccacagcatggaaaaataaattgtagtatattcattaagggaacactacagagcaaaaagtacaaactgctgcatcatgcaacagcatggacaaatttcacagacagttaaaggtgaaaaagtaaaaccaaagactgcatagtgtttgattccatttatgtgaagtgcaatatcagttgaaattaatctatggtaataaaattcagaggtgtttacttctgggaggggatgtattttgtttatctctgggtgcataaaaaggcaaaacagaatcttttggtgttgaatgtgttctatgtcgagagtgagatagtggtattataagtttgtatatgtatttttatacctaggatttgtataccttagtggatgaatgttatactttaataaaaaatcatttttgtgggggcgtattttagatctggctactgaacatgcaataatgaccatccgatatcattgtgctgccttagcatccatattatggtcttgaaatattattttccacaaaaagaaaccagggcttggacaaaggctgattgtaggactgaggcagaaaatgtatgagatggaactagaacaccttattgtaaaagacagccaagtaaactgaaagagttctttgaaaggtactcaggaaccaacatgaagagcctccccctggccaaaatgggttattttgattaaaaaaaaaaaaaaaaaaaaaaagaaggaagtaggctgggcgctgtggctcatgtctgtaatcctaccactttgggaggccgaggcaggcagatcacttgaggttagaagttcgagaccagccaggccaacatggtgaaaccccgtctctactaaaaatacaaaaattagctgggtgtggtggcacatgcctgtaatcccagatcctagggagactgaggcaggagatttgcttgaacctgggagatggaggttgcagtgagctgagattgtgtgccactgcactccagcctaggtgaccaagtgagattcctttgcccaaaaaaaaaaaaaaaaaaaaaaaagaagaggaagtatttaaattgcctatcttatgcaaactgtactagtaagtaaaagaacagtggatgagacttttctttagtgaggaactccaaatgaaagaagaatgttgaatttagaatgtcaccattttacagctcttaataaattaatagatctagtcactgagctttcaatgcttcttattacaaaaggagaagtaaccaaatattatgtgcctcctgatgaaaaataccatttgtgaagtagtcttgctcagacaaaaaagtcaaacctgaaattgatcaattttatagatccaactaccaatttgtagaaaatacagaggccagaggaatattaaacaacattaacatgggtacaattaataaaatccagactgtgagaaactacaggataatctgatttcttcaacaaataacttgcatgggggagaaagaagggatggaaggagggtgcctgcagattgaaagatttaaaaggacaaatgagaaccaggagctataatgtttagagatgataaattgaataataaatacagaaaagaaagtgaagagtataaagtggcaggatggtgcctacacttagaagaaatggagggtagtactgtgattagaaagggacatgtggggcccagcatggtggctcacgcctgtaatcctagcactttgggaggctgaggcaggcagatcacctgaggtcaggagtttgagaccaacctggccaacatggtgaaaccccatctctactaaaaatacaaaaattagccgatcatggtggtgggtgcctgtaattccagctactgagagaggcgtgtaggcaggagaattgcttgaacccgggaggtggaggttgcagtgaattgagatggcgccactgctttccagcctaggtgacagagcaagactccgtttcaggaaaaaaaaaaaaaaaaaaaaaaggacaggtgaaggctctggggctctggggttgctgacaaagttctatttcttgaccagggtaggtgttataataagatgtttgccttataagtcattggtctatacatttcatttttcatttatgcagttttcctttcttttctttatctttttttttttttttttgagacggagtcttgctctgtctcccaggctggagtgcagtggcacgatctcggctcactgcaagctccgccttccaggttcacgccattctcctgcctcagcctctggagtagctgggactacaggtgcctgatactacgcccggctaattttttgtattttttagtagagacggggtttcaccgtgttagccaggatggtcttaatctcctgacctcgtgagcctcccgcctcagcctcccaaagtgctgggattacaggtataagccactgtgcccggcctatgcagttttctttatatccattatattgctaataggaagatttaaaatatatatatattaaaaatttaaagcttatgaatgataaagaagaaaaaacattaagacttgcttttagtagacttgttctacttttttcactctcataagtcattttttaaccaaaattcctcaattacgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgcctcccgggttcacgccattctgcctcagcctcccgagtagcgtagctgggactacaggcgcccgccaccacgcccagctgttttttttttttttttttggtatttttagtagagacggggtttcaccgttttagccaggatggtctccatctcctgacctcgtgatccgtccaccttggcttcccaaagtgctaggattacaggcgtgagccaccgtgcccggccaacaaatataacttcttaatattttcagccatctgttttttttgcttatatgcatgttataatttatgattttgcaggtactcatgaattagtatagtattcaaagcaattatatatatatgatagttaaggaacattttgtaatattcatatgacacttaaatctatgtatatgtaggtctagttctaacatgtagcataataccaatataattttgtgcaataacaatttaatttctcttatgctactttgttactaaacttgaacatatatgcagacacttttggtatactttctaatcttaagtattatttttatagatttcagttgctgtccccaactgaaacttcagcctagtgaagtttctccaaatttagattaataaaaaactttaaaaactacatgactcaagaaaagttgtctaatttggcattaataataatggaacaaaaattatgtaaaaaccttaattataacaacataatgaagcaataaaaatattttattgattagaaatacaatatttaggagtctatgtatctttattctattattcaaatactacaaactcttcagcaggacacctagtcatgtgtaataataattatattcaatctttagtattttgcctacttccaattatatagtgtaattttccagtttttaaaaaattttgtcattatgaagatacatctgtcaaggagggaagaaagagcatatttaagagtttgctagcttgatttttataactttaaaatatttaaacctgtggtatgtaggtcttcatttgtactcttgcccttgggcctgcaaatgttacggatagtctattacttttgttacatagtgttttccagacatactagccaatgaaattagacaagaaacagaaataaaaaatatataagcatttataaggtatcattaattgagacaatctgttctacatagcagtatcaaaagaatcaataaatatgagtatggtaatattattggatatacaattaatatctaacaatcagtttcaattaataggaaaaaaatacaaaaaaagataacactcataatacaaaaaaaaagaaaaaaagctataaaataccctggaataaactgaacaaaaaatgtgacttttatggagaaaattaaaattttctgaaagactaaaaacaaaatgcaaataaatatcaaagtaaaccacattcctggatgtgaagactcaacactgtaaaaatgtaatttcagtcaaaatctcgggaggaagctttggataatttaacaaattgattttcatatttgtgtatagtagtgaagatggccatatagctaatacagttttgaagaagatcaaattgagtggacttatccttttgcatactaacattataaatctatagtaattatcatgatgctatattggaacaatacaatggaaaagaataaagagtatagtaacagatctattcacacataggtacttagtataggattgagataaaatcataaatcaatgtgtaagtgttcaaaaataaattccagatggattgaaaaccaaaaatgtggtaagtaaaattatacactattaaaagaaaaagtagtaaaactgaaaatcaattacttgagcatcaattggaaggaaataaattaaaactaaagaaagtggtaggaaagaaaattaaaccaaaattaaggaaatacaaaacaaacacaacagagaaagttaacaaagcccaaaagtggtcttttgaaaagattaattgataaattcttactaaaactgattaagaaaagaaagaaggcacaaataactgataccagaaacaaaagggggacatcactataacatctacaggattactaacactgacaccagaagaaaccaaagtctgaagattcctgtatctgttaaagaaattgaatccacaaagcaacctccatgcccagatggcttcacttgggaatcctttcagatgttaagatagaaacaatgaaagtcttatgttaacttttcccagaaaacagaaaaagaacatttactatattcattttctatgtctgctttaacaaattgccacaaactggatgacttaaaacaacagttctggagatcagagtctgaattcaaagtgtgagcatggttatgccccctctgaaggctctaggggagaatccattctttttttggctgtgtcactcatcagtctgggcctctgtggtcacattgcctccttctcttctcaagatccctaacttaattacgtttgcacaaccctttttccaagtaaggtaatattcacaggttctgttgattaggtcacaaatacatctttttttggtggtagtggggcacacatcattcaacctactacattttctaattcattttatgagactaggataattctggtatcaaaacctaccaggacattataagaaaggaaatatacagaccagactttcttgtgaacataatgcagaaatcctgaagaatatacagtaacatcagttaactagaactgatagacatttatagaatgctttatccaacaacaacaaaatacacattcctcttaaggttatatggaacattcaccaagatagaccacattctaagtcataaaacactcaactcatttaaaagaatagcatacaaaatgttcctacagaccacaatgagttaaactagaaatcaataacagaaagccaaaaattcccaaaatatttggagattaaacaacacatttctaaataatacatgggtcaaagaaaaggtcttaaaagcaaaaatatttttaaatgagaatgaaaatacaacttaccaaactttgtaggaagcagtgcttagagggagatttactgcattgaatgaatacattagaaaaaataaagatctaagattgagaatctggccaggtgtggtggctcatgcctgtaatcctagcactttgggaggccaaggtgggtggatcacctgaggtcaggagtttgagaccagcctggccaacatggttgaaaccctgtctctactaaaaatacaaaattagccaggtgtggtgacaggtgcttgtaatcccagctacttgggagggtgaggcaggagaatcgcttaacctgggaggcgaaggttgcagtaagctgagatcgtgccattgcactccagtctgggcaacaagagtgaaactccatctcacaaaaaaataaaaaataaaaataaaatcaagaatctaagcctccattttaggaaattagaggaaacagggcaatagaagtctaaagcaagctaaagaaatgaaataatgggctgaggcaggaggattgtgtgagatcgtgagttcaagaccaagcaaacatagtgagaccccatctctatcaagaaaaaaaaaaattagctggggatggtggcatgtgcctgtagtcctaactactcaggaggatcccttgagcccaggatttcaaggttacagtgagctatgatcaccccactgtactccatcctgggtgacatagcgagaccccgtctctaaaaataaataaataagtaaataaataagctttaaaaaataaaaaggagtagaaattaaggaaattaataacaatggagaaaataagtgaaaccaaaagccagttctttgaaatgttcagtaaaattgctaatcctttagtcagactaaccaagataaaagaagaactgaagtaccaagatcaaaaatgaaagggattgttgttgctggtcacatgggcattagaaggataataaaggaatattatcaacaactctgtgttcagatttaaaaaaaaattttgtggatacacagtaagcatatatatttatggggtatatgagatactttgatacaggcatgcagtgtataataatcatatcagggtaaatggggatatccgtcccttcaagcatttatcctttgtgttacaaaccaattatactcttgtatgtttaagtgtagaatttattattgactatagtcactctgttgtgctatcaaatactaggtcttattcgttctttctaactacttttcttacccattaaccatccctatgtcccctccacatcctcctgccctcacccttcccagcctctagtaaccattcttctactctctacccccatgagttcaattgttttaattttcagcctccacaaagaagtgagaacatgtgaagtttgtctgtctgtgcctggcttatttcacttgacataatgacccccagttccattcatgttgttgtaaatgataggatctcattctttgtatggctgaatgtatatatgttggatgttggatggatatatgttggatatgtatggatgaatgtatccattgtacatatgtcccacattttcttaatccattcgtctgctgatggacacttaagttgcttccaaatcttggctattgtgaacagtgccacaacaaacatgggagtgcagatatctcttcgatatactgatttactttcttttgggtatatacccagcagtggaattgctggatcatatgggagctctgtttttagtttttttgaggaacctccaaactgttcttcataacagttgtattaatttactttcccaccaacagtgtgtgagggttcccttttctccacatccttgccagcatttgttattgtctgatttttggatataagtcattttaactggggtgaaatgatatctcgttgtattttgatttgcatttctctgatgaacagtgatgttgagcaccgtttcatatacctgtttgccatttgtgtcttcttttgagaaatgcctattcagatctttggcccatttttaaattggattgttagatttttttttcctatagggttgtttgagctccttatatattctggttattaatcctttgtcagatgtgtagtttgcaaatattttttcccatcctgtgggttttctcttcactttgttgattgtatcctttgctgtgcagaagctttttaacttgatgtgatcccatttgtccatttttgctttagttgcctgtgcttgtggggtattactcaagaaatgtttgcccaaaacaatgtcctggagcatttcccccaatgctttcatgtaatattttcatagttaaaggtcttagatttaagtctttaatccattttaatttgatttttgtatatggtgagagataggggtctagtttcattcttctgcatatggatatccagttttcccaacaccatttattgaagagactgtcttttctccaggatatgttcttgggaactttgagtttattataggtatatggatttgtttctggcttctctattgttccatatgtgtctgtttctatggcagtaccatgctgttttgattactatagctctgtagtataatttgaagtcaggtaatgtgattcctccagttttgttctttttgctcaggatagctttggctatattctgggtcttttgtgattccgtataaattttaggattatttttattctatttttgtgaagattgtcattcatattttgatagggattgcattaagtctgtcatttgctttgggtaatatggacattttaacaatattgattcttacttaaacccaggagacagaagtttcagtgaactgagatcgcaccactgcacttcagcctgggtgacaacaacaaaacaaaacaattgattcttctaacccatgaacatggaatatcaatatctttctgtttttttgtgtgtgttctttttaatttatttcattagtgttttatatttttattgtagggatctttcacttctttgcctgattccttatttaatgttatttaattttatttgtgacttgtaaatgggattactttttaaatttctttttcatattcttcactgttgacatatagaaatgctactgatttttgtatgttggctttgtatcctgcaattttattgaatttgtttatcagtgctaatcattttttggtggaatgtttaggttttcccaaatataagatcatatcatcatcaaacaaggataatgtgacttcttcctttccaatttggatgccctttatttctttcccttatctgttgctctagctaggacttccagtactatgttgaataacagtggtaaaagtggtcatccttgatcttagaggaaaggctttcagtttttctgcattcagtatgatactagctgtgagtctgttctgtgtggtttttattatgttgaggtatgttccttctatacctagtttgttgaggggttttatcctgaagttaggttgaattttatctggtgctttttcagtatcaattgaattgatcatatggtgtttgtccttcattctgttgatatgatgcatcacattgattgatttgcatatgttgaaccatccttgcatccctgggataactctcacgtgttcatgatgaatgatcattttaatgtgttgttgaatttggtttgttagtattttgttgagaatttttgcatcaatattcatcagagatgttggcctgtagttttctatttttggtcttgtctggttctggtatcagggtaatactggccttgtagaatgagtttggaagtattccctcttcatctgttttttgaaatagtttgagtgggattggtattaatttttcttcaaatgtttggcagaattcagcagtgaagccatgaagtcctgagcttttctttactttagtgactttttattatggctttgatctcatgttcacaaatttgataacttagatggaaaggactaattccttgaaagacacaaactaccaaaaactcacacaaagagaagtaaactgaataggcatatataataaagaaatgtaattaatagttaataaccttccaaaacagaaagcaccagacccggatggtggttttactggtgaattctaccaaacatttaagaaagaaatgataccagttctctataatattgtccgggaaatggaagcagaagacttccctaactcattctgggtgcccagtgttactataataccaagaccatataaaaatattacaaaaaaggagaactcaagaccaacatttttcataaaaatagatgcaaaaatatttaacaaaatattagtaagtcaaatccagtgatgtataaaataattatatcccacaataaagcagaatttatttcaaatatgcaaggatattttaacattcaaaagtcagtgtaatctattacatcaacagactaaagaaaaaaatcatgtggtcacatcagaaaatgcagaaaaaatatttggcaaattgtggcacccactcgtgataaaaatacttatcagactaggaatagagaggaacttcctgatttgataaagaacatctacacaagacctacagctaacatcataattttttttttttttttaaagacagagtccagctctgttgcccaggctggagtgcagtggtgcagtctctgctcactgcaacatctgcctcccaggttcaggtgattctcctgcttcagcctccccggtagctgggattacaggcctgcgccaccatgcctgcctaatttttttgtattttttagtagagatggggtttcaacatattgggcaggctagtctcaaactcctgacctcaagttatccacccactttggcctcccaaagtgctgggattacaggtgtgagccaccgtgcctagccaacatcatacttaatgatgagaaactagatgctttctccctgagattgggaaagaaaaagatgtcccctttcaccactcctgttaatcacagtattggaagtcctatctaatgtaataaggcaagaaaagaaaagatatacattggaaagagataaaattggctttgtttgcagttgacacaattgcccatgtcatgaaacccccaaagaattgacaaaaaaaaatagtaataataaacctcctcctgggccgggcgtggtagctcacgcctgtaatcccaacactttgggaggctgaggcaggtggatcacctgaggtcaggagtttgagaccagcctgaccaacatggtgaaaccctatctctaccaaaaaatacaaaaattagccgggcatggtggtggtagctgtaatcccagctactcaggaggctgaggcaggagaatcgcttgaaccgggaggcagagattgcaatgagccaagattgcgccactgcactccagcctgggtaacagagcaagattctgtctcaaaaaaataaaataaataaacctcctcctgtaactaattagcaattatagtaaggttacaggatctaacattaatattacaaaagttaattactttcctatatacctgtaatgaactactggaatttgaaatttaaaataatactgtttacattagcatcaaaaaaatgaaatacctaagtataattctgaagaaaattttgtaagatctatatgaggaaaactacaaaactccagtattccagtgaaagaaatcaatgaatatcttaataagtgaagagatattacatattcatggataggaagactcagtattgctaaaatgttaacttttttcaagttgatatatagattcaccaaaatccaaatcaaaattttactaaattactttgtgagcaacaggagcaacaagaactcttattcattgttggtgaggattcaaaatggtaccgccagtttagaatacagcttggcagtttcttacaaagctaaccataaatgtatcatttagtcaagcggtcgtatatttaagtcacaaaactggttttgtggatgttcgtaaaacctgcttggaaaagcaagctaggtgcagtggcttgtgcctataatcccagcaacacaggaggctgaagcaagaggatcacttgaggccaggagtttgagactgtcctgggcaacatagtgggacccccatcacttaaaaaaaaaaaaaaaaaaagttaatatggagaagccaaagactgagaagaaccagcacagtactgaataagaaaaaagtcagaggactgacactattggactaattttaagacttagtataaagctccagtaatcgagacatgtagcattggtgaaagaatagattaatggaccaatgaaacagaatagagagcctaaaagtagagccacataaatagtcaactgatctttgacaaaggagcaaaagcaagtcaatggagaaagtatacatttttttcgacaaatggtgttggaaaaattggacatctgtatttaaaaagatgaaggtagacacagacctttcacaaatatcaactcaaaatggatcatatacctaaaagtaaaacacaaaatttctagaagaagtgtaggagaaaatctaggtgaccttagatttggcaatgaacttttagatacaacaccaaaaacactactcatgaaaggaaaagtgagtaaattggactttattaaaatttaaaacatcttctctgagaaaggcactattaagagaatgaaaaccacagactgagagaaaatatttgccaaatgtataataaaggacttgtgtgcaatatatgtaaagaacttttaaaactcagcagtgagaaaatcagctgggctctgtggctcacgcctgtaatcccaacactttgggaggccaaggtgggcagatcacttaaggtcaggagttcaagactagcctggccaaaatggtaaaaatccgtctctactaaaaatacaaaaattagctgggtgtggtaatgtgtgtctgtaatcccagctactgaggaggctgaggcagagaattgcttgaatacgggaggcggtggttgcagtgagctgagatcacaccactgcactccagcctgggcaacacagtgagactctgtctcaaaacaaaacaaaacaaaacaaaacaaaacaaaaaaacccatctcaatagtgagaaataactcaattttttaaatgggcaaaaaatctgaacagatattttaccaaagaagatatgcagatgacaagcataagaaaagatgcttaatatgatatgtcactagagaattgaaaattaagacaatgagataccactgtatacctattagaatgggtaaatctcaaaaatctaaatacaaaatggtggtaagatgcagagcaacaggaacacttattcactgttagtgaggattcaaaatggtacagccagtttagaatacagcttggcagtttcttgcaaagctaaccataaatgtatcatttagtcaagcagtcacatacctaagtatttatccaaatgagtagaaaatttatatccacacaaaaacctacacacaaatgtttatagcagaattattcataatcaccccaaactagaagcaactaagatgtcctgcaataggcgaatggataaacaaactggtatattcacacaatgagatatttttcagcaataaaacaccgtaagttatcatgccatgaatagacttggaggagccataaatgcatgttgctaagtaaaagaagccagtctgaacggttacgtagtgtttgattccaatcatatggcatctggaaaacacaaaactatagcgacattagaaagatcagtggggctgggcacagtggctcacgcctgtaatcccagcactttgggaggccaaggcaggagaattgcttaaggccaggagttcaagaccaacctggacaacatagaccccatctcttcaaaaaatttttttttctaattagttgggcatggtggtgtggctttactttcccctgcttgggaggctgaggcgggatgatcgagtgagcccaagaggttgaggctgcagtgagccatgatcataccaccatactctagcctgggtgacagtatgagaccatgtctgggaagaaaaaaatcggtagtggccaagggttcatgagaaagagaggagggatgaataggtgaaacatgttgttgacagtaaactattctatgtgatactgtaatggcagctacatgacatgcatttggcaaaacctctagaactaactatataatacagagtgaactttgttgtaaactatagaccttagttaataataatgtatcaatttggttcattaattgtaacaaatgtaccacactaatacaacatgttaatgatagggggaactatgtgtgtctgttggtgggggtgtatatagtaactctctatactacttgctcttattttaaataaaaattttaggctgggcccagtggttcacgcctgtaatccgnnnnnnnnnnnnnnnnnnnnacctaggaaaaaaacccgcttcggtctctctaaaaaccaaaattggccgggtgtggtggtgggcgcctgtaatcccagctactcaggaggctgagacaggagaattgcttgaacctggaggcagaggttgcagtgagccgagatcacgccactacactccagcctgggtgacagagtgagactccatctggaaaaaaaaaaaattaaaggggagataaacaaatgtgaaaggtgttaaaattgtgcatgtgccaaatggaaatattttacagtctgtaacaaaggaattataaaataattgaaaggcaggaaaaaaaaacctatagtaaacatcataattgaatagtggcagctttttctctgagatgagaatgagacaaagatgtatttcattatcggttgtatttatcattgtactagagaagatcatagccactgtaataagcaaaagaaatagaaagtataattattggaaaggaggaaagttagttcattattcactggtgaattgatattttatgtggaaaatcagaatgaatggacaaatttagaaatattgttgggtacagggtcagtatatgaaaattaacattatatactggcagcaattaaagaatgacatttaaaatattccttttttttgagacagggtctccttctgttgcccaggttcatagctcactgaaggcttgacctccccgggctctgttagtcctaccatctccacctcctgagtagctgggactatgggcatgcgtcaccacacctggctaattactgtattttttgtagcaatggggtttcaccatgttgcccatgctggtctcgaattcctgggcttgggtgatcctcctcccttagccttccaaagtgctgggattataggcatgagccaccactcgctgccaaaaaatattccattttaataagaacgtcaaataaccaggaaaaacaatctaaagatgagcaaggtatctatctggaaaactacaaaaattactgtgaaaaattaaagaaatcctaaataaattttgaaatggatcatgtttctggattggaagatttaatattgtaaaaatctcaattattcccaaattttctacaaattcagtgcaatcccagtaaaaatttcagaaagttttcttgtagaaattgatatgctgattctgaaacttaataggaaattccgaggatcaagaataactaagataatcttgatgaagaagaacaaagttgaaggacttacgttaccagacattgtgacttattattaaagcttcataattaaaacagccttagtggcacaaagacagactaatggagcagaatacaaagtccaaaagtatatccaatcccttactcccctgtgattatttataaccagggtgctattgcagtgcttgccttgtaaagctgaggctatcacatttgagataaggaagcactttctaggaaagaatgttttgaaggagtcagaactcagtttgccactcatgtcgctatctccgtttctattgacagtatcccaggctgtgtaattcagggcattacttttactcgtcgaaacatgagtcaggaattggctttggtgtcagtgtggtagtttggagtattgccacgcctatttgtgcaaattcaactactttcagtttaaaaggttggggagagatgggaaataatgtaaatactttaggcaatctattttttcattcagtaatcataaaactaggtatgagatgagatgagaaatgtgaattcctgttgcacctgttggttcctatgtgtctcagcgtgtgagctcttgcttcacttgtgagtgaagcatgagtccagtttgttccaaacaacatactcactaaacgaaaactacttcatttattattatcagttaagaaatagcactgtcgacctaaataaggaaactgaggcaaaattaatctagagagtttatttggggcaagtttgagattgcagctcaggtaacactgggaagtgatcccgagaataaaggagttgctcgagttggtttgttttgttttgtttttttgagatggagtctcgctctgtcgccaggctggagtgcagtggcggatctcggctcactgcaacctctgcctcctgggttcaagcgattctcctgcctcagcctcctaagtaactgggactacaggtgcacaccaccacgcccagctaatttttatatttttagtagagatggggtttcactgtgttgaccaggttgatctcaatctcttgaccttgtggtccacccgcctcagcctcccaaagtgctgagattacaggtgtgagccactgtgcccatcctgctcgagtttctaaagaaaaaaggatgaatcaggagaggggcaattacaaaagttgtttttgggaactcttacgggtttccagaagtagcattgattagtgattgatcgtacattgttgaactatggggtaggagttagagtatcaagcatatggtattgttaggttactttatagctacttgtgtcagtcactctagagcccacatagcggctcacatctcttagattaaaagtttcttttctttctcaggatctagcccaatcctgagggaaaagcagctgtgttaagcgttccaaagcagtatatgtagtggtcatggcttgtgctcttgaaccagactacctgggttcaaatcctagttcagtgtgccctgggcaggttacttaacctctatgctcagtgtccttatctgtaaaatggagatagtaatagcacaacacctcatagcagtgaactagcatataaaccatggttggcacatagttggtgcataatcaatgttaactatttttgttattaccagtattgttattactgagacgtgataaaggtggtatgctcttaaggtattttcaagggaaacagctaactctttttttacctttggcttatgcttttagaacccaatccctgcatgaaatatgattctactgtaccaggctagtttctctgtttggtgtttgtttctgtagggagctgataatcagatgtggctagctgtgggatggtcatatgtcacagaacacagctattaggggcaggagagcctttgtgttgggcaaggtagatgtgtagatatcctaaaatatattgaatatgtatgtttaagtacacatattttagccaccagcatttttctatgtacaaagatccactgagtctttttttttttttttttttgagacggagtctcgctgtcgcccaggttggagtgcagtggcgctatctcggctcactgcaggctccgcctcccgggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcccacctcggcctcccaaagtgctgggattacaggcgtgagccaccgcgcccagccaagatccactgaatcttttaaagtcagtgtagcccttattatgcttctatcctttgcttttcactagaaaatgattgtagcctatattgtaggatggcatctatgcagtcagtatcccatggtactgcatgtgggtgcattattgtagggtacaacactttcatgttttatgattctactcttcttccctgagtccgtggatttttatctcaccaccgattgttgcctttgaagaattttgaggaacattataggtggctgttcgccatcttaaccactctcccccttccacactcagaggcacagactctcatatttactttccaggactctgaaaactgaggcactactcttgttcctgacttcaaccctgtccacccttcttctcacagaaaagctgccctttgtttttagctgtcactctgcagtgctgaggcgcacacggctgtttgctcacatactatgagcagcagctcctctccttgactgccagaatgtcgaggcttcactcagtcccctgccatgctggcagctactgcttcctctaaggcattactgatgccaaccaagattttgtttgcttctgtctgcttttcttccccccacctcttcccgccccatctttcctatgttctctggctccttggcttttgcttaggaaaaactgatcacttatagactttgccaactaatgagctccatctttctgccaggcaaacaaatacttcaaaccaaatgggctttgtcatcaagctttttttgacagtgttatttgaggctcaggcatctgagcctgttcagtgcatctaccaccaaaagagggcttatgctagagagttggtcttcaaatagaaccagttatggtctttcctgtgtccattacttagaacaagggaaatataagcttaatgagttctaaggtaatttgtattgtgtgtccaaaatagcttctgaacatgcaaacacttaatatttcactgtagtgatgtaaagttatagtgcacttgtatatttcagattgaggaatcttgaaaaaacttatgtatccaggtggcggattagagtttatctttcaagttataattatcctgaaatgttaacaccatctcgtttttgtgtttttttcctctctctgtagaatattttccttcttggatatagtaactttgtgccgatgtgcacagatttccaaggtagagtattcaccagattttttaatcaataaatatcaagttttattagaatgagttttagttcaaattactgaaaattaaaattttattatcttttatacttaatataacataatggtataattttgcatttgatgattaacttaatatacatcaaaaataggagtttggaaataaaggttaatcaagactttctttaatagtctcaataaatgtgtttctttcatcccaatccctcttcctttacctcccaccttccaggcttggaacatcttagccctggatggaagcaactggcaaagaatagatctttttaactttcaaacagatgtagaggtaagttagctttggtttagacaaaaaactttttaaaaatatgagtagctgttccccctttcctgactttttattttactgcatttagatctaatattaaagtgctgaggtagaacagaaagaagaaaaactggaagggatttgcatacatcaaaacaaaaccctgcttgcattttaaattgtatcagtaacagatttttttcccttgtttatgtttatagtctgaattttactactcagctttttaaagccacacacctgcatcattatcacctggttcagtgctttaaccttaggagacttgacaaatacttattgatctagaaaatccaccgagaattctaattcagcatcaaaagtggagaaatggcagaagcagaagcccaagagtgaggctggagatctaaagtgtcaccctagcttggccacttaagtcatataatctctcagtattctgttttattatctataaaataaagtaataattaagtcttatacaattattatatacagaatatataagattctgatatatttatctgtaaatatgtaaatatctccatttaagtgtggtaaacctgatgaaatgaggaaagtttatgttaaaacaactttgatattcaatactaaatttctaaccaaaaagaaagtttaggcagggaataaaaaaagagcattgtacttaggaattgtctgaagtgctggtttgagggtcttgagattctgaagtttattttctacctaatataaaacctaattgatttccagtttagcaaacttacagtagtggaaatgcattttaatttagttactcacatagtatgtttgctatgtgtttttaccaagatgtatatattggtttttttttgtttgttttggataaggaaatgaatgtgtttaacagtaggattgagctaagcaatttcctgctagctacttaacctggcttgacctagacaaactaatgatctaggtcagttgtggagactcttcacctccttctctaggttacttactgcctgagagtctctggttctcatcttaaaccagtggagcacaatacttacagtaagtggggcagagcagaagatttccctttattaaataaagggggaaaccccttatttctgtcatattgtggtgctctgctcttggaagggggcagggacctcaaggattcacgcccatcctggaaagataagctctagttcctggcttaacactgtagtttctgaattaggtgttctttagtgctcttttgagacttaacagcagtgattacaatagtactccacctaaacatgccagcattccatgccagtgaatataattgcccttcaaactgatcatacctaactctttgttcactatgtttacttagtgatgatgtggaggacatttaatttctaaaaattgtagtcatttctactgaccacaaagtagagttattgttttgaaaaaattgagcaaaatacttactctttttctgtggttcttcatgtctcctcaattttgatgacttttccaaccatacaacttttttggaaagcacatgaagaactttttttttttttttttttttttttttttttgagacagagtctcgctctgtcacccaggctggagtgcagtggcgtggtctcggctcactgcaaactccacctcctgggttcatgcgattctcctgcctcagcctcccatgtagctgggactacaggcgcctgccaccacgcccggctaattttttttttttttttttttgtatttttagtagagacggggtttcaccatgttagtcaggatggtctcgatctcctgacatcgtgatccgcccgcctcggcctcccatgaacttttaaagtcaggctgggtgcagtggcccacacctgaaatcccaacactgtgggaggccatggcgggcagatcactggagcccaggagttcaagaccagcttgggcaacatagcaaaactgcgtctctacaaaaaaatgaaaaaacaaaagttagccaggcacaatggcacatgcctgtagtcctggctactcaggaggctgaggtgggaggatcacctgagcccagggggcagaggttgcaatgagctctgattgtgccattgcactctagcctgggtgacagagtggggccctgtctcaaaaaaaaaattattttgatattaaaaagtactactatttcaagtaaatatcactaccttgtgcattatttgattacaagattttagctgactgctgactttcagctaactgccatataaacacatcccagaaatacttaaaagtatatccaccaaaggggaagccagtttatggtttaccagttatataaagaattgtatgtgaaaacctaaaatagctggcaccagagtttcaatctagtcataacacttagcttcccttttgggctagcccccttggtccaccctagattatgaaccagtcttggggtctgccatagtccttaaacaagaccctttggaggatgcttgccctaggaagcattttatggatagtcttaaaaatatgcactttgggaaggaaatggtaacttttggatatggttgagagaaaagagaagttgccaaggatcaggatcaacacactaataatatttgttgtgtgcctgacactgttgtaagtaccatattaaagaaactgaggcaaagaaaaggttgagtaacttacccaaggtcactcacctactaagaggagactgtaggtatcttgaacggtgggttgcatgactggcacatgaagaaaaggcagagtaaagcatctaggtgacaagtgcacacggtaccttccttcctcatcactctttcctgaatacgtgtagtttacctgaagtttgggttggcattttctgtgcctttaaaacttggacattttgttgtcagtgtcttcatggttattgaagattgtgctaggccaaaaatgagaaataactaagtagtgtgtgaatctaaaagtgataactccaggggtctttagcccattttagggcttatttttctctaaagcccttcattctaaaagcatgcctataacatattgtctagtagataagacacagagtcactggcttgaatattgcactgaaatggatttgcattttccccctcttagttggaaacagtggaacagaaaattgtgtatgtagttttgtattccagtacaagaactttgccccaaaaggggaggactagaaagtttatataaatgttactaacttgatattccccatcctgtgtccatgtgttctcattgttcaattccctgtatacatatgtaacaaacctgcacattgtgcacatgtaccctaaaacttaaagtataataataataaaatttaaaaaaatgttactaacttgaaatggagaagagtatattaggtgctctatttgtagacattggtgtagagctgcttttttttttcctgtttattaggtacttaaatatatatctttgatttctaagtcataatctttttccccctggtgacaaagatttattttacagttgtctggaattttgcttcaaaaaatattaataatcattaatgcaagtagtctcaagaaagtataaataaatgctagcagtatcaaagattggattttcaacataattaagatgttagctaggtaacaatatgtatcctgtggggttttttgtttgtttgtttttatgagacagagtcttgctctgtcacccaggctggactgcagtggcatgatcttggctcactacaacctctgcctcccaggctcaagcggttctcctacctcagcctcccaagtagctaggactacaggcatgccccaccatgctctgctgatttttgtatctttagtacagaaagggtttcaccatgttggccaggctggtctcaaactcctgacctccagtgaatcaccttcctcagcttcccaaagtgcagggattacaggcgtgagccactgcacctggcccctgtggttttgatgtatcctggtgaattcatcatgcttacagttcagtgccaagattgctgttttataaaatgaggataacattattcaaaaccaatcaaattgtccctttgaacttttcctcccttgtggaggtagaggttgtagttagtatttataactaccttcttccacaatgcatttctgtattcctttgccttcagcaagcacctcagctggtgatggttctttacctggtggaatgactcagacctttattcctgaaggtctggtcattaatagtcgtgcttggattgggttgttgtagtttgctactgacataaatcacagggcatggtagtactacaggatgccctaagggatcttctgtattccacacatactctttcttacctccattttgggagtgttcatgaagttttttgactattaaatgagccataataggtacaagaaattgttcctcaaaaagtggaagtaaaccaggtgccatggcatgttcctgtagtcctagctactccataggctgaggcaggaggatcacttgagcccaggaatttgaggctgcagtgagctatgaccacatcactatactccaatctgggcaccaaagcgagaccccccaacaccaaccctgtctctaaagaaaaaaagtgatttgaaatagaaaacattttttaaaaagtggaggtgcttaatcattgttcattgttcattttctttttgcttcctctaatatctctgccagtactcaacaaaagttcctttttcaaagcaaatgtgtttaagcagaggacagctaaggaggatgagggggagcttttgcaatatattgttatacttttgaagtggtaatgcttagctcaagtaggattttctttttaaagcagcattgtcttagatctctgctcagtggctggtattcccacagctaacctcaaaaagccttttggttggtggaatagctgtgacctgggtagggagggcctaaccccagggctaaggctttcaaaaggcagtgtacaggttttggtttttgcatttgtgtttgtttttgtttgttggttggttttagaatacttaatgctttaattggaccatttttcagtgcttgcagcccctgtatgcattaaggatagaactgaggtgttacaggaatgttccaaaatattttctgttacacttggaaaaatatattcagttcctagatttcaggttattttgctgttagataagcagcatgaaaaaacagtattttttcctcccgaactttcttgattaaagggtcgagtggtggaaaatatctcgaagcgatgcggtggattcctgaggaagctcagcttgcgaggctgcattggtgttggggattcctccttgaagtaagtcaaatccagtgactcactgtcatggcagcttgtagcattttcatcagcaaaaataaaccaagcctattacatgctcttcttctgttaaaattctttctgtggtaatttgcatagagtaatgagaggaccaggactttggaatagcaaacctgggttggaaaccgagctgtactgttgttagggatgtgaccttgggacaaattatttcccccggccgagtgtcagttctctcttctgcaaagtcagggcagctatagctcccacaggactgtcataggcataacaagaaataacatgtatgaagtgcctacctcttttctattcccttcttcacttcggcatcttcctagttttcctctcataatattagctacctttatatataaattttactaattgataaaataactatttcaaaaatttccttggcataagctagaattttgcttactcataatgagatgtgatttttacattaattttattacagttagcaatatatcctatacaaccaaatatttgcccatctcttactggatagccattatttattggggtttttttttttttttgagaccgagtctcactctgtcactcaggctggagtgcaacggcacaatctcaactcactgcaacctctgcctcccaggttcaagtgattctcctgcctcagcctcctgagtagctgggattacaggcgtgcaccaccatgcccagctaatttttgtatttttagtagagatgggatttcaccatgttggccacgctggtcttgaactcctgagctcacccatcttgaactcccaaagtgctgggattacaggtgtgagccactgcacccaggctattgggaatgttatcaatgctaaggatgtgtactggccaggcacagtggctcatgcctgtaatcccagctctttgggaggctgaggtggaacgatcccttgaagccaggagtttgagaccagtgtgggcagcaaaatgagactcttcgaccaaacaaacaaacaaacaaacaaacaaacaaaccaacaacaatttgtgctttgaggatttctggagacagagatgattaaaaccttcatgtctttatcctcatggcctctagtattgcttatgagtttggctaaaattaggatataccccccataaccttggaatacactttgtgttcttgcagacctaaatattaccacaatgtacagcaatcacagacttccagtaagaatgtgcaacatacagtgaatgcagacagtagaatttataattcaaacatctgctataccattgctgaaaaaaaattgattcacaacatcttttaagtataaaaacactcactttaaatgttatggaacaaaatgattttccttaaatgaagaaaattctttaaatcatgaattagattggctcttttaaacatgtttaaacaaccctccatcactcatataaagcacacttgaattgccatgtattatttattttatatattattggatcctatttgctacaattttgttaaaaaattttgcatttgtggtcatgaggaatattgtcttatgattttattttcttataatgcttttgtctggtgtaggtatcaaggtaatactggcttcatggagtgaattgggaagtatttcctcctattcacatttctgggggtgtgttcagtggctgacatctataaccccagtgctttgggaggccaaggtgggagaatcacttgagcccaggattttgagaccagcctgagcaacacagcaagaccccatctctaaaaaaaaattaagtagctgggtgtggtggtgcatacctgtagtcctagctatttgggaggctaaagtgggaagatcacttgagcccaggagttcaaggctgcagtgagctatgatcacaccaccatactcaaagctgggtgacagagtgagactctatctctgaaaaataaaaacaatttggctgggtgcggtggctcatgcctgtaatcccagcactttgggagactgaggcgggtggatcactaggtcaggagattgaaaccatcctggctaacacagtgaaaccctgtctctactaaaaatacaaaaaattagctgggcgtggtggcaggtgcctgtagtcccagctactcgggaggctgaagcaggagaatggcctgaactcgggaggtggagcttggcagtgagcaagcaacagaacgagactccatctcaaaaataaataaattaaataaaaaaacaattttaaaaaattctgggagtgtttatgtacaatttgtattttttaaaaatgttttgtagaattcactattgaagccgtctgctcctacatgtttttttgggggaaggtttttaattacaaagtcagtttctttttttttttctttttagatggagtttcactcttgttgcccaggctggagtgcaatggcacagtcttggctcactgcaacctcaaaggattctcctgcctcagcctcccaagtagctgagattacagtcacccaccaccatgcctggctaattttatattttcagtagagacgggggtttcaccatgttggccaggctagtcttgaagtcctgacctcaggtgatctgcctgcctcggcctcccaaagtgctgggattataagcgtgagccaccgcacccggcctcaatttctttaatatgtatagaactcttcagattatttcttcataaatgagttttggtagtctgcgtctttcaaggaatttgtcaatttcacctaagttcctggacttattagcattaagttgtttataatatcctcttattttaatatctgtaaaatctgcagtgatatcccctctcatttctgaaattggtaattgttgtctttttttttttggtcctcgtcagtctggctattaagaggtctatcaattttattgatattctcaaagaaccagcttttgttttcacccatttttcattgtttttctgttttctacttcatttatttccactctgatctttattatttccttccttttggttactttgggcttcatttgtttttgtttttgttttttctctagtttcttaagatggaagctgaagtcattggtttgagacctttttttctagtatgggagtttaatgacataaactaagtcaatactttggggaaaatttatgccacaaattcttatatgctatgttttcattttcatgcaaaatgcattctaattccccttttgatttcttccatgacccatgggttgtttagaacaatattatttagtttccaaatatttggacattttccagaagagcacgttaatgattcctaattcaattcagttgtgatcacagaacatagttataccctgaatccttttaattttattgagacttgttttgtggccagtaatatggccagtcttggcaagtgtcccatgtgcacttgaagagaatgtatattctgctgttagatgaagtgtgccataaatgccagtaggtcaggttggttgatagtgttgagcagatcttctatattcttactaattttctgactactaatttatcaactaataagaggagtattgaaatatctgcctataattttgcatttgtctatttctcctcacagtcctatcagctcttgcttcaagtattttgaagctctgttactatgtatataaacatttagaattgctatgtctttttcattgattgtccttcttttattcctgatagttttctttactataaaatcttctttgtctgatatagtcattccagctttcttttgactagtgttggcattatatatgtttttccatcattttattttaatctatttgtatctatatttaaagttgattttttatagttgggtgttgcttttttttccttttttttagatggagtcttgctctgtcgcccaggctggagtgcagtggagtgcagctcactgcagcctctgcctcctgagttcaagccattctcctcagccttccgagtagctgggaccacaggcgtgtgccaccacgcccagctaattttttatatttttagtagagatggggtttcaccatgttagctaggatggtcttgatctcctgaccttgtgatccgccttccttggcctcccaaagtgctgggattacaggcgtgagccaccgtgcccagctgggtgttgctttttatccaatatgacaatctttgctttttaatttgtgttagaccatttgcatttaatgtgattattatggttaggtttaaatctaccctcttgctgtttgttttctatttgtcccatacatccttttttctcttttcctctttttctttcttcttttagatttttttttttttgagacagggtcttgctctgttgcccaggctgcagtgcagtggcacaatctcgactcactgcagcctctgcctcctgggttcaagcgattctcgtgcctcagactcccaagtagctgggactacaggcatgggccaccttgcctggataagttgtatatttttagtagagacaggttttcaccatgttgcccaggctggtcttgaactccagacctcaaatgatctgcccacctcagcctcccgaagtgctgggattacaggcatgagccaccatgcctggccgagattaagtgttttttatgatttcattttatattcttttttagcttcatttctatagctcttcatatgtttagttgttgctttagagtttattgactgcatctttgatttagtacagtctaccttcatattgtattacataacacttccacttctcctcactcggttgtcatacattttaattctacttacataaacttcataatagatttagtatctttaacagccaattatttttaagagatttattattatcattattatcattattattattattttagatagtctcactctgtcacccaggctggagtgcagtaccatggtctaggctcagtgcaacgtctgcctcccaggttcaagtgattcttgtgcctcagcctcccaagtagctgagactacaggcatgtaccaccccgcccggctaatttttgtacttttagtagagacagagttttgcccagttggccaggctggtctcaaactcctggcctcaagtgatctgcctgcctcagcctcccaaagtgttgggattacaggcatgagccacagtgcccggcctatttttaagagatttaaatttaaaagttgtatacacccaagtagttgctatgtccagtcattcctttctgtagacacatatttttatctggtatcattttctttctgcataaagaagtttttttacatttcttttactgcaagtctgattaattcttccagctcttctatgtctaaaaaaatctgttttttcctccacttaaaaaaaatatttttgctgggccaggtgcagtggctcacgcctgtaatcccagcactttgggaggctgaggcgggcggatcatgaggtcaggagatcgagaccatcctggctaacacagtgaaatcccgtctctactaaaaatacaaaaaaaaaattagccgggcgtgatggcgggcacctgtagtccaagccccttgggaggctgaggcaggagaatggcgtgaacccgggaggcggagcttgcagtgagccgagattgcaccactgcactccagcctgggtgacagagcgagactccgtctcaaaaaaaaaaaaaaattgctgagtctagaattctgtagtgactattttttgttttttgtattttaaggatggtgctcctctgttttcttgctttttcattaccagtgataaatctgctgtcacccttatgttttattctctgtacataacatggctttgttttctggctgtttttagggttttcctatcactggtttctctctctctctcttcctctctctggagtctcactctgtcacccagggtggagtgcagtggcaccaccttggctcactgtaacctccacctcctgagctcaagtgatcctcccacctcagcctcccaagtggctgggactacaggcacacactaccacgcatggctaatctgtcactggttttgatcaatttggttattatatgccttggtgtgtttttcttcatgtttcttgcacttgtggttctttgagttccttgggtctatgggtttattgttttcataaagtttggggaaaattttggcaattatttcttcagtattttttccttcttcctctgtctctcttatttagtgattccaatcgcatgtatattaggttgcttgaagttgtcctacagttcgttcatgctctgttctatttctgtttctgtgtttcgtttttgatagttgctattgctatgtcttcaagttcactaatcttttcttctgccatatctaatctgttgttaatctcatccagtaaagttttatatcagccattgtggttttcattttttttttttttttgagatggagtctcgctctgtggcccaggctagagtgtagtggtgtgatcaagggtcactgcaacctccacctcccgggttcaagtgattctcctgcctcagcctcccaagcagctggaactacaggcatgtgccaccataccagctaattttttttttttttttttttagtagagacagggtttcaccatgttggccaggctgatcttgaacttctgacctcaagtgatctgcttgcctcagcttcccaaagtgctgggattacaggtgtgagccactgcatctggccggttttcatatctaaaagtttaacttggatctcttatttttccatgtgtctacataacatgtttaattgttagcttcatagaaatatattctaggcaataacattataacttttaatacctttgttgtttatgctatttgtgtcagtttagagtaggttttggtggattaccttttctctttattgtggatatattttcctccttctatgaaaacatgataattttttgttcaatgccagacattttgaattttactttgttgggtgcagatatttttgtattcctataaatactcaggttttgttctgggatacagttgacttaattgggaatagttcctgttaggtcttgtttttaagatttgttaggttgtaccaaagcagtgtttagggctaattatgcgccactcctaaaggaagactattctcaatactctacccaatgccccaagaattgtggcatttttcactcttggttggtagaaatgggcactattccttgccctcggtgagctctggctactgtttcctttaatgctttttgttcattctgattccctggccttgggctttgggtagtttcatcacatgcatacattgatcagtgtggtactgaattctttttgttgttgttgttgttttggagatagagtctcactgtgttgcctaggctggtctcaaactcttgggctcaagggatcctcctgctttggtctcccaaagtgctgggattacaggcatgagccaccatgcctggcctgtacttaattcttgaggggcaccctccacagatctctggagttctctttgtgacgttctctctactccaatgctcttgccagataactccagctgccttggtcttcctagaatttcagccccatttcttcatctcagacagtcccatcaggcttggttccccctaccggtaccagggcaggttggaaggagcaaatctcaaagctgtatttcagaatgatggagacgacctgagctagtccttgctgaatatgttaagcagtgagtggtgaatagggcgttttaatgtgctgcttctggccttgctaccaacccacagatcaatgaggaagttcctcttcatgactgaatgtcctcaccagtaaaatgagtgggtcttgatactgattaactgctagacgtcttctatcaatcgccagaaatggtttctctggaaaggctctagggtaagcaagtgacagcatggcacagtactagaagatttgcccccttggttcaaattgatttttttgtagagcggagggagcagggagctaggcctctattctcatgattcggtgatgactcaccaagctgtgggtaaaggagaactgattgataggtagtctaggactctgcttctcaaaacgtggtccctagactagcagcactggcatcacctgggagtttctttgaactgcagactgtcgagccccattctagatctatcatcagaatctgcactgtgacaagaaccctagctgattgttacgcgctttaattaagtttgagggagcgctgttctaagcgtgaatggtttcatatgccctctagtggctgtccagcaacttgcagggagctttaaaatgttttctcattttaggacctttgcacagaactgccgaaacattgaacatttgaacctcaatggatgcacaaaaatcactgacaggtaagtaatgaagattaattggtgaccaaatagccacggggagagagaagggagagaaacgtggttgaaaatatctttagtgcgtctgctctttttcagcacgtgttatagccttagcagattctgttccaagctgaaacatctggatctgacctcctgtgtgtctattacaaacagctccttgaaggggatcaggtaagagtgcccattgtttgtgtcaagagaaatacccaaagctatgaacattctggaaaccttcttaatggtcacgttggatccagcaagaaataggtgactccaagaggtcccaggcatggtctccccttcggaatttcttgtgatgtactaaactcagagttggtcattaactctctacaggagagactgcacataagtttttgtttcttgttctctcagtgagggctgccgaaacctggagtacctgaacctctcttggtgtgatcagatcacgaaggatggcatcgaggcactggtgcgaggttgtcgaggcctgaaagccctgctcctgaggggctgcacacaggtaccagagggttgatacagctgtttgtgttatgtgtcaggtgtgggcacatcatccagaaagctgcttttgcatttttcttggtgtcccactgttccctcacctggattccagctgtcttttgttttctctgtccactcagttagaagatgaagctctgaaacacattcagaattactgccatgagcttgtgagcctcaacttgcagtcctgctcagtaagtagcgtgcctttcctgaacactgtttgctctatcttgtctcccaaagcagtctgcctcaggcctccctgcagccccctaggcacctgagatgggctgtgttgccacaccctgatttccatcctgtgtccttatataacctaccaatttgtcacaagctggaacaacaacaacaacaaaaaggaatcatactcaatataaagccactgacatctcccctaaaaataatacagactaggtcttgattttgttgaatagagtattagggacgctattgaggaatgcagtgaattggtcactaaatagttttaagacatgaagtgtctttttttttaacttataaattaaggatgatgactcctctcacgttgtttcagtggataaaatgaaataacacatgcaaaaatgctttaaagaataaaacgcataggcaagagcaaggtggcattttcatcaggacattagcctatgaaaaactattggtccttctccactgccattgtaaatgttgataattgaagaggatgcttgctacatcctaccaggttttcaaggggaacatagattttgagaaaggtaagggaaaacccttgcattcagctttaaatgaatatattataaatctttagagtccctagtggtggggaaaaaaaccagaaactatcttatggacaaacgttgaccatatgggccaggactactcaaaaataggaccttgacttacgtgtagcatagcagtggctgatggcttgaagtataatatagatgtgcgtgtttatttctatatgaagtagtctgtttaagtgaacatattattttgaatcttcatggccaaattcatagaatttaaggtatttatcaataattttgtgatttatttaattttcctattgtctaaaacatttgatgaaatataaatatatgtgtatattgtaaatatctaaagcattaatctgcagaaatccaatcaaatattaatgtcagttaaactaggaaagcctcaaaagttctttaatcagatttttaaattatgagtttataaattttatgaaaaaatctatattttgatgactagtgagggagaaatggaattttaaacttttattctccatttatattatttaaaatttttactttattttttcctggatgcatgtatcttatctaaattgctgaaatattttaaagctgtgcagagataacacaagtacctgtctaccctctacttattttgttgaagttatttggataaaatgctagtaatcagcaaccaaaactgaacaacagcagatacttttctgctgctcccgttttggtattgctggtgtcctctgacttttctttctgtgctgcttttcctcagcgtatcacggatgaaggtgtggtgcagatatgcaggggctgtcaccggctacaggctctctgcctttcgggttgcagcaacctcacagatgcctctcttacagccctgggtttgaactgtccgcgactgcagtgagtacactgcactttttgctttgcagctcagagtttggctgagttaaccaagagggcttccttcaggagaggacaggcttgccaggtagtggtggtggaggcagtagttatgttgttgttggcttttgttgggtaaattggggtggggcgtgtataaatccagttcattggaggatgtactgggagagtataaaatgtctaccaccagtgaatccaaactttaatttcttaatgaatgtcacacagtttcccacctaatttacctcatcatgttattgctttaagcacccgagtgagcacatagtgaggagagtgatagcctcacatccaaaggacatgagcttctcctccagaactgctgccaaatggacagaatgaggggaatatcacaatcaccttcttacttagcttcttccccagtaggaaaaaaagtttttaacaaataataatttaggccaggcatggtggctcatgcctgtaatcccaacagtttgggatgctgaggtgggtgggtcacctgaggtcaggaattcgaaaccagcctggccaacatggtgacacctcgtctctactaaaaatacaaaaattagtctggttggtggcaggtgcctgtaattccagctactcggaatgctgaggcaggagaattgcttgaacccgcgaggcggaggttgcagtgagccaagattgtgccactgcactctagtctaggtgacaagagtgagaccccatctcaaaaaaaaaaacaaaaaaaacaataatttgtattctcatcctcaaggtaatagattatcattaccagctatgaatattaaaattttaacaatggtaacaatagttgacttcagaaccagcaacctttaactttatccaagaggcagaaaaaaagatactttttaaaaatctctacttcccaatgaaactgatccattcccacgctcacaccagttctgtatcttttaagaattgtatatttctgcttttaccaatttttcttactgttgtagagaaggtactatatcatttagatatttctgcttagtagaaggaatttgggtgatcaaaactggccagaaaggaggtcaaaattattgctgtaagggagtgtttaacttagaaatgttattcatgcacccatccctattaagcatgggtaattgagaattaacttatttttcattgtccacaaattttttaaatttcctttagggtacctgggaatttccataaatggagtaaatctcaagatgattttgttgagaaaagttcattttaaatgtgtttaaaaagtgaacaaggctgggcatggtggctcatgcctgtaatcccagcactttgggaggccgaggtgggtggattacctgaggtcaggagtttgagaccagcctggccaagatgatgaaatcccgtttctactaaaagtacaaaaattagctgggcatggtggcgggcacctgtagtcccagctacttgggagactgagacgggagaatcatttgaacctgggaggcggaggctgcagtgagccaagatgctccactgcactccagcctgggtgacagtatgagacgctgtttgcaaaacaaaacaaaacaaaaacaaaaccaaaaaacaaatattagaatactatttaaaaacaacatgctggtaaagcaggaagattcttggatttactttccaagtttgggatggaacttcggggctttgggcaggtcacattccctaagggctgttaacagaggcaaaagcatgtcaaagagcagaaaagactcaagtatgcatcataaaatatgtgtttccattattaactagttggtaccgttttctcccctgtacccactttctcctcagaattttggaggctgcccgatgctcccatttgactgacgcaggttttacacttttagctcgggtaaggcatagatttaaagaatacaaccaaactctaattcacctcccgaattcaaagtgacttggagtggttttgggtgtgcaaaagactaccttcagaaaagacaggcacaaagtagagtagaacccttggggtgtgtactgcagtttttccagttagccagaaatctagggaagtcctatagagggttctgtaaagagtctgagcctcacgcgtggtcaagtgggaccagcctcctcctggcaggagactccattcctcattggaccccaacttggcctctcagcagctccccctaactgggctgtactctgccctttgtcctgcaaacactgaccactgggggcccctctggacctgctgccaggaacccatgtcctcctggggctgctgatatacttggctacctccacccaacccccacagtgtggcttagtgccccatccccatgccctcccagagtctaggctatggctaaaatttacctgctgatgtctgcgagccactgggaaggttgtagacaactctctttacaagttgagagaaggaaatgcagccagaggcagccctattcccagttccaaagcactgtaactcaaaaggcagctgttcagaagtgctggtttactgggtagctttaggaagagggcatacttcttaacagaagagaacaaggacactgggccaatactcagagggatagggcaagccaccattgttgctgtcaccactgactcacatgtggggtgtgtcttgtggactcttccagaattgccacgaattggagaagatggatcttgaagaatgcatcctggtgagtggactcctgacagccctgcagggcagcctgctccttagtcattgctggccagtgcagcacagccagagacactgactcgctatcatcctgaccctccttgatcaacctcagtggcagggcttggaaacctgtgaaggccatggcagtggatgcgtgaacttttggccattctcagtcatcagacagaactacagaagagaagttcaggatagctctataaaataagcttgcatgtccagtgatggggtgactccaaagaggagaatcctgggaaccctccttgcccactccctctttgtcccttgccccaagcctccttggggtaccagaagagagacaaagaacagttttgcatctctagaagtgggcagattttagagtgctggtgaagagaggagctcccagccccagagtgtttgagatgagtttttaattcttttacaccttttgattctcgtgttcaggagaagccaggattaggtattaagttctggtgtagaagccacactgacacagcatgtttctctccagataaccgacagcacactcatccagctctccattcactgtcctaaactgcaagccctggtgagtctgagtttttctgacattattcacctgttaaagatgaaagagccctcccaccacaacaagaagctgtttgggttctctttctgtaaggtatcatctctcttgatttcaaaaatctattaattgggctaacttgggaggcaaggtatctaaatatttgattactgctttcattgaatttgcaattttaagattcccaaaagagaaatgtccagatccagatggttttgttggggaactctaccaaacatttaaggaatgaacatcttttttttttttttgaaacagggtctcactctatcgcctagggtggaaagcagtggcacaatctgagctcgctacaacctccacctcccaggttcaagcaattctcctcctcagccttgcggggggattacaaacatgcgccaccatgcctggctaatttttgtatttttagtagagacggggtttcaccatgttggccaggctggtctcgaactcctgacctcaggtgatctgcctgcctcagcctcccaaagtgctgggattacaggtgtgagctaccgcacctgacctgaattagcatcaattctatacactctgttttaggaaataagacagtaaaacattttacaactctttttttgagacagagtcttgctctgtcacccaggctggactgcagtggcgcgacctcagctcactgcaacctctgcctccttggttcaagctattctcctgcctcatcctcccgagtagctgggattacaggcgtgcaccaccacgcccagcaaatttttgtatttttagtagagacggggtttcaccatgttggcctggctggtctcgaactcctgacctcaagtgatccacctgcctcggcctcccaaaacaactttttttttttaatgaggccagtaataccctgttatcaaaaccaaacaaaaattgtaccaaaaaaaaaacaaaaacaaaaaaaaacactacagaccgatattcctcataaacatagaagcaagtatctgtaacaaaatattagcaaatagaatgtagcaatatatagaaataattataataccatggccaagcagggtttactccagagacacaagtgtagtttaatatttgaaaactgactgatgtaatcaaccatattaactaaagaagaaaaattacatgatcacatcaactaatgcagaaaaagaatttgacaaaattcaagagggctgggcacggtggctcacacctctaatcccagcactttgggaggctgaggtgggcagatcacaaggtcaggacattgagaccatcctggccaagatggtgaaaccccatctctactaccaaaattagctgggcgtggtggcacacgcctgtagtcccagctactctggaggctgagacaggggaactgcttgaacctgggaggcggaggttgcagtgagccaaggtcacaccactgcactccagtctggcgacagagtgagactctgtctcaaaaaaaaaaaaaaaaaattcaaaagaaaaagttactttaaaaagtaccaggccggctgcggtggctcatgcctgtaatccccagcactttgggaggccgaggcaggcagattgcctgaggttgggagttcgagaccagcctaaccaacatggagaaaccctgtctctactaaaaatacaaaaaattagccaggcatggtggcacatgcctataatcccagctactagggaggctgaggcaggagaattgcttgaaactgggagggggagattgctgtgagctgagatctcgccattgcactccagcctgggcaacaagagcaaaactccataaaaaaaaaaaaaaaaaaagtaccaggaatatgagaaaaatccccagttgccatgttccctacacagggataactatcactgtggccagtttctgtcctttttgagaaattctttgtgcaatgaaaagtgattgtctttctctgtccctctcctccctgtctctttcatgcacacacatccacaccacatccatgggagcagaagacacctgctgatggcaattaaaagtaaccacctctgagtcaggaatgtgatataagctgctcgcttccagaatgcatcactcctgccagggatgagtgacagtgcatgacaggagaaaaggctttaaggccaacctgagctgggtataattggcaagtctcaacttctttgagccacaatgctgtcatctgtaaaaagggaataatgacacttactctgcagaattggcccgaaccagacagctttgactattgactacgttgttagtgttaatatagaaggccccactgctgtgtgaaccatgttggcagcggattttcctgttaactcagaacaggtcaagcaccctctgattttccttaaatcagtttttaaaaatttctatgaatacttgaatatgccagtacataagtttttcaattaatataacagtatctcctcagtctcatatgttactgttaacttcttgatttctgaatttccctatattaaaacaatggagaaattgacattcatacaccatctccatcatctttctccaatctgtgtttgtaaatatacacgtatatacgtgtgaatccatatgtaaataaaatgaaattggctgggcacggtggctcacgcctgtaatctcaacactttgggaggccaaggcgggtggatcacctgaggtcgggagttcgagaccagcctgaccaacatggagaaaccccgcctctactaaaaatacaaaattagccaggcgtggtggcgcatgcatgactgaggcaggagaaccgcttgaacctgggaggtggaggttgcgttgagccgagattgcgccattgcactccagcctgggcaacaagagtgaaactccatctcaaaaaaaaataaataaaaatttaaaaaaaaaagaaaatgaaatatatacatacacagagagacactttttttctcattccattttattgtaagtaatcaaacttctatttttttatttaccaattttaaacagcctcctaaagaaccagttttctggctttactcttaattctaaaagctaaaaaccaatgaacagcattgattacataaatactatttgatgtaaaccatgtagagtgattcgattcatgagaaaggaaatatattccacattgttaagatcaagctcagagaagaatctttaaagcatcaaggtccaacagaattcctctcctctagcttcccttccctcgaggtggtactctgctgcctagttacatagccagtagttctagtttctagcagtagtttctagtttggggctgttacaaccagtactgcaatgtcttagatttttttattctgcaggaataccttacacccatccactcaggtctcctctgccaggacttgtcaagtccaaactctcagacatttccttgcttcatagactgcagtagccattcacttgctctaaactgtatccactttcgcactaaaaaatttggcagagtggtttttcaaattttaactttactgaagtaaaatatacatgtagaaaagcacatttatcattggtgtatagatcaatgcatttccataaactgaatacaccccgatcaaaggtcaacattatcatgaccccggaaaggccctttctgctccctttcaatcactgatcccccaaaagtcgtgacttccaaatagtatatattagttttgcctctttgtattttatttaaatgatatgaatggaattatcatgtatactcatctggtttccttatccatattgttacatgtagttgtatattgttcattctcactgctttatagaatgggtacactgtgatttatttatcctttctctacttttgaatatttgagtactgcttctagtttggggccattacagccagtattcctgttttttggttaacacatgtatgcatttcagtcagaaacatcgaaataacccctgcagcatatgagacttccaattgctccacatcctcaccaacacttattttccatcttttttgaaaaacaattgtaacatcacattctccttacaactcctcccactgaccttggaatcagaactaaatttctttacataacctacacaactctgtgatctggcccttacctccccaattccatctgcatctacatgcgtcctcttatttcccacctattatatgttgaccttcttcctaaacagtacttgccgttctcctgctacccctgggccttgcacacaacaaactctttgctctctttcctaggattagctcctaatccttcaaatatcaactcagtggtctgttccccaggacaaatcctgctatcatatgctctcaaagcacctcagcttcagtttaaaagattagcattatttgattttatagactctccagtctgggctctgccagtgcagagaagtatacttttactcatcattgcacacgtgggggctgggacagagttagaactcatttatttgaaggaacaaatgaacaaatgggaattgatacagtacttttgcctctctagtttttatggtggggtgaatcttacatttgatatgcactgggggaaactgtcaggtctgaaactgtttttgatatagagaacttaagagaattacataaatgtcatttggctatataatattcatctgaatttatcttttgcaaccattactgtttacccaagagaagtcagtaatgtcagatcacactgttcaaggtctatttgattataaccttcaaagatgctcagtatatctctgggtctcagctatttgtgcaattttctaaatgaacaaggacattagatgcattgatttcactggcatcccctcaaatggagaactggccaataaaactgctctcaagggggtaaactgaaatctcccctgaagattttatttccatctttacacaattagaagagagaagccactcccagtgtagcaaacccataaccaaagggccccaaggctttgtgtttggtcctcactgcctgattaaatgtctcagtctgttttgtgctgctactacagactggataatttgtaatgaacagaaacttctcatagttctgaaggctgggaagtccaggggctggcatctgctgagggcattcttgctgtgtcatcccattgcagaagggcaaaaaggctagcttccagcttttttttaggacttgagccttggaataagggtcctgcaaacatttactcatgtcttcctgttccagagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggtaggtatggggcaggggagtcagtcacacctgacatttctaagcaccaaaggaaaacatcaagaatcagaccggggctaggcacgcggtggctcacgcctgtaatcccaacactttcagaagccaaggtgggtggaccacttgaggtcaggagttcaagaccagtctggtcaaaatggtgaaaccccatttctactaaaaatacaaaaattagccaggtgtggtggtgggcacctgtaatcccagctactcgggaggctgaggcaggagaatcacccgaacctgggaagcagaagttgcagtgagcccagactgcaccactgcacttcagcctgcaccacagagtgagactccatctcaaaataaatcgatcaatcaacactcatttcctgttatgcaatagttatgcaaactgatctggtacaatagtgtcaccttaaacttcttcaaaatgttcttgcttagactccaccctggaagattcaacttgagttgggtctgggctggagattccacatagtctggtgatcgtagcccttataagaaagcctatgttgggatgggcgcggtggctcacgactctaatcccagcactttgggaggccgaggcgggcggatcacaaggtcaagggttcgagaccagctgaccaacatggtgaaaccgtctctactaataatataaaaattagctggctgcgtgcctgtaatcccagctaattgggaggctgaggcaggagaatcgcttgaacccgggaggtggaggttgcagtgagctgagattgcgccattgcactccagcctgggcgacaagagtgaaactctgtctcaaaaaaagaaaaaaggcctatggtaaaggcaagcaatttaaggtcattatgagtgggaggtagaactctcttggctaatttccaggtaagagagcttaacagaatttggctttttccatatagttcacctacactgttttcttgattatgctttaagtttaggcaactgcatttaacagccccatccagggtgctacagctgtagagaacattcacttagtttgtaaacagggctggttactacccctgggtggaaacgtatcaacgtaagtgttttcacttatccttagaaggtactaatggggggcagacggtgcggggagtaacaggagtagctctaatctatagcataaattctacttcaactaaggtgaagatttttaatagaggactataggtttttctagaattatgactataatcctaaaaatagtaatgtgtaaagactccacttttttcttcatccttccaggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattcttgctccatgctgtccatatttatgatctttattaagaacctgtcaatcagtcatcaccaccttcattgtaaacttaggtgttcatggtggctggcccttccaaacaaccactcccgcaaactgaagggccagagctcatgagaaacttaaaagtgaaacggcaaaagcaagatgtgttcccatgactaccaatacctttattaggcagttttagaagtgtttttaaggatatattatgtcagctgcattctaggaagagaagcagattatatatatatataatctccccataaacggacttagcacaattatcatcagagtaagcattaaagtcattttattgccttatgatatattccagtattccttggtctaaaaattgtgtggataccatagcagttagttaaatatacatttatacccactgtttgttgtggaagagatgatgggggaggaggactgatgcaggaagcaacttcaataaatgagcatataacagacttgcttcagtgattatgaattagtttagtttctattaaaaaaaattaacttaaggctggccacggtggttcatgcctataatcccagcacttggggaggccaaggcgggtggatcacctgaggtcaggagtttgagaccagcctggccaacacagtaaaaccccatctctactgaaaatacagaaattagccgggcgtggtgctgggcacctgtaatctcagctactcgggaggctgaagcaggagaaatgctggaacccaggaggcggaggtggcagtgagccgagattgtgccattgcactccatccagcccaggagacaacagtgagactccatcatcatctcaaaacaaaacaacaaacaaacaaacaaacaaaaaaaaccaccagagccttctatacatgattgatttcttttgagccaggatacaacctatcatcagtcacagctattggacttgatgctcaatgatccatggcctcatttacaaaacaggagaacctcttgtaagaaaatcaggtttgcaggctgggcacggtggctcacgcctgtaatcccagcactttgggaggcagaggcgggcggatcgtgagatcaggagatcaagaccatcctggctaacacagtgaaaccccgtctctactaaaaatacaaaaaaaattagccgggcatagtggcgggtgcctgtagtcccagctactcaggagactgaggcagaagaatggcgtgaacccgggaggcagagcttgcagtgagccgagattgcgccactgcactccagcctgggtgacagagccagactccgtctcaaaaaaaaaaaaaaaaaagaaaatcaggtttgcttccttttaaagtctggaatagttttagttagttagttagttagttagttagttagttaatggaataacaacatatcctcagttgcatcagctttcagaaaataaactgaaaaggaaaaaactatgagcctaacctcttactacatttagactggctcagaatacacacagggaaactccttgattctatgacacgaagtgacagtagcaggaactgggattttaaatgagacacacatttgcaaaacaatcagaaaacatttattatactgaaatgtgtacatcctactattaaaaaaacaaagtaacaaatttgctggtgccaaaatttatttagcctgtttcactgggacaaactcacgttcaatgccactcagtataatttcaagtctgataagcatctaagtatttttaccccgcttctaaaacctgatgaggaattcaaaataagcacacagcattaaatgacatttattgttccataaatcttgagacccaaaaaggaatgctaaatagacaagcaaaacttttaaaacaaacgagataaactcacttctttccccagtgactggtacagaaaacatgtggtcacacgaaagcaaagggaaaaagtcagaaaggaaaactctctgcctataggatctataggagttacagatattttcaaatcgatgatgaaaatagatcgtgcttctttgtagcaaataattaaccccctttatgaataaaacataaaatgtcaaagcttttactcactgaagtagtttgtcttctgggagagatttcaaactcaaaattactcatttcctattttttgcctgaacacaatgaggatcaaatagtacattcaaatcaggacacctgggtatatggacaaagatatcctacaattaaaatggaatagaagttaaaaaaaaaattcagtcccctacaccacaggcctcaaacatgcttgctgatggattctgggaaggttttggatgaaggacggagatatgggaggaaagtgagaaaacagtggattccctttgaaaagtatgctagcagacaagcatttggttttatgaaagaggcactcttatagagaaagaagctagtatgtggtgtataaaaagcccctaaatcatcaccagaatgtctatccatgattgtactaaagctcaatatttgagaggcttaagggatttgtatggtacattttagtgtttgattgataacatctagtgtttccagaaaaaaattcatcttgttcataatgaagatcccttaacacctagtcagaagctatcaacaataatactttctccccctacttgggtcacctatttccaatgtctggggtagggctttaaaaatgtttaataggatggtgggggtggggggttagggtgggggtggtcagagatggagggagagagggaagaaaatgagagaaaaaccacgagtttaaaaggcaaggaatctccaaaaatgaaaaccagaaactaaaatgctaaaaatggaagcagaagcaaaaaagtttttcaataaatctgtgacaaagccaaaacacaaaagtctttgtacctattaggatttacactgatcctctcaccaaggtactcctgataatgcagtttgcttcaagcccatcttcctggcttggatcttctccaatctggcatgatcatatcaaacgtacaccctcagacatgatttcttccaagaaggtgccgagcctcttacctgaccaccaacggccacatcagcacaacacaactctccgcatacagattcactgctggccccacaacagcactgtcccccatctcctctccaggtcagcataaggttcaggcaataaaagccaaactggcacagaaaggtaaatgcccacagtaagtttctacattcatttccaaaccgcatacagtgtaaaaagacagcaaaggctgcttctaggaactgtatttactggcctctgccagagcagcaggcagctatgcctgcaccgtggcctccagagctggatgcatgctgtgccgatgtgctcactctcatgaggatgcttggctatggcagtgacagtgaggagattcacctctcatacagctcattagaaaggtcatcttgtgttttcaatatgaaacatttcatatggtaaaatccaatcccaagacttcttggattcagtcttcacacacttttaagcgtgactatttggtactgaatacagttcagtctatataagacatcacttcaaaattatgtggatgccatcactactttcagctgcagaaaaaggaaagacagtatttcttcagtcaggcttaggaaattaagcctattaaatggaaaactccctgccaactacaacctcccttcccaattcagaggttacctttaaatgattctagagaaacaagcagattaacttgctctagctcctcttcccccaaaaaacttcatgtacacattccctttttagacattctgcgaagcctggcccactatcaacgcccgcattccaacactgtctgccagttctgggggtagggggacatctatcaagacacacaataatagtgctgtccataaggggagcaagagctagaaggagaacaggtgaaatatactgtgtcagggcagaggacctgagggagtaaatgcaaatgtgtacatctaccttttccagaaaaatttctgagctactcacagagatttcaaacattttaaaaatgtatcattccttttgcctagtgtttctcagtaaatagtgagaagcaatataggcattcataaaaaaatgatttttctcatgacgacaaagtttaaaaaaaaaaacaaaacagtaaattgagattagaggggagatcctatgatttctaataccaaaaaatgtctgctggtttcacaaaacaaaactatgcaattatagtatatgtcttctttttcagacaatgtcagttatgcaaggtaaaaactgtactgctgtgaaaacaaaagactgagcagaagggtactaggctaaagatgtttctgaaagagtgaaccagttcagagttaaaactcagccttgcaggtaacctgatggcatacgcaacatgtgaggcgcaaaataaaatcagtatttcagtagtctggggacacctgacacacatgacatctccctcttctaggggcagcttttgtgctaagaccggatttggatcttagctcacctgacttttaaaacagtctatgaatgtatgatctcttctcaaataattttacatttaggaatccctcctctttaatgttggagccacctaagcctggtcctggctcttttcatattctctccctaaatgaccttaacaacttctacagctttgagtcactgttgatatgctgaaggtttccaaatttacatctcaagcccaggcctcttctctgagccccagactggtaatagtcaactgcctacttgacatttctacatatccaaaatcaaactcttggttgatttaccccaaccatacttacctcttcaatgagatcaccatctgcccagttactttccacagaaaataaggtgtcagaactattcctccctcaaaagtggagcccactgggaccctgtctataaacgtgtaagataccatcacctttcacctggatatctcctgcctcgttttgccaccttctcatctgtctccacagagttgtgaaagtgaaagaaaaatctagtcacattactgctcctttgtttaaacaacttcagtgacaacccaatgcatttcaagtaaatccgaactaccatcatcatccggtccccgcatgccagacccggcctcctgctttgatttgccctgatccgctcaccctcacacactgcatggcacctacatggcccactgccaggctttccaagaagccaggtgttttctttgcacacagccccacgttgcctggggatgctaatccaatggccagctcccgcttcttctcattcttcaagtctcaggattaataacacctcctcagagaagccttgccttacagtttcatattcccctcaacccagatctcccttatccataagtacccccacactttcctgttccttcatggaacttaacatattgggaattttgtgtatctcttggccaattttggtttgctttccccaataggagtttcatggattctgttttattcaatagatccactgagcgacagaagcacggtgtctgacacaaagtgctcagtaagacgttggctgaatgaattgagatttttttttccagtcatctagaaagactgactcctcttccttatatgctaatttctgttacaaccactagaaatattctcatttatcaaactttcttcttaaaatgagtaaagcaatcattttaaagaataaacacgagaggcactaattagaggcacacaccatctctcatgattccagcattttaagacacacacacatgcaaagtaccttttactgtggagaataaaaaacaactctcatcttgaaaattctgaaccatctggaaggataaagtaaatgcgtaagtacaattaagatccaactgtcgtttcttaaaatgattttaaaacagtaaatattcttctcaaacaaacacaggactcaatggccaaaacgataattcatgaaggcagtgtgaggcagcaaagatgcacacgtgctgcactgccttgtgttcactatgcctgtccataatggtccctgagagacctggtcagtcacccatgtgacccacaggggcacattccctgccggctccagtggatgatgactcgaacaaaaattgcataaagtgctcttctattattacttgccaccaatcactaggggaaaaattatatatcttacatgtttttttaaattagtcatcaaataatagacaaaaggaaaacacatccagtgactcacctcataaaaagggccaaagcctgccactatccctagagtgccccagtgattggctgcatcctaaagggctggggggaggctaagccagttttccttggcttgtattccatattatcactaggatgcctgaaactcttggttataagttcttccaaagtgattcccaactctctgaaaatgattctcataagtattttcaaaagaggtcacagaatttttctacagttctacaattacatgtataaaagtaaataccagtctgaaaaggaaaaacaaatgatttgatttacctgatcactaacaagaatgtgaataccagtgggaccctgtctgtaaacctgattaatttggtggagagggatattaaacaccagcgcaagttttcgagcaacttctgaggcaatcatttcttccaagtagattgcatgataaactgaaattaaaaaaaaaaaaagaaaagcattttaacagtaatctttgatctgttttctgcctgatctgtaggatctgtacgaaggtcacacctttcaaagtaccaaaaaagtaaaaaaacattttaaatgggaataaactatttctttcccccatcttactaccttgaaatcttgaactaccaatctaaaacgtaagaatacattatttatatccacaaatataatttaataaacattaacagaaatccctggacaaaaagatttgaggtttgaatttttcttcatatttttattcaatgaatatagtttcatgtattcaaaatttaaaaacaggaattggctgcaaatggacatgggggatcttcttgaaataatggaactcaaactgaattttgacaatggctgccaaactctctaaattggctaaaataccattatatacttacaatgggaggactttatggtatgtaaattatgcctgaagaaagctgtttttaaaaataatatatacttcatgtatttctagcaatatacaaaaagaaccctaaaagagtcatagttctttttgtttatttttttaagacagtgtccttttttgttgcccaggctggagtgcagtgacacaatcacagctcactgtagcctctgcctcccaggctcaagcaatcctcccacctcagcctcctaagtagctgggactatggtgggggcacacgccaccatgcctggctaatttttattattattattattattattattattattatttgtagagacagggtttcaccatgttgcccaagctgtctcaaactcctgggctcacgcagtctgcccagttaggcctcccaaagtgctgggattacaggcgtgagccagcacgcccagttaagcattatagtttttgatccagtaatcctactactaggaatttatcctaaggaataaaagctatctgtatatgcccctcccccacaaaaaattttaaataaaagatactatatgaaaagctaatataaacaatgaagtgtgatgcttccttacagaaagccccagccacattccagtgttctgcatttttgctacacagaacttatcagcagacatctgcacagtgcacatctgtagtgagtctcactcttgtacgtcctgctcaattactgattaaagccagacatggatcaggaatatcattactgagaactttgcttccccaaacaaggggtctgtgagtatagaaacccagaattttccattacataaaagaagctggaactaaaattacagtaagaatatagaaatgatctagagcaggtgtcaccaaaccacagcccatatgggccaattcctgccctccacttgttttttttttttttttttttaaataaagttttactggaacagccttatctacaatttacatattgtctatggctattttagcactacaatcacagagttgaatgtgagagaccctatgtatgatctaaagagatggaaatatttactacctgaccttttacagaaaaagtttgctgattatgggaaaatatccaatatttccccatatccctccacaaacactcatgtttgagaatacaccttccaaaatattataatcttggccatatctaagtgatgtataagctcttgatgatacatggagatctcctttaaatttttatcctttaagaatttgtatacttaatctcaaaattcagagcttttgaagtcaaaataataccaaatagaaaagttcacagtagtgatgctatccttccaatttttcagtaaaattcaaaccacaagacatttttcagagctctacctattcttagggcaaataactgcatctctgaatgccattaacacatctttttttttttaaagttctgagcatgttgcctttgttctacttcagagtatggaaagaaggaaatgttaccatatatccatacaataaatgagaaaatatatgccttttaaaatgcttgctttttttaagggccatatttagaggtgagaagagggagaagccaagattatctctgtcctaatccagcactataccgtacaattaaatgctcaggatgagaagccctcccaagataacgtactgggtagtattatttacagtgacataaaaacacggcaccagacgcgccacacaaggtgcacaatgctggccgaacacttgtcagtgacaagtccacacacttaggactattacatgcaggcactgttgcacatatgttatgctttaagagttctccccatacctagtcaggaaaattgaaaaaaaaaaaaaaaaaaaaaagaaaaaggaaagaaaaaccctcctgcttttttgttaagctgccagtgttatattcatcatttcagtaaatctgaccaaaaaaaaaaaaaagccagaactcaatgcattcaagctagtttttccacttgttagatatttccggcatgaagggccacatgaaaaacagacccatagtgtggctgcaatgactgagaaagaatgccagtttcctcttctcccaaggacttcaccctagagctgccacctctcattgctgtcaaggctcccacatgagcaacttggcattcctaacacagcaagagttctccaaagcctgctcaatcgagtcctttccgtttctgtctgacagtctcagaagtgacagaattgagatgccctcaatacctaccatagggtgccccactgccattctcgcttgcactgcttgcagcttgctgctgcccttgcagcactgtgctgcttggctgctcccggcagacatagatggttaaacggggtctaaccgacctgcaatcagaagatgccactgatgagcctgggagagaaagctgccttacacatgtacaaatatgacaactacaggaatctaagttctatttccttatgagaactttataatgttatttcgttatacaaagtaatttactaataaaaatataaaaaccacacacctcacaccaactatcacaggtggtctaatatgatgatccagactctaaaccattgagatggtctgtcagatgctggtaaatttaagtttcaagattaagtcagcaaattaaaaatcagtaagattcaattttaatggaattctcacaccacaagtatagaaagagcaatgatagtaaatggttcttacaagccagcacaatttacagtttctgtcattttaattcacaattagtttacatttttaataactgtttagtaatagtcatgaccttgaaaaccatagattctgtatagctcacctaaattagaagttttgttttcttggcaacaaacccagtcgtcttcaagaaatcagtactgcccatgtgcatttctaccagtcttacagtctacctctgccctcatcagtgcctgcatcatatctgggcctgccctgaaggtgtacacaaaacagtcttcttgtgagcacaatgctgccaatgctcgatggcgcacacaggcacacacgccaacctagcgtggaaacacattctgcccaaattccccacgcgaagaaaggtacattcttatttcaagcaaaacagttcacagtattttaccttgacttcagtgaattatagagccgaattccatcggctgcaccacaaatttgaactaaatcctcctttgtcagttttaataagtcggcacctagagaagagcaaaaatatttttctcaaataaatggaaaaagaacagaactgctttacaggcatctgtcttcatgcagtccaatgtccttcaaaataatcagatatcctgaatacacacatacacatgaacaatataagaagacaaacagacacctgtccttcagagccaaggaaaatgctggcttttccatgtcctgtatcaagaaggagcttagaagtcctgaggctgatgaatcaaatcaatgagagcagggcctaaagaactcttcccgatataggatttcactcatctaccttatttagtgactgggttgtggctatgtgaagaaacatgattctaacccaccccacagaaacaaaccctgagatcacccgggccagtcaatctttaattttaaaaaaaaggaaatggaagtccagagtttgtgggacttgcctaaagtctgtaagagttggtagccgaactaggactgggcctctttattctgaaacgtgcaatgtaaagtcaaacatgttaaattttataacataaacaactctgtcacagcagctaattttaacagaagaatggcagagaatcacacattataccctaagatttcccccaagcacatcctacttacgatgtcatttacaagtgtaaatgtctctctatacaggtttcctatagcaccacctagagaagcagtgtttgacacttttaaaaattctatctgaacactcccttcgcttaccatacaagaaaaaaaaacttacatataagtataaaaaagccatacctgagtacatacacaccatgaactactattcagtatttcaagcataaatgatatggcatctaggatttgctttgaaatacaacagaaggcaggagaggaaatagtggagagcaagactgaccaaatgctggtagtttttgaaggtaggagatggctgcatgggagttcatcatattctctctactttttaatgtctgaatgtatccataatcttttgttttattctctaacacccaggatacagtttattgggggaattaagatgaactttgggatgaaggcttgacttccatatgataaatagccacttacatatgtagaagataatggagtcatctttctattttttaaaggctcaaatgcaatagcctactaaatttctagtctgtaaaacaaagatcagagaagcacatctcccatgagacatgagcattaatagagtcattttatagagtcaggtaagcaaagaggctctctttcatctctctactagggcttactacatgcacctcacagttgtgaccagagagtactgtgtatgtgtgtgcacacccttaacccatacagagaactggacagataactgcaatgtacaacccttcctgaaatgtgaatgcccccaaggatcagagcaagaagactcactgtcctcctcaccatgctactgtcagtgctgtgactcaggagatgtgcccaaagggtaccatggctagctcctcgcccactttcttggaagaagcccccaggataaggaaaaggcagaaggccacgccatgtgatcactgctcacagcgaaagggattaaaactcaccagatagaaacatggatttgcctgatgtaaaaggagtaatgtggggcctccttcagttccaaatgtcggcgctttttctatgtgctatgcttttcatctgccttccatacaacagtgcaagacaaaccccagctccccgaccctgaaattttacaatttctagtttttcacacataaaaggctttacttaatcatataaaaatgtagtccccagctagcaaatgacctccatagggaactttaaagagacaaagaagtacacggggaataactactcattgcacaaacattacaatacgtggcatagtaagaaaccatgttcttagcaaaatcaagcttttcttcaggctgagtgtgtgcacacacaagttctgtcctcttaaagggattcacaaagttgtgttttaatggccctactgcactgcaggtgaaggaatgctaactaccactttactgtgatccagcacttctcaggatgtttggccaggccatgttactaggtggtcatgttggaaaagagtcccagagccaaatatatttgggaaatgctacctctgccccacctgtcattatctattactgtccctctaaacaggtttcctatagcactacctggagaagcagtgcttgataccttttaaaattccttcttaacattcccttagcttactgtgcaagaaaaaaaacttacccataagtatataaaaactgtaattgagtacactcagactatgaaacactacttagcagtaaaaaggattaaactactgataaacacaacaacttaggtggccgttatgctagtgaaaaaaagccaatctcaaaaggctatatactatatgattgcatttatataacattctcaaaatgacaaaattatagacagaatgtaaagtggttgccaaggactagggatggtgggggaagggtgtgggtgtgactccgaaggggtagcaggagggagatccttgtagtgatggcacaatcctgtcatcttaattgtggtggtggttacaaatatctataccataacatacgttgtgccaatgtcagtttcctggttttgctattgtactataattatgtgagaaacggagtgaagagtacaccgaaatatcactgtactagctctgtaacttactgtaaaacaaaaattatttcaaaataaagttaaaatgaaaaaaatcatgtaaaactatatacacctacacacaaatgaggtcacgtaagtctggtaaaactgctgactgaaccaatgtcaactgcctggcttcaatagcatataataaaaatacaagatattcctattgggggatagatataaagaacttctctgtacatttttctttgcaacttcctatccatagttatttcaaaattttaaaaatataaagttaataaaagcacagaaacaaaaacaaaacattctcatgcacagatacacacacacatacacatacctgaaaaattagagaacagtcttgtgtaggaagagaatctgtttttgagcagccattgctgtgtttcctggatcgtagctgaaggctgaatttgctattaacaatgaaaatgaacataaataaaaggaaccattcagacttagaacatttaaacaaaacacagaaagcctcggagtctgaagtaaaaaacacccaaaaagagcatgagtctgactccagcaacccaaatgatgcaggcccttgtcagaaacttaaacatgatacacaatgggatgctattcagccataaaaaaagagaaaaatcatgccgctgctaatgaaatcaccttttgcagcaacatggacaacatgaacatttcattgtcttaagtgaaataagccaggcacagaaagacttatattctcacttatatgtgggaactaaaaaaatttgaacacatgaagggagagagtggaaaaataggtaacagagaccgggaagaatgggtgagggataagagagaggatgagaagaactggattaaagggtgcaaacaaacatacaataaaacagaaggagtaaattcagtatttcgtagcagagtaggatgactatacctaaaaaaatgtactctactcaggtgatggacacccaaaatatcctgactcgattaccacacattaccatacatgtaacaaaacttctcacctactccatacatttgcacaaaaaccaaaactttaaaatgtagaaccctgaaagcatcagatagttttaggagaaagatacttacttcaccagaggtctgtgaagctccatctccctgatgatttggggaagaagaattgctggggagaaaggagaaagaaggaaatgatgatttttataatacatatatgttttaatcaaggcattaaaagctgttgcattgtaactatgcaaatttcaagtaaggcaacagtgggagacagctatgaaagtctgcaacaaaatgcaagcgcaacagcttagggtgtggacatgatgacgaaattaagacacagaagactgtgtcttaatttgtgccttcttcatctgtactagtaagaaattcaagttttgtgaaacaaaagggcttccccaattatcttcagggatgccaaggaaaatgaaggatacacattaatttttaaaagttaggggaaaaaatatgaaacatcaaattagataaatagttgaaaataattgcaaaaaaaatgagctacaagaaatagtacaatgaccctaagcaaaaatataaaatgatactcctttaagtaatacatatatccaagactgatgagggtgaatttcaagagaacaaaagaaattaacttgtaccactatccttgagcttctaagtaaaatgaaatgaaaaacagctccacagggaatagggctaccttctggctcttgagcaccgactcctttcttagcccccgtgcctcaattgcttaggtttattatcttgattatttatatcctttctacccataagaacttaagctccttcagacgggggtctgtctgtttgggcactaatgtatcagaacacttagaacagtgctgggaacacaataagttctccagtctactagtgagtacataaacttacagctcacctttaaagccataagcattttctaagattattcagaccggactgactgactaggaaactattctaagccctcagacatggtaacctactggtcctctggtcactcctctaagtttctgagtccaaggctatttttctactcttaaagcataatagcctacatgacaacaagctgccttctcagtttatccatctcagggggagagcacatttttgcttgctttctcatcagaccttgtcagcatgaccggagaacctttttctttgtgatcttagctttcataattttcctccccaacaagaaacttcctaaaaatagggaacttctgatgctaactactctgcattagttctgcagcaaagccctagaatggaaagccgccatggggtactgctgtaccttcaagatgccccaaatgcagtctcttgctcccaccctgagcttactctagactcttgccagtcaaggctggataacagaataaagagtccaccatttccatttctaaaaccacagcaagtctgtagaaaccgaaaggtcttcctttaaagatttaattaaaaaaatagcatatctattgggagagaaaagaaatactgcagaaaataacccatttgatataagcattacagacaagtgaatgaacttagtaataaactcactttgtccctctctctctacctatagacactgttaatgttgtctttaatcttacaaagaatatatcttggctatgtcttgaaaatggcgccttgtctacaattaccatagttgtgactatgttaaggcacaaggggctcggagtaaaaaaggctggtaggtgaagaaaagacaatgattgtcctctgccaccaagatacaggatacttccccttactgtttcctttaggtacaatacaaacaaaaggctgctgtacatggagagatggggaaatgaaggcacatgagcattagttagctgcaggcacacgatcacacaaacgagatacctgtctgggacactgcaagtgctctgctgtggggaggtgaaagtgggcgctggggaagggctgttattcacataggctgtgggggcatcgggccacggagaacactaaggacagaaacagaaataaattagtgatatgcttttaaaatatgtggaagaaatatttttgtaattcactcactaaccaaatgcaagattataaaatgcgagacagctgacatttatcaagcaacctcacagacacatgtcaaatttacttctgtgtggcaaagaaaagttttacctgctgtgtgcgtctagacactgattaatcttagagaagacctaaagtgatgacagcagcaaaaatttataaaggcatttaaaatatatgcttaagtataattgctttgaagagctttctcctccctctttaccagtatcctctttatcagtttcccaacaggcacctatcaagatttaagaatggcgaagacaagaaaggatttataagcaacatctgacatcacatggtgacctgaaacatggctctgacctagctagtgctccttttgccctcttccctaatgagcagcctcaccagtacccatttgcttctctgatacctctaaaggttaataatcctcaagacagaccagacaggcccagcatcaaaatacatcaactgtgtacagtactacatctatctctatctatctatctatctgtctgtctggtctgtctatctaatctatctgtctgtctgtctgtctgtctgtctgtctatctatctatctatctatctatctttccttctttctttcttttatattttctggaagggttatggtgaactttaatatttttcagctccaggcaaaattctgaccagaaacagaacaaagacacggagatacactattacaattaggaggttgaaaaagtcagtcaaaagcatgctaagcatgccagagtaatctcaaatacaagtcttcagacttgagatacagacatcacatggtgtgatttcactttacaggtattctttctaaaaaccaatggatctgaggactcagtttcaagggtcccctttcataatcatccttctctcattttacacaagaaaggcatcacatctaactatagccctggggtttaagactgtcccaggctggacacggtgactcatgcccctaatctcagtgctttgggaggccaaggcggtagcccaggatagcccaggatagcttgagcccaggagttcaagaccagcctgggcaacacagtgagaccctgtttctaccaaaaaataaaaacaataaaataaatataatgaggccgggcgcggtggctcacgcctgtaatcccagcactctgggaggctgaggtgggtggatcatgaggtcaggagattgagaccatcctggctaacatggtgacaccccgtctctactaaaaatacaaaaacttagctgggcgtagtggcgtgtgcctgtaatcccagctactcaggaggctgaggcaggagaatcgcttgaacctgggaggcgggggttgcagtgagccgagatcgtgccattgtactccagcctgggtgacagagcgagattccatctcaaaaaaaatgaaaatagataaataagtaaatataatgaagactctcccaaagccaagctaaagataataggattaaaaaaaaaaaaatagccaggtatggtggagcacacctgtagtcacagctacttgggagtctgagacaggagaattgcttgaatctgggaaggggaggctgcagtgagccatgactacaccactgcactccagcttgggtaacagagtgagacccccatcttgaaaaaaaggaaagaaaaagtacataactctaatgactaagtttttctgtaagtcaggtgattttcaattatttgctatcaaaataattcaggaggatggacctattgtcaactgacatatattgaaataatctagtagatcacataaaaatgtccctgggatttttgacagatgattcaaaaggacttccaggacctgaatgacactaccgaaagaaaaaacaaaattgctcatatgtataaaattctagaagttatattctatcctgtctcatcattcaagatgcatttccaataatatttctatttttacatgtaataaatattcatcaaaatctgtaggatttgttgttttgataaattggtactaataagttttaaatatcttgactgagttaagaggctatggtcacagcaaattttaaaaattaaatttcaatttatgtaaatttgttgtaaggcaatttttttagggtgatcatttaaaaatttcagtttcatcatttgaagcctcaggaataaaaaataaaaataaataagaaaaaaatttttaaagattttcaggcataaaactatgtcatattaggataaaatttaaggggagtgaaatacaaacatgagaccaagaaggaagaacagagtaaaatcttggatttaatgaattttttgaatgaacaatagcagtggtcaaactgccatggcatttagattccataggatgcacttcaagagtaatgtcacagttttatcttaaattgtaaacgcaaatcaccaccacgccagaacattgcctcctttgcagctatttaaatttatgatgaaaaaactttatgatgaaaactttcaga

SEQ ID NO: 17596 - DNA, 7948 bp, Human
tcctccacttccactccctccccgctcgagtcccgagttcccccctctccttccccctcccttcctccctctgcggccctggccgtcccccgccaccacctctccgcctacccgctcgctctggacttcgtgccccgggggtctcggggtctctccccgtcctccggcgcactcgcgcgctcccgacgactgccccgtgcccaccccggggcgcgcccccgccgctcccaacttctcccaactcaactttcccccgcgccgcgggcaggccagccccctgcgtgcgcgccccccggcgcaccgtgcgcggtcccgccttcgcgggtggggaggcgggagcgggggccggggcgggggcgcgcttccaggcacagcccggcaccaggggccgcccccgccgtccctctgccccaagcttctccactcggggctcgggagccccgaggatgccgtcccttggctccattacggcacctctgagtgtaaaggagcccttctcacgctagggatcccaggcagcaaaacgcaggcacaaggaaattcggggaagtcgaaacataaacgtatcggggttgagattctcttgcccccctcaataacccccgtgcctccaagaaagcccctgagggacgggtggcgagtgggtgagaagggtgacaggggctggaggctggccgcccggtaccctgagctgatctgggagagggtaacttgttagaggctctccacttccagagagggacagagattcgctgtgctggcctccttcctcttgaatggaacctccacactgaaccgaaccctaggcagagccatcacttatcattcaagacctttgtgtgtagttcttttttgcccaacgaaatcacaaagtcttccagataaggaatacactttttgcttcttttcccttgtgtatgcaaaagcattcagatagaaacgagttaattaacacgtgtttagcagcaactctggttccggtgctgaggagtgctgtttgggatccttttccctcggtccatagccctcaagaatgcaatcatgagacaattagagaggcagcgtaagggaatctataatcagctcctttaaggggtgaggcagaggctgctgcaagttgagcatcggtctgtggtcttgtctgtggagggggttaaccaacctgcctgccacaccctggctgactccagtgggccctgttccggagactggggtctgagggggacccccagggctccacccagttttcctcagcatgtcagagttcagcggctagagtcgggtgggctccgagacaacaaacggggctcagcagagagggggtctttggcgtgtgtccctccactaaaatccagcctcgaaggggcacagctgttctcccagccctgcggtcagctgttccctgtgaggtcatcatcgctcacaggcattccccagtcaattctggggtcactaggtggcttggggagaggtggaaacccgtgctgaggtcgtcaagaggccgttgggaacacaatgccaccaaccaggtcagcgctgggccgccagtgcccgggatctaggccgccaaaccccaaacccctaaccgagagcgctccgcccccatttccgctgcattctggaacgcgtagtcccggagcggcccttttcaagagggctgggagcacataaaaggaataacaacagcggggcacactgggaaccacggcgccgcggcggggcgcccggaaaacggacacgcgttgcttcctgggacttgaagtccaaggtttgcctccgcggtagaaacggagccctggagtcgagtgctgcagagagcgtgagcgcagacggctgggggttgtagtcttcttgtcctcggtctcgggcattgcggggagacctagtcgttttaggactacaagccccagaaggccctgcgcgggcagacggggcggggctggaggctcaggtgccgcctcctctgcaacgccggggccagagtcttaaaaccgagggcccgcaggggtccccgcggccgccgcgatgcagaaatacgagaaactggaaaagattggggaaggtaatggaatctcgagatgttcctgcaagagctcctctgcagatccttcggcattccttgaagccctggctcccttaccgtcagcaatgcctacaggctccgatctcagcagcggctgcagccctggccccctagctcagcactccgtgcagacaccagtcttccccgtgttagcatttcccgcagggctctcactccaaccttagcgttcccagtagacccgacctcccaaccgcgacacttcctgaaatttctcaccccagcctcagcagcacttggacaacctcaccccgacccccagcctcgtttcttgctgcagacctccaacctcaatatttctgcagcccctcagtcctctcccagacccctcctcactatttccagacccttccggagcaccgccttcattttagacatccttgccctggcaaccgcactcgcccctcctgccgagcccctggagcctcggtgggcaccttctcctccctccccacctgccacatcctcactcacaaagctcaccaacctaccttcaccctgaatcccttcccttgcatactgagacgctgccttcacctctctcaggaggcatttcctggcttagggaagagtgccgcatcctcaccctgacccctgacctccttcccctaggcacctacggaactgtgttcaaggccaaaaaccgggagactcatgagatcgtggctctgaaacgggtgaggctggatgacgatgatgaggtaggactggggagtgggatacggcctggggaggggtttgagggcctgggctgggtgggatctgactgctgcccaccggccccctcacatatgcagggtgtgccgagttccgccctccgggagatctgcctactcaaggagctgaagcacaagaacatcgtcaggtgtgcgggaggcgggtgctccttgccggtgtggccgcttgggggaggcgggggctgacactggacgtctgtcaggcggacctgcctggctgagcccttcttttgccctaggcttcatgacgtcctgcacagcgacaagaagctgactttggtttttgaattctgtgaccaggtgaaaggcggggtttggaggacagtagccttgggaaggtataggggcccagattgaggttaaactctgtcccattcccccactcatatcccttttcaggacctgaagaagtattttgacagttgcaatggtgacctcgatcctgagattgtaaaggtgaggagagtggtgttgggggacccctcaggctggggtcggagtctgcattcggtgtaagcaccccttgggctctaagtttgggccctgaacagggacactctagggtgttagagaatgagaaaaccctgtttctgtcctccaggggtctccagtcttagtgagcattttcacgtggtcatctttgacccgcacagtgtcactctgatgtcagtgatattatttacactcgagagatgagaaaatgaggttcaaggagatacactcattcattcaacacatacttactgaatgcttcactgtgtgccaggtgcttttctaggcccaagaccaaatgccttggtccaggttccaggggagccagtcctgaatgatactacagcacgatatttatgttgatgttcacggcgtgcatactcagatgcggccaggaagggaagatcagcatgggctgggatctaggccggatctaggatccacctgccaaggcccattaggctgtatggtccaggaaggtggggaccagagccagcttctttactttggtccctctaatgcctagcacagtataaagcaggtcctggatggcgaatgaatggtgtcactctgaaccaggtgctgaaaggtgggtggggtggagcgaagcacagggtgaggagaggagccgacccgttgctgggcacagttgcatgttcagggcgtctgactcccttctccctctctcctcccagtcattcctcttccagctactaaaagggctgggattctgtcatagccgcaatgtgctacacagggacctgaagccccagaacctgctaataaacagggtacttcttgggaagaaggtggggaatggagaggctggggccagggcacggggagcacagagggaagaggactgggaggatggagttggtgctgtcccaaggctttttaaaggcccttctccatgtccccttcccattcccttcagaatggggagctgaaattggctgattttggcctggctcgagcctttgggattcccgtccgctgttactcagctgaggtgagctagacgatgggatatgggattgggggagggagtccctcagctccaaccccaggacccaaaacattattttcctctcctctctgagcctcctcctcaaacctcctccccagtcctctaagtgggaggtccctttcggggggggtctcctccaggtggtcacactgtggtaccgcccaccggatgtcctctttggggccaagctgtactccacgtccatcgacatgtggtcagccggctgcatctttgcaggtgatgtgctggggtgttgcagaggcaccttctttcccatttgagttgacaaatagggtctggagggtcccctctgggggaagggagggaggccctgggactggagctggaaggtcagggggtacctcagagtgaggggtccttcacatgtcacatcttagccccctgtctatcccccagagctggccaatgctgggcggcctctttttcccggcaatgatgtcgatgaccagttgaagaggatcttccgatatccttgctttcctctgccttgagccctctgggaggggagagtccgtggagttttgagcacaatgggtgagggcagtgatggtgtggggtagggtgatggggtctgtagggcttctcctgagggcaaggggagagagcaggggtgctggacaccctgattgtcacagtgcaaatgcacactggagaaggtgtggcttggagacaggcagcgtgccctgaggggtgaagccgagagggtgtccctccaggtgagagatggatgccaggatgaaggagccaaagagaacaggacacattttgtgggagcagggcaaggactgtttcattaggactaggacagcagcatgtgggttaggtgattgtcatgggaaacgtggctggatatgcgagtgacctgcctggggctgcttctgtcaagctcaagccggagggtaaagggagggtgagaagtgggcggtgggtatgaggaatccctccccaggaggggaagaggccctcaccctgcccctgaagatgcagctgtggccctttcccaagtgatccttgactccgtggacacactgctggggacgcccaccgaggagcagtggccctctatgaccaagctgccagactataaggtgtgatggggaatgtgggggtcatggttcatcagggtcactcgtttcacattcctagcgcctccatccccctccccctacctctagtctgaccctccctgcctctccacagccctatccgatgtacccggccacaacatccctggtgaacgtcgtgcccaaactcaatgccacagggagggatctgctgcaggtaggtgaccaggggtagagggtgggtcaggacacttgcccagtgggactacaggaaggcagggctctgggcagtgacctgtcctgaacctgccacctcctttcccccatctccagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccacagtctggttgatgtggtggtcaagtggctctacagggcccatgggctggaggtgtctctggtctgttactgccggccgcaatcctgcttctggctcaaagacagcaccttgctcttctactttaagaggccatgaccctcacccctcacccctggggcagggcagcactgtcgctgcacaccccttcctcccaccctcccttcctctgcccaggagggcctgatgtggtccctcagagtgaggggagcaaggatgggctccccaccagggtggagaggaaagggctgggcctctccttgtggttctccatatctcaggtggatcctcttgtcctttccctcatcatcccccccataccaaggcctgcaggctggcacaggagagccccaaagatatggttccatcaggaacaccccctcccactccctatttgtcagtttcccaatgtttggggtccagtgaaagagagggaagttgggcctgtggctggggcctggtgtgtccttactggcaggaagaggaagggagggctccgcctacccccacccccacccccaccgtctcaagcctggggcctttagctcttgtggggaggctgaggaggcagaacttgtttgtatggagacaggctgtgtgccgcacttggtcccaaatgtgggaaaggagtcaggatgtaaggcaggacacaggtgttcttgaaagtggagtcaccccgtcttctccctgcctcttcttgctgagctctgggcagagttttcttccagttatacctttattgctgactgtgattctgcacctcacacctaacccgggcttggaggatacctgtcctcccttctctctaagatgtcagtcggctaaactcactcacactgaggtgcaaatgactgataacctcttgctaccattctcccctagagattcatgggggttcaagggcccagctccacatttcagaagccacgtccagctggatgatggctggcagaagacttccaatgcctaagttgggctgaccttggcttggctagtctctgccctgtaagagaaacagctgaggctgatgcattaggactttatttggggtgaagacggaaaagctacgtgcaggctaggcatgtccaggatgtcagggcggggctccgaggacacagacagcaggtctagagctgtgtgacaaggtagcaggtgcggtgggaggcggagagagtcttggtgacggcacagggaggggtgggaggtcttcggaacagagcagagtgctggggtgggaacgggcacacccactgtcctgagcctgcccctgccctcccttgattttagggggccattatgtgttacctggggcccaggctgaggtggggaacttgggttcgatggctgcccagcccttcctgaagctgtgtgaggacgagagggtcagaggtggggagtggtcctcctcccagggaccagtcgaggtcactgcacaccctcctgcctgtttctcctcagctggggcgggatggtggtctaggcttcaggggtgggccctagcacccttggagcaggcaagggctccagaagaggggctgttaccagattggtgctggagtgcctttgggagtgctgtcggttccagaaatatcccaggaccttgtctcggaacacctggaggcaagcaggatgggaggtggccagtgcacaccttccccctcatcctaggggccctgattcccacctcccaccccctgcagtgggggccctggcccacctcacagaggtagtctaggatctcgaggatggtgagcaggctggccccgatgaacagccccatctggcccccaatgtcacctgtggagacagggtcacccttcaacttacagccacctgcctgcccacaccccccca

SEQ ID NO: 17597 - DNA, 75674 bp, Human
  misc_feature (1)...(75674): n = A,T,C or G
ctggacctggaatttggggtgcacattaacccttgtttacagacctaaagaagtagttctctattgggggcatttttcccctgggggacatttggcaatgtctggagacatttttttggctgccataactggggaaagggggattgctagtggtatctgttgcatagaggccatcgatgcatctctcaacgtgcaaggcagtccccctccccaagaaagaatcatctagccccaaatatcaatagtgcccaagttgagaaactcctggtctagaatttttatcctatactaaaacttataccgtggagcttagcggattggggagagacaaaaatatgcatctggtcaaactccaggtcacattcctaaagattctgattttattagtgtgaggtagagcctggatatggtattttcatgaagctccccaggtgacccacataaacaaggttgagaatgactccctggaaagtctggtctgatggaggccacagaatagactgacctcccccatttccttgcgactagggggttatttaagggttgttggttccctgaagaggtagcagcagtggagaaacccacaggagatggagcgaagtccccccaagtgctagagagggtaagatggacgttcaagtctggggcttttgtgagaattgggaaatggcactccttctggataaacaaattcagaacttctaggtgagtgcccccagggctcttagcctagctatcagaccagactactgtggcagagagaaagatgcccttctagtggatgtggcccctgccaagacgcaaagctccctgaacccaaaggcatttggattttggctcccacttgccccttcctctggatgcctttgtacagtgcccaaactgcacaacctaatgcagcaactccaactaaaatttgccttagctaagatctttctgagacagcaaaggggcaacgtattgccttactgatttaacaagaactaaacaaccaaaacaacaaacaaacaaacaaaactatgagaggcttactcaaatgcctcaaagaaaccagatccgtcctgcgggcagcctagaaaccctgtcctgatgccaggatccagcgatgccaagccacagggaagaggctccagtctggtcgtggtatactttggggtggttgagaacaacccaggaaatgaggaaatctggctgcaggaacctacagctggatccccatggctgtgggtgagacagagaactttctgtgccttgtgctctcccatcagctgatcctggaaggagaacctcaagccccatcctaaaccgcagcagagcaggcacgcacccggtccagtccttgatttattcctttgcaaaagagaaacaaactaacaaaaaatctgtagtatggactttgacgtcggcagaactacacacctaagttccagtccctgctctgccagtaacgggggtgaatctgggcaagtttctaagcgtcggtgtcttattggagaaagtggacatggtaatagcgaacttggggcatggtcgtgaggatcaaaacagagaacatggccatagtatccggccgcagtgggccactctgaatcccctcggttgccccttctgtttccgtgtgactcacgcagctttctgcacagatggtatccttctagacgtctgggatgttcgaggcggttgtattgaataccgtgtgtgtattccgggtgagggggcgcgcaaattggggcaaagaaagctacttcaggatatttcgctctgctggggcttgtctccagcgctctctggccagaaaaagcgctggcacaaaaggaggaggtgggtgggtcagagccccgaaccgcgcagtgttccagggggggcggagaaaggagggcaggccccaggcaggaaggagggagggaaagaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgcgcgtcccgcccagccgcagcttcccaggtaggatcggaggcgtggctgcctcctcagctgggcaccaaagacccccggagtcgccgttgggacccttcgctcgggatagagggaggtgccgggggcgccctttgtttgcgcagaactcctctttcgcagcccgagggtggggatgatgcggatcggggctggtgtctgggcacgcgccgggaagaactgaccatcccatctccaggcgcggggcgccctcgcggcgacgggagccctagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggccgcagactagtttgctactttctccacccccagaattttgcctctcacatggttgcccactggaggctggcagcttgtcctggaaggagcctctatgccctcccactacacgtcccaggctacccccttggggccgcaggacacgagccacggtaaagcgacttttgtggaaggcacgggcggggcctcccctgaatctcttaaccccccctgctggggattccgagaaagtctgcgcctctgaggaagaattgccagctgagagtggtgacatgtggcatgcacttgattagccccagggaaagagggctactcgcgcaaggatctgctgggcagagggtgcggcttattcctggagggcgtggtctccggcatctaagggggccctggtgtttcttgggggctctcatggtgtgagcaaaattctctttggagatgcactttaaaaagctccagctaacttcctcaccctggagtcttaggttagcgaagagcttcaggggagtagggcaatgtgccatgcactcctgttgcctcggaatggagaggaaatccatggatgcgttttaatttagtgttaatgggaaagtgggtgacgtcggctatagggcgtgcaaatatttggctctgcgttcaacaccgtgggcagcttaaatctagggtatgagaaatgaacctactgagttctggtagaaggatagaggatgcccatctttctagcagtgtgcttgggagatgtagggatggctgcgggaagttctctgcacgcacctaaatgaatgaatataacaaatttgtaaattaataaacaggaacatttgtgttttgagctgactcttaagttttaagctgctttgtaggaactgattcagggtaaagtggaaaggaaattttatccttactgccaggcaactgttattcccatggtgtgttaatacctcctctcccaccccctttagcaggaatcaggttaaaatgaacctgtaggggaagaggaagtcattaagcgtcccagaagcagctttctgggagcgggcaaataaggtgagaagctagaggtagcttttccgcactgagttgggaggtgcctgtgagctgcctgggaacctcaacttttagttgagcctttctcaagctggggaccccttctccttttccatccgacctccctccgttctcctcccctgccctcccctctcctttctctcatcttccacctttatatagtacagcttgctaccagggcccagccacagaatcatgagttcgccagtttgggcattcactaccacctgtcttttgggacctatcccggctttcctggctccctctgccagcctgcaagctgctcccaacttttagccaccatgttcctgcttgccaccacctccactgactcctaacctgccctccggctctgctcagaccacagatgagctgaagctgattggagctgcttgataaacactcctcttgagcctccttttggcatggctcaatggggtctcttgggaagtgtgctccgctgaggttgtgagatccagaggaggggatttcagtccaagccagaggctttggaaggctggggaggggaaaatctctaggcccttgggtctgaaagcaaatcacataggctgagttcactctaagtgctgggtgacaaattttaaagatcatttcagagacactctcttagcaagtggacatcatatcttcagtaagagagaaagtgaaggacttgaatctggaacttctgaaagaagatggagatctagggctccatcagcaagtcgattatgtaactatctgcacgtgaatagcacatctgtcagagtgagagtaaatcattctcattcccactcctagaaggtctctggagttcttccatcttagaatttaatgcagcttttctggctctctgatctattttttgcagcctagcaaagatgcagtgtctataaaaacctacatgaagtgtatggaaaatttgtagaaaagttgtttgtgtttgactgtgtttgtatgcttataacagatgagaatttagattctgttcttaaaataattcttagagctgtatttgcatgtgagatagtggtggttcactctgcctccttctgcaaacaaggctgaagatggagaatgagtaccatggcctctaagaaaggcttcgtgaatcttacatctggagaaaactggtaaagtagcgtggttttactagtcaggaaaaccaagtgaggtttgctaaaagccaaaccagactacatcagctgaagcagtcttttgaaataccacatttggagataagtactaggaatggagcacctagctcaggttatataattaaggtgtcaccgggaacaggctaggaattcctatttagatttaaaacatgtaatcagctgacaaaagtactctgcaatgaaaaggaaatatgctggggagagcaggtcattttcctctggcattttcttcattgataacactttcagtacagtacaatgttgtttgttagttactactcatttcgcagatttgggagctgaatgagacaccagaaaccattgttaaagcagcgtcttcacatcttcccacctcatcagtcctcgtaccataaccaaagtgctgcttttctcttttagattattgctataacattctcacttttggtctctctaattctagctcattttactttctcactttagataatggtcttttaagtccattgactttagtactgttttttatcacatcactcccctactcaaaaacttagggcagcaggtccctgttctcactcaagtaaaaagttctcagttgtttttagggggctacacagtttgcttctagcctaattttccagtcttttccccctggtttcctaaaatcctatccttatagaacctgagtcacattttccttcttggcagatgctgctttctgtacctggaatccttcccccttgccatttgtccaaattctgcccatcatccagcaacacccccactttgatgagaccttttcttgatcgctccaatgggaagcaacgtgccttccttttaacacccatggtctcactcatgtctcttatatttatcacatatatcacatatttgataatgctgtatattatcataatttatgcactcttcttacttgtagattttaagacctggaggcaggggccgtgnnnnnnnnnnnnnnnnnnnncaggggccgtgctatgtcttaccccttatttgtatttccccacggtgcctagcagagcactttgtgccacatggatatttgtgcgtaatggattaacagtgcctgtaactccagtgatgggccattggacaggaaaggagctgagggaaacatgtgcacaggtacacagggctttgtgccaccatgaatctacatacatagaaacgatggcttactggatacagaggttccttttaaatatacgaacactctctgtttaagcaataaccttctctgttgggggctgtaagatgagagactgactgcaaccgcaagctggagtttgcatttattatttttgttggccaccttgatctgtgcctttcccaagtggttgaatggtttccttagtaaacgcaaatatgtgtgctacatcaattcccctttcagagaacacaactgaaattagtaattgaaagtgaagagagaatttgaacagaagaaggtttagttttgccaggctataacatagtatgaaatttgtagcaggcaagttatgattaatgcccaggttagagattcgcttccaaaatagcagcgtgaataataacctctcccaacttccaattcatagggagtttctcaaaccagcccctcagttcttgactgtgtgatgtcttaactgctaacttttatgggccatttgttttaggagggtggtcttttaagcctgaatctctgggaaatttgggtttagttctgaaatagaatcagtttctaccttttctaataaaacctgggctctgcccagagacttatttttaaagtgaacactgaatgatgaagcatttatgtgcttgggagaccacgatgaagaaggtatgcaatttcttctctcttgtagctttctgtcttgtggggaaatagagacatagttatttcaggtggtcaatgttataatacaattggattgacaggcccggggagcacagagaggagctatgtgggaacactggaattggttattgaagaatgatgctgagacttgctggtgcggagatggtggcactaaaggcccaagaaaagtgaaagtagaggatgtgtgggcttctctaagaatgttttgaaattggagacaaaaatctgtgtgagtgtcctttttctggggagacggctctatcccgattcaaaaccactagttactagagcaccttcatgaattctatgagaaaatatgcacttaatgggcagaaaaatcaacatacagagtaagatgaaattaccacagtaggtaaactttgattgaaccagtgagcaggtggcctttccagttacagccagctgtatagtttccagttattttcatttaaaaagcagtaccaagcaaaacagatgtaatcgtaaattgtaattgccttcaggcctgggctggtaacttgctgtacccccctgccccacttagtacacagtgtgacttgggggaggatctttagtcagtatttgtggattaatggattgaagtaattgtgaatcaaagtattccatttcaaatctcccctgtaggatttaaccagaatttccaagatgacactttcctgagaaaacggattgcaagatagctaaatgtcaaaggaaatttgtccatttggacaggcaacgaatcagggcatagttaattgcgaaggctcttggatgtcaaatcaccgtaagacattctaagagacttagaaactcaagggagttctgggggcaggatgtgcagataaagatttagaggaaaagcttgtgcaagagaaaagtccttggtagcactgctaagctcccaagttttccagatgataattggtagcacctggatcttacgggtgtctggcacattctgacctcagaaacctctggagtactcattcccgagctgaatgattcactcacccgtaatccttagctcacactggatgcttctttatgcattgttctccagggagaagataaatgggtttggacataatggcttggattatcccagaggtttggggttgtaaattgagcataatgattttcaaactttcttctgagtaatagatccaaacatagaatctggggacagactttctgccttggccttgaaatatcattgcaatatttcttctgtcccactcttacagtgacctgtagtgtagtcacatgtactagcagctcatttcccctgctatcactagctgtttgcaatgtacatccagtagtacttaatgagaatctcctcaatgctgattacaccccatgatctgctaatggatgacgctcgcctgccgcttattgtgtgggtggctgagctgaatgaccctgccaatcccagtgatccaagattgttcgcaaacacggttaaattagggccacagggtgagaattaagccaaggtttggcaggcccattgtggagtggtgaggaagtggtggagcggctacatcctccacctcctgagattctgcccacaaagtggcaattccttataggaactctgacagacatgttggtactgactcagtgttagtcagatcaaggctccaattcctttcaatccccaacactgaaattttgtttccacttagattttaattcagctttccaaggagtagggtcattgtgttgcaccattacctattcacggagctgatgcccccagccacgtgagtaggttgtgggatcttgttcatttttgtattctcatggtctagcagggagcctgacttctgggaggctctcagtggatctgtggagtgacatgtgctggggggcatgcctctggccagttctgagcctctgggtgggtgtcttggtctttatctagatttctgcaggagtttctctgttccacacccaggctcccttgcatgggttgcctaattcatggaaccacggaacctcagactgggaggatgcctgagatggtaacttgccctgcattttagggaggagcctctgaggcttagcaagttgaagggatttgtctggggtcacacagagagttaaatgcagagttgggagtagacctcagtctagtggctatagaattcctttcacttcataggcatgcattgaattcaatttttgagtgatccctacatgtcaggcatcctgtggggaaccagagataggcaggcaagaatgaatggcactgagcatttgatatggtttggatctgtgtccccacccaaatctcatgttgaaatgtaatcttcagtgctggaggtgggcctggctggaggtgattggatcatggggggcggatttctcatgaatggtttagcaccatcccctttggtgttatttttgcaatagtaagttaccataatacctggttgttttcaaagtgtgtagcacctccttcctctctctcgctcctgctctggccatgtaagacatgcctgcttctccttcgccttctgccttgattgcaagtttcctgaggcctcctcagaggtagaagctactatacttcctgtacaacctgcagaaccgtgatccagttaaacctcttttctttataaattacccagtctcaagtatttcttcatagcagtgcaaaaatggacgaatacagcattgttcactgagcccctgtccagggtgtatctcagggctattctttatattgacacttggctgtactctcagcatctcatatctagagctgtttggatgtttttcaagagttctgagaagttgctgcctcagtgtcagtccttgccctcttttgaggttgtcagagtcccaaatgcttcctctctataccatttgctttgagctccccaactgatttgtgattaaattcataacagttttattgagatacaattcatgtaccatacctcattcatttaaactgtacaattcaatggtcttagaatattcacagagttgtgcattcatcaccacaaccaattttagaatgttttcattgccccccaaataaactccaaaccttagccatcatttcttaatcccccatccctaggcaaccactaatctattttctgcctctatagatttgcctacaattgaccttccataaaaatggaattacacagtaatttatcattttgtgtttggcttctttcacttagtatagtgctttcaaggttcaactgtggcaggatactagccagagtcagccaatggtgcctggccacctctcaatgctggctgcagggccaccactggtgcataaagcacctttgggtgaattagaaaaagaggcccccatctggccacatgtagatctgtggacacagggcttggtcaggagacagactttgggcaagaaaaggatagaggcaggcccaagactcaaggacttgaggccttgagtccaaggattcaagacttggagagtggaggacaggcttgatttgagaccccacttgctctttttgagggtgtgacggtgggtgctgtagtgcagggaactccctgaactatatctatgtagtcctggatgtcagtagcttaactccaagtggacaagctatggaccccatattcttttagagcttgtgactctgtaaaataacaacacagaaagctgtgcttgcatgccagcagcatctgtggtgaactcttgggtcacctgggagcacgttaaaattgcagaagctcgggcccaaacccaagacctactgaatcagcatcttcattttaacaagatccttccaatgattcttctacatgatgaaatttaggaagtactggtctgatgaatgagttcagcccttggccaagacagagtggcttgcctgtttataactgccacacaatggttcacttcccctcctctcccttttcctgttggctttgccttcatcactgaatcctctgaccttcctttcctaagtccccagcattcctgagataagcatgtacagcctgtaggttaggtttttcctcccttctctaactcaaaaacaaatgcaacctcccttggcttcatctccttttaagcctttctgccaggaatacagcccctgcctggcttagccttgagcagcagcaaagcacatcttcaggctgattggtaacaggggccttgcatggctttttcctgcagctaagatgtattaatacctgatgaataactttagctgtcaagaaaaccaggctagtgtgatcagggccgctcctgccactccggcaagactcctggggctgagaattcctggaactgatcagctcttaaagacacagggacttcttatcttcataccagaaatcaatgccactggggttagcggggaggcagcaccttgggagatgagtgagagtgagaccagtgggttagtcaggaaaacacacagcccctcacattaagcccctcaagctccatgaattggggatgtcaggaagactgaactgttaacagcacttaaagagggtctctcaccttttcagggagttgggtaagtagtagtttccaacccagcaatggtattttttttctctgttcttttcctcttttttttttgaccgagtcttgctctgtcacccaggctggaatgcagtgacatgatctcggctcactgcaacctccacctccaaggttcaagagattctcctgcctcagcctcccgagtagctgggattacaggcgcgtaccaccacacctatctaatttttgtgtttttagtatagatggggtttcaccatgttggccaggctggtctcaaactcctgacctcatgatctgccctcctcggcctcccaaagtgttgggattacaggcgtgagccaccgtgtctggccagcaatggtatttgtacaggctgagtaaggatcacctggggagtctgatgaaatatggtttccctggctccgcctctgtgtattttgatttggtagatctaggttagggaccagtaatctagggtgaaggtctgcaaacaaagtccaggcaggccaaagatggctcactgccagtttttatatgattagttgagctaagaatggttttaacattttaaactgattgaaaaaaaatcaaaagaataataatgttttgtgacaaatgaaaatgatataaaattcaaattttgatgttattggaacacagccatgttcattcctttgggtatttgtctatggctacttggtgatacgatggcagttgaatagttgtgacagagtccatatggcctgcaaagctgaaatattttcctttacagaaaatgtttgccgaacccctaatccaaggccttactcaaagtgtggtttgataaccagcctcacctgggagctttatagaaatgtagaatcttgaacaccatcacagatatgaaataagcacctaccttttaacaagattcctgggtgtttggggctacttcttccccaccacgaggctcagctcaggactcatcttggaggtccaggccagcatgctataactagccttgtatacggttaatttatctgacacataactgggtgtctcattctcaaggtttgaggcttggtagcctcctgatatcttagatgctctaaaaactaggttgctgttttattcttgccaattcttggctaggatccagtgtcctaatctgaggctggaggtggactggcttttgctacctgctgacatatttcttaatgcttcctggatttctagacagcagtctccagatgtgctgccctgccaggatcttggtatgtagtatggcccatagctctccaccgtctcctacttccttccatgaagcactgcttcccagagacattcagaaatggtatatgggaagcaggatgcactgtaatttagttgcaaaaggctgggttaaataggtttctttattgcaggactgctcagggtcattgatatgccagtataccttgttactctctgagagaggacaaggaggaatagtgaggaccacagaatctcaaagtggggtctgtagaccagcagcaacagcagcagcatctcctgggaacctagtagatatatacattctcagaccacaccccagagctactgaatcacaagctgggtatgtgggaagtgggcctagccatctgtattttagcagaccctccaaatgattcttatgtacactcaagtgtgagaaccactggtgtggacgtttccaaatggttttctccgaacatctcactagcctagtgtttcacatttgttgatttcagtgaacactgtgtttttggtttcaggacaagacatttgggaacatgacattgaatttttcctgaagcatttactggtggcagtgaccactgcaggcttggggaggtggaagtggggaagaaaaaaaaccccaacctttgggtagcatcatctgtcccacatctgtctctctagcaattgtgtcttggttaaaggaagtttttttgagacgaaagccaccaacttttgggtgttgccaacatgtgttctttaaaatgtgtttttgtgtattcaaatgtaaagaaagctggggaacagcccttggggtgtttctctctcctcttcacgttacttcctttcagaatactttcttctgtaaaatttcctcatccaaattccaaactcatcttttcaggccagccaagtccaaatggctttcatttgagtgagtgacccttttctccatgggaagcctcaggacacattcagataggagggaagctatggctctcagcatgaggaggctgtgtcttccttctcaaagctcagctcactccctcccattccagaccttcttcctttgccttccatggctagtggtgtcacagccatgggtctgtgtgtgaacactttttagtgtttactctgtgaggatatgtaactgctgtgttgtcacttagtttgaaattctcagtgatagtgaggcttgagggtgagttgggaggaagcactaagttattctacttcctccatgggctggccgctgaggagaggaatgagggttgagaaagccatgcagaccttgattttcagtgaaaatagatgagacaactgacaacttccatttctatgtttttggtgggcagaaaatagatattatcgtttacttttcttggcttggtggtctgaatgctacacatatctataaaatggcccatctgatattgcagatgagctgaaagtatcctctgatgaatgtactttaacaaggctttcaaaaattgtaggctgaccactttttttccaaaattttttgcaaaaaaaaaatatatatatatataggctgagcacagtggctcacacctgtaatcccagcactttgagaggcctaggcgagagaatctcttgagcccaggagtttgagaccagcctgggcaacatcttgggaccctatctctaaaaaaaaaaaaaaaaaaaaagaaattagtcaggtgtgctggcactcacctgtagtcccggctactcaggggctgaggtgggaggatcgcttgaacccaggtggtcaaggctgcagtgagccatgatcatgcactgcactgcagactgggtgatagagtgagtccctttctttaaaataaaattataaaagtaaaacatgctcattatgaaaatattcaaatagaggcataaaaagttgaaagcaggcccacccttcattttcctcttgattccattctctttttctgaaattgccactcagtagtttgatataaacttctggacacttttctgtgcttacgattcttaaacaaaaaaggtaaaaaaggaatgtattgctacatgtaacaacagggatgaatctcatacataatgttcagtgaaataaaccagacacaaaagagtacatatggcaattccatttctacaaagttcaacaacaatgtgcaaaactagtccatggtgttacaagtcagaatagcagttgtctttatggggtagccactgggaggggccacaagggggtcttcaagggtgccagcagtattctgtatcttgatctgggttgggaggtctcatgggtatgcacatacatagaatgtattgagctgtatacacttaagatttgtgcactttactatatatgtttacctcaattataaagaaaaaaatacccacaaatgtatgtgtgggcggggcataaatggatttaagatgtctttgttaaatttccatgccattgcctatgggaactttggaaatatatggtagtgatttgggttgtcataatgatagagaaggccaggcctacacaataaagaattggctcccttagaatgcccatagcgcccacattgaaaaacactgttttaaaagtttgcagactgttctattgggcaggtgttcagaacatggggtaggcctttgaaatagtcttgcctggatctttactctgtctttgtttaaatggagttgaagcctcaagagctgatgtggatggatgggttcttgatttgtttttgccttctgaaccaaattgtaaaggagtggaatcatctcctttgccagggaacagaggcaatttgataaccctcaaatgtgaacttgatgcaagagagagctcttctccagctcagtgtatccctcccatgctcatagctctctgaggccatgtggcctccgccagtgtcttggtctggagtcttctgctgaaagtcttactgcatcctcctttcctttcttagattttctctgtgtcccatttgacctctatagaggagagttaagcatttgaaggaccacatgccacatcacaaattgcttttgttccactgtctggttttactttaaaggctagccctctttttgtctgtctgtgttgactggggacagtcaggctacagagctttgtgaatgccccttggtgagaacaggacttggcatttattgaggtcccctgctttgggctgacctcctcagatttaggtgtttgtcttttttctgtttctcctctctcccatctctgggcaatgggcagggacacactttggcccttcgtagtattaaacaatagaaggagactaaattggaaaaatattattttccccttggaccagagtaatgccttcatttataaagcttttcttttaagtttatttttgttggctctgtaaagtaggaccacaattgatatttcacaagccacatgctgttttaattgtctttgctaatgaaagacagagggcctggggattatgggtgccatggactctgcctagggtcttccttttggggtctgcatagaagagtttgaataagaggatggaatattgtctaatattgcctctgatgaaacagctgtggaagcaaggctgtctctgagagctcatgtctggcagggatcattctctcaccagccagccattctactgccatttatttctggatgaaataaagttaaaatgaacatttaagtgtagcctcaatggggaaagaagttatgtaacggtagtatttggatgccagagagggaggaagagtccccagcaggatggagccccaattgcccacaacagtgactcacagcagttgcccagtgagcagtacccttattgtctttcttctcttcgctgtctctctgctctagtccatcgctatgcttcctgggattgcttcccaaatgaactacttgtactttgtcttagagtgtgcttttgggggaactcagacaatggctaagctggaacttaacccaggattttggtttctggtccagagttctttgtactgctgaattgactcctgctgaatagaactctctaggtcactgaatgaactgtaaagaaggcttctgtgatggacacttggaggttgtttcacttatcttttgatgcataagaaaccactccaaaacttagtggtttaaataagtgacaactatgtatttactcatgatcccgcagtttgggcaggactttgggggacggctcatctctggttcacatggtgttgtctggggtgactcatctgggtctagaggatccgggatggttccactcatgtgtctgtgtctgacacttcatctgggatgactgaaatcgctgggatggctggtccctctctctgcctctctgcagtctgcatagtttagctcttttccatctccccgtgttgccttactctccagcaggaagctggcattacatgcagctggcctcccagtggacaaaagccaaagctaccaggacacttaaggcatagatccagaattgtcacagcatcacttctgttacattctattagtcaaagaaaatcacaaggcaggcccatatttgggatggtggtggtagtggatggagtctacctcttatatgcacgtgcagggtgggaggaattgtcggtggccactgtgcaggcaatccactacagagctggtttgggacggcatattggagatgggagtttaattttccaggatgtttgctgggtgccttctgattagatgctggacctcaggttgctagccaagtgtattaggctgtttagctacagaatgtggcatatgcagattcattgaaagttcatagaagtgagtaaatcagcatccctgggaatatcaaaggctcattttccaatggttattgatactatcaaaggcaaagactttattaaacaaaaatgaactcaaaatagatcatagacctaaatataaagcctataaatatgaaacttcttgatgacaacatgggagaaaatctttgtgaacttgagttaggcagagatttcttgaatatgacaccaaaagcatggtctataaaaggtataattgataaattttactttattcaaattaaaaacttctcttccaaagaccccactaagagagtaaaaagaaatatataaagaactctctaaactcaataacaagaaaaaaagccacctaatttttaaagcagacaaaatatttgaacagatacttaaaccaaagatgttcaatattattatccacctgctaactggattaaactcaggcaacttctgctttcgtctgccaactgtgaacaaagccacctgctcttttagggaagtgatttgtaatatacagtgcaaatgtaaggtatggttatacctcccacaaaacaacttgcacacatttctgctccttgtagagggctgactagccattttctctgtctctctcactggactttatgtgacagacacccgcaaattgctagccatggccgttaagtaaccactggccactggcaatttgaggcagatcatttactgtaagctcaagtggacgtgggtgtctcctaccatgcttttccaaaccaggctggtttttaggcctccctaaaaaaatctcccactgcctacttgttctgccctcaagtgtcctgatgtcctttcatttcaaggaacttgcatcatttgagcctgtaacagagggcttttagtcttctttggtactattgatatgtaagaaatgtactttgactttgatgtttttctttgaattcatttgtaagcaatggtaaagtttgaaatgtattacttcatattatcatatattattcttctcaagacctaatgttaaattcaatgctgagtgcttaataaggatactgattacatgagaagtaacagaacagttttcatctagtttctaaatttaggggaaaaaaaagcttggatgaacgccaaataatttcccacttttgtgaatcccaaaggcccctcttcatgcattgaacattcctgaaatttctggaataaaaaaaattgtgagaagaacacacagggtttttaaaaacgactttttacttgaggtgtacttgccatgtaataaactgtactgaattgctttcataccattttcaaaaattaattggaaatttttgtacagatctgtttctgggttctttattctgatccattggtttatgtgcttatttcttcactaataccaatactgtcttgattactgtagttttgtaatatgtcttaaaattgggtagtgtgattcctctaactttattcttctttccaaaattgttttggctataaatttcatataaattttaggatcagtttgtttatatctgcaaaaccttgctagtattctgatggcaattatgtcacacctactgatcagtttgggggagaattgatatccttaatatttgaatctttcaatccatgaatatggtacatctctccatttatttagatattagttgatttctttcacaaacattttttagttttcagtatacagatcccatacatgttttgttagatttataagtatttcattttatggggctactggaaatgtttttattttcttaactttcctctctaatagtttattgcaagtatatagaaatacaattgatttttgtggtttgactttgtatcttgtgatattgctaacctcaagtgttattttgtcgattctttgagattttctacatagacaatcatgtcatctgtgaatagggacaggtttttcctttcttccttcctgccttccttcctttctttctttcttctctccttttgttgcgcaggctggaatgcagtggcacaatctcggcacactgcaacctccacctcccaggttcaagtgattctcccacctcagcctcctgagtagctggaactacaggtgtgcaccaccatgcctggctaatttctgtatttttagtagagatgtggtttcaccacattggccaggctggtcttgaactcctcacctcaggtgatccactcgcctcagcctcccaaagtgctgggattacaggcgtgagctaccgggcctggccagagacaggtttatttcttcctttccaatctttgtatcttttctttctttcttgtcttattgcactggctaggattacctgtatagtgctgaatagggtagtgaaattgagtgttgtgttgttcccagtcttagggggaaagcacctcagtctttcatcgtaaagtataatgttaattgtgggctttctgtagatccccttcatcaggttgaagacattctcttctcttcctagattgctgtaatttttttttttaaatcacgaatggatgttaaatttcgttaaattccttttctgtattaattgatatgatcatctggattttcttctttagtttgttaatgtcatgggttgcattgattaattgatttttgaatattaagctaggcttccattgtcaggatacgtaccatttggtgttaccatattattctttttatgtagtgttgtgttttatttggtaatactttgttggggatttttgcatctgtgttcatgactgatattgtcctgtagttttattttgatgtgaagtccttatctggttttggcatcagagtaatgctagccttgtaaaatgagttgggacatgtgttctccacttcaattttgtggaagacattctgtagaattcttttaaaaatatttgatagaattcaccagtgaaatcactgtgcctggagatttatttttaggaagattatctattcatcttgagtgagttttgatagttcgtgctttttgaagaattggttcatttcatctaagctgtcaaagttatgtgtagagttatacacagtatctgctgtgataccctctgtttcattcctaatattggtaatttgtttcttttctttgtttttctttgtcagtcttgcttgagttttgtcaatgatatgaatattttcaaaaaacagcttttggtttgattgtttccattgtgttgtttcattaatttctacttttgcctttattatttttattatgtcctgctgcatgctttgggtttgttttgttctgtagtttcttaaagtggaagcttaaggtattgttttgaggccttttcctttttctaatataaacatctgatgctgtaaattcccctctgagaactgttttatcccactcactgtactctctctcctctcctttttgaactctattgactgaaatgttaaacatatggatattgtcccacagctccctgaaaaaaccaagattaaaaagaagattgaaaaaaaaagtttattgagcaaggggaagaccaagaaagacaaaaagtcacaaggagtcttcctaccctcttaagaccacatcttctctacagagaaaaaaatctccattcccagagttttaggtatctagagtttgctatacaattgctgtagtcgccactgctgtcactcctgcccactgtcaccacagggttatatgggggctgggtcatgaaataatggagaaaatgaacataaaagaaaaccagggaattttcttcattctctctgaagcattacagttcttcttttccactcttagagtcagagatagagggcttctcctggaactctctctgtacccagtgtctacttctgtgtttgggctgattttagtctagtcctgggataccagagcaacaccaattcagtgttaccccaaattcttttttttttttttttttgagacggagtctcgctctgtcacccaggctggagtgcagtggcgtgatctcagctcactgcaagctccgcctcctgggttcacaccattctcctgcctcagcctcccgagtagctgggactataggcacccaccaccgcacctcgctaattttttgtatttttagtagagacggggtttcaccgtggtctcgatctcctgacctcgtgatctgcccacctcggcctcccaaagtgttgggattacaggcgtgagccaccatgcccggccccaaattcttagtctgcctgctaatgtttactttttcagaatcaccaaagagctgttcagatgcactttgttcaggtttttcagctgcattcagtaggaaagacagggtgaagtacgattactgcatcttacccagaattggaatattgtgacctttttttttttaacattacattatccttttcatggtagtcaggtggttttcttcctcccttccttctttctttctccctttgtttcttcttttctttattttctactttttcttcactatgatgcctagtatattgttagacctggataaataacttttgactgttgcagatggtgaaaagtcttttgtgtgaggttttatagttattacaatttagagaaaggattggattgtttatcattggaaaacactttgttttctaaagatatatctactaggatgagagaagaaaaaatcacgatctaaaaagtggggagtaatagtcttatagagtcactgtgaaagttcagaggaatgatatatttgtaccaggaacaaatatgttacatttgttcctttaagtaaattcagtcccatccaaaaacgtatttattgacattagctcatttttgaaagcctttttaaaatgagctaatatcaataaatatgttaataatgaaaggaacctaacaatgcagaatgattaggcatcaaatgctgtatgtttactgtggtttgaatgtttgtcccctccaaaagtcatgttgagatttaattgctgtagtaacagtattaacaggggacctttaagaggtgattgggccattagggctctgccttcatgaatagattaatgccattatagcaggagtgggttgttagttatctcaagaatgggttcctgataaaagggaggagtttgcctcctctttccctttctgtctcatgtactcccttctgcccttctttcatgagatgatgccgcattaaggcctcaccagataccagtgccctgttctggggctcctcagcctccagaactgtgagctgaatagacttctcctccttattaattacctggtctgtggtattttaacaacagacaatggactaagacagtgtccttcttctgctttattagatagcttatttcaaaagtgaacaagcaatcctgcttgtagtctgagaaatggaaattgtggagttgagggagattcagtaaaagatgatctttcagatgaggctattgttaaacttttcattaaattgcttttattttggccctagtattggtatcatcaaacattaaacagtcttaaaaagtgaaatgatacccagtcatctataaaagagtgaattgtgagaaattatatggcttatttcccagtagagacaagtgatttcacattctgcagcagacccatgagccacacaagtcacatgaaaggtggccatagatcaggtgtttggctcagctttctattctatccaagctatttctaatcacagatgaaccagccacacattcttattttgagcagacatctgaaattgacttcagcttaattgcaataacactgaggattggaaaacatttgtgttaacatctacattctgttcaaaacatcaacaaaagccaaatcccccaaattaataggctcttttgaagacttctcttttgaataaacagtgttgacatgtaattcatcattaactcataaaaacacttcagtaatataaatcaggattgaagtctaaaagccattctgctttcaattagagcatccaaatctggtatacgagaccttttctcctttttttttttttccagccactctgttattttgtcaatctaatctcatctgtatcctgctcacgctctaggaatcaagtctttccctcagatgcaatgcctgcattctaattttaaaagtagttaatagaatataccaattccatgtttaaacaggaagaaactaaggctcctgagaggtgatggggctagccaaagtcacatggctagctagtagcagagctagatgaggattcttagcacctcactccattattttaccctagtcttctagaaagaccctgtgctgttcccagagtctcacctctgaaatatcacactttttttattttttttaattattattattatttttttgagatggagtctcgctctgtcgcccaggctggagtgcagtggcgcgatctcggctcactgcaagctccgcctcccgggttcacgccattctcctgcctcagcctcccgagtagctggaactacaggcgcccgccaccacgcctggctaattttttgtatttttagtagagacggggtttcaccgtgttagccaggatggtctcgatctcctgacctcgtgatccacccgcctcggcctcccaaagtgctgggattacaggcgtgagctactgcgcccagcccacactaaagttttaaattcagtcacaaatgtttttcaataccttataaatatatgaaccaaaaccaacttgtgatgacattaggttggtgcaaaagtaattgcggtttttgccaatggcaatgaaaaaaaacctcaattacttttgcaccagcctgtagacgtcaggatagtggcaggtttctgaccatgttctgtttcttgatctgagttctcttacatgggtgtgttcagtttataacagttcattgaattgtgcactttttaaaaaataaaatatttattacgagtggcttatggtattatccctgattgttgctcgggccccagaacttaatatgttagtaatgtcctttattatgcaacgagtcacctttctcatccagcttaaaaaataattttcctcttaacatttttttattttgctctccagtatacttttgcttcccagcgcctgcctaatgtttgtaccatcagtgttgtagaatcctacttcaaaagaagcatttgctacagcccagaatcatagcggtaatcatgcagtgatcttagcccccaccccagggtgcttgcttgtttgatagtcactgtgagtgttcctaataagccagggcatatctggattcatcatttatcattttctgtgctccaaggctccaacaatatgtgtgataaatagcctgtagcttattttctaaatgacagcagtgaaacctcctgtttttctttctttgaattgaatctgagacacatgaaattggtattctctgaggcttctctcttctccctccccacatttcttttacagcaggggaaaaggcagaaacctaagtttgtgattggtagtggattgaaagccgtagatccttttctcctctccagagctaaggaaatgatcttttgtgagcattcatcactctgcctttttattatttctctctcttacctttagagtcttatttcgtcctgtcctccacctttctgtacaccactccctccccaaaggttgctttttcatagcgtaaaagttgatcctgagtatgtgtgcaagacattatttggtactacaatttcacagaatcatataatcttaaccttggaaagggctgtagagccccaccctacttccctcatctcacccctcttgccagcatccttcggcctcatgggaacacttccagcttcagtaagctttgatggaatctcaagatggtcttggagtcttagaataccctgcctcacactgggctaaaatcagctctacatgacatctagccattgtccttatttctcacttttggtactgcacaaagtaagtttctctctatttttatccatgggatgaccattgagaaatcagaacacagggattctatttccttttagtcccattttcttcaggctacaaatctaaagtttattcaccattcaacaaactttttatttatttgtttacttatttatttgctatgaaagctagtctctgttggtcattttttgttttttctttctagcatcttctggcatgtctgtgtccttctcaaagtgtggccccaagtgataaatatttgaggtgatagatatgtaaattaccccaatttaatcattatgcattgtatgcatatatcaaaatatcactctgtattccataaatatgtacaattataacatgtccaaaaaaaagaaaggaaaaaaaaagaattggcccaaatggtctgttattccagtgtggttgcttcagtctaggataagccagacttctttggtttagcctctgtcctcttgcaggccactgttgctctctcttttttaagaaactatttcacctgctggctcacaatgtgggcaactagctggctgctctttcccaagcctgccagggaagctctcccccttgctgggtgtacagcttagtgtagggagagaaatacaagacttcatgtttataatctctatttaatttctccttgtaggtttcaaactagctatggcctatggtttcatcatctgttggttttgcccatctgtagccaacattgttgatgccctgtgccatctcccctccgcccatctctggattcatctgcagctgaggtagacagttctcaaacatgctgacagtttctcaccttagatgtccacatgtcttagaggctttgcctttagatttactccagtcctgtgggagctcgctcagcaagaatttctggaagagtaggagatgtaacaccccgccagctcttagccaaaaaaaaggcaggagtctgtgggtaaatacccaacctttcgtgtccctgggttgtgtttcctcagaggctcctcagtgggaatgaatccaggttgcccccagaagtaacctgctcattagcatatctttatgggcttttcccctattcctttctcatttcccctgctttctcactgtgcttcctgggatcaccttccaaatgaacaacagcacccaagtccttgtttcagactctgctttgggagaaagaaaactaagagcttgtcctccccagcttggttatcttctacagatttgttcttcttaattcttccttcactggtagaatgacacagagccctatagcatatctcctgagaggaggttacctgttaatgggttgtgaaattcttgtagtggtcatgattagcactttttaaacactcaaatgtaatagaatagcaaatatgagagggcatcatacttaaatattgttccatgaaacttatttttcgatcatataaatgtatgtgtgtactgagtcacaagatgaaacattttctgtggattgtattcaaaaaagtgaaaagtaattgctttctgtgaatacaattcataaatcagtatttctctgaatggacctttatgtaaactagatttactagaggaggcattctcttgggtaaaccaaagaaatgaggttactttggcctgatttgctatttttgaaccaacgctgattccaaattgtcactattctaaaaatttcttcctattttttttgttaataatctgttctaaaataacgcttaggataaaattgaaacttttcatgtctatggtttccatactccatatttttactgatttgaaaattgtctatccacagcctttgacacttctttggtttcccttaatttttcagtgattatgaagaataatttcacgtccatcctttatattctttaaggccctgggatgtagtttccttggatctggaaatttgagctcaggtaaaattgccagctgggatctcgttactcttgagcccttcttcctaatctgtggcttttccccatatataatattaaagcaagaaagatatttaggtggactttaaggaagaaatttcaactttcctacaagtaaaatgttgagaacagcttgggagtaggctgggaaggctgtctccaaacttttgagttttcattgggactctctcagtacttgaggctggcgtgtgcatcagattgtcttccaagagtatttccagatctaagactctctaattttattggcaaagcatatcttttagttggaggcccaaatggtaatttttaagaacttcttggataaacatgttcttatcattgcaaacaaatgagaaacaaacctaacaagctctttgcatcaaagatattttaattgctctgcttgaaaaattttaaattaaacaatgagtagaaaaaaagaatatttacataatatgggtatggtaaaaaaaaaaaaaaaaaaaccacaaacacctctacttaccagccagtttaataagaacttaccaaaaaaagagcaaaaactttaccctgtagtccttgctattctttcctttggattcttttcctttcgctatctcctcagaggtaaccaatgtcctaaattttgtatttatcattcctattattttctttatagaatatgtttatatctctaaaaatacattatttacagccgggtaaagtggctcatgcctgtaaccccagcactttgggaggccgaggcaggcagatcacctgaagtcaggagttcaagaacagcctggtcaacatggtgaaactccatctctactaaaaatacaaaaattagctgggcgtggtggcacgtgcctgtaatcctagctacttgggaggctgaggcaggagaattgcttgaaccgaggaagtggatgttgcagtgagccaagatcgcgccactgcactccagcctgggtgacagagcaagactgtatctcaaaaaaaaaaaaaaaaaaaaaaaaaaaccaaaaacaaacaaacaaaaaacattatttacatttgcatgcttttgacttgtgtataaatggacacatgctgaatatagtcttctataacttgcttgcttttcttcacttaacattagattcttaagagttgctcatgttgttacatgcagttgtgattttttcattcacgttatcttgtaagatcccattgtgtaaatatgccatcatttatccatgctactcttgatgtgcattttgggttgttgctagttttatgttcttgtaaacagtgctattgggaagattcttgtctatctcccttgaacaatgtgcaggaatttctctagactaagtacctaggagttgaattgctggataatatgcatacatatctttgactttgttcaataatgccaaattatttactaaggaagttataccaatctaaacttctagcaccaatgtgtatttccattgctcaacatccttgttaacacttgatcttgttatatttttagagttcttccaaactaatgggtcagaaatggtatgactgtggttttaattattgttagtggtattttagtaataatataatagtaataataatatggttattaattctcaggggaaggattttccttctttcactcactgctggggtacaagatgagaacttttctttgtagtccctatacatgggatggatttatttcactctttacactgagagtataggctgttggtatatcagctttatgtaggaggtgagggtgaggggatgtaggcagtctcctctaaaactgatgaccttgaatagtctctggagtttgtcttctgtatccaaggtctcaccagtccatggaaattaaagctcagttttggcagttatcctcagaataaaaggtgagccttaatatctggtacctaatcaggatcctgctttcacagtatttcttactttcttgcaagctaaaagtggatttttttcattgattttcatgtaagcacagccaggctacatggctcaccatactgcctgaaataggatcctaattgcttgactttgaaattgattccattttcaacctttagttactttcaaatgtatttcatgatattgtgccagagcaatctgtaatttgatgtttgaaggacatatgtacctcctcaaattatcctcttcagatttacaaactagaaaattctcagtggagatggctgacctaccacttgttcaagattttacaatgagacaaaaagttgccatttgcaagcatttgaggaaaatttttgggtgttcatcaagggaggagagaaaaagactgcctagggtgtttcccatttgctgcctgctttaatttttcatttataattccttgctcagaatttcattgaagaggggaatttctaggaagcattggcattcatgctctaaaaatgccctgtcttaacttccctaatgcagccttaacaatgatgaagatcccatacccagtttgattgtgctgtgtaaaatttgaatgtgacttgactactacacatagaagaacattaaaagacccatactaacaaaacaattactgacaggttttgttagggctgcaaaatagtgtgtttgcatttccccccctccccacctttcttttttggataggtttcatgtgaattcatgtgagtaccttgattgaattaaataattcatgtaaatcacccaaggcagtgcctgaggtagtgtctgttaactaaatagtaggtatttcttctctcttacaagctaggactgtaaggactgtgttaggactcactggtgtctaccttggccagtaagaccagataagatggtgctgtacaaagctgctcctgcatggtaaaaggctggagaaatagttgctacttcatttaatttaccttttatttccttcttaccctggactttcatctgcacaccaggatgctggaaaattgctcagaaagactcaatttttggcaaagttccctttagggcacatactgcctttttcactggcccatggtttctgagaactgccctcatcgctgcaaatgaggacttcaccagcccctccagtcccttccctgcagacagcctgccttggtcctaggggaaggacaaagggagcctgtcactgcaggcccttctccagcaagggactgggaaggggccaacatgcctgcaggctcctgtattgacaagttgcagcatccttaagagcagccaagaaataaaatggtaatttgtgtttgcatctggaatttctgagcttcaaaatcttggatcacagcactctcaataacagaaaacaggacacacatataaatatccatatccatattagcctctttgttaaactctgtctgggtcagcagctcgagactgaaaagtagcaggatgattgtacaggaagtagaatgaacctgaatgctgtgtttcagggcaggggacagcgggcatgagagggacgagaatggcctccccatttagtggaccctgagccatccccccagggacatctagagtttgactatattatggcttaaaacagctcttatggactctctaggggacctgatcaccactgataatgtggtttccaaggaaaagccaatttcaaattataagcaactgatttataaatgcactttggggatgctgccatctgtaggtgagaggccacatgactcccctgtcatcagtgccctgatactttggcagggttacaagccacgctgtgcctctttgtggggctctctttagctgggcagtgggctaaatgtggtattcgttggatagcaccagaagcctatccatgcaacatattatctccacttgcctgttctgctgcctgaggtttccccatgaggatcaggaagtttccacaatgagaagaaagccatttggggaaccctgtaaaaaactagtgtgttaaggcattatgtaaatatgagagtggataaatgacttagctgatatgtacagcaaagactattctgattatcaacttgggagttctagataaggtgtgtaatacaattgttttcaaactcttttgattgctacctgcagtaagaaatatgttttatatcacaatccaaaacacacacataccatgcacacagtatgccatcaactccaaaactctgtcagtcgtcagtcaccattattttaggtatcactaaaaaagaaaaatgataccaattaaactatgccattccattgattatagagctcatcttgggttcagggaaattaaaatgttaaaaagtgttgttttagagtcaataaaatatggtatatgtgtgtgtgtgtgtgtgtgtgtctgtgtataattgaaacaaaagtgtcatgaaacaatgctcacttttactatgtatggtatattataagtatctgctattttcccctattctaatctaatgtattttattgcaaataaagctggtcccactaaatttatggaatggctcactaatgttttaatttaattttaaagtgttaagtctgagctatagtattgttttgaaatagggaattggaaatgatacactgagattgatttcttatctcaaaccagatgtcatgctgtatgttttagtcatctatttcattcaaatgtaaattgatggtctactgtttaagttaggactcttgatggcacatgacagaaaccagtttcgaaaaagctttgaagaaaggatgggcttatcatcttatgttagggcagaggtatgcttgtggggccaagcaatactggaaccaagggctcaaatattgtgggatctctctttctctctttctctgttttgtttttgcttttctttgatggcttcattctctcgaattagcattctgtatgagatttaatctttgtcgttggcagcttcagggctcacatcttcctcattttaccaccagagaaaaatccttccaagattctcattggttcatgtaattggttcatatgattgctcctgtagtcaagggataggataaactcacctctactagaaccacataggtatgaggaataatgcagttttccaaaagaaaggctcttctttctttgagaggaacacaatagatgtctatcacacctaggaagtgctagcaccaggcattgtgtgctggggtgtagcctcacacaacaggtattgccaaaagcctgcagatgatcattttgaaaactagaattgccgtcagcttagttgcaccttcactttcccactagagcttgagtctcccagtgaagataataataactgacaacagctactgtgtgactatcagttcaagggcaccgaatggagaaatcggtgctttcaagagagaagctacccagaaaagaaatgattctacctcccaacacaggcagagctggataaaatagccatctgtaaaaaacttcaagtaaagtccaggtttttgttcttgggtgctcgtgttctattccctgttggggaaccggagaatgttttataaggaagaagccttaggtttcagctgagcagactgcagcctgtcactttcaggcattctcatgatgttcatttcagtgtttcagtgctgttttctggaaatatctttcttcacactctcttctctctgtctctctctgccatttaatgtactatattaaaatatcaatctacagctggcaattaaaagtttgctgcctacaattctcagtacacactgtggcgattttattttattttcttagactctgtcttctctgaattcagttattctcagttttgccaagatgtgccagaattttgtaagttatactgctgggttactgccaagaacgacgtaccagtcgcagctttatttgggcagctttttgtgccttaaatacagtatctgtttctgtaagtacagccttcactgagggagatggatgtctcattctgatattgatggaacagcttgagcatatcagtaatgtgtaggctaaagtctcaaggggaagaaaacttttgagagcctttgttagtttcacaggggcagtaaggggaaacaaaccctgaccgtattccctgaagagtttgatgtctagctgggaagaaaaaactcgaaatggcttctgaaaatccaacgcaacataaaatcagtgctgatttaaaaatgtgaacagagtgcatcaatgtgaatggaatggttaggaaagataaactgggggagctaggctttgaaatagctttaaacacaagaaaggaactgagaggagggaaagggctttcaggtaggtttctgagtcatgaagacagaaacaaggagtgaaattgcatgagatttagaatcagaaaagttcaatccttgttctcctataactgataatcacttcattctctgagctgagaatacaatcataaacaaagtgtcaaagagttgttgccctccccaggtttacattctagtcactgaatgatacctgcctcataaggttgcactgaggacttaaagaggcaatggaaatgaaagaccaggcagatttttaaaatgatgtgccatggtaatttgtttattgccaggtgtagaaggaggagggcaatttgatttgcttgactgctgttgtcccagctagaggttgaggatgggagtgttctagggtaacataatttgaaaacaggtactatgcccttctaaacacttctggtgtcccattttacagatgagcaaactgaggctcaggaaagaaaagtggcttcccaaatcaggatggcactggaacttaatcccagggctttttcagttgcatcctaccagagaggatggccatgagcagttgaggaaactcagtgtctgcttgctgtttcatgggatataacatctatgccctgaacaaatcagataaaagtagacttctaccaccgatcccccaaaggctttctcagattttcagattccttcattctgagggaggaaaccgaattaacttaacaaatgtaggttttcaaagtatttaaatcactgtttttctaatacttttgacaagacccacaggaagaaatatattctactgtgacctattgttagagtgaatatattatttattgtacaaatcaggaaggttttgagtgtgaaagagaatgctattaataataatgttagatggtaaccatgtgaggtgatggatatgttaattagcttgattatggtgattatatcacaatggatacgtatttcaaaacatcatgttgtaaaccttaaatatatataattttgcccattataccccagtaaagctgaaaaagtaatgctgggacaacaggcataaaatgggactgtgctatgcaaactggggataccctaccacacatacacctatataaaaacaaaaattgtacaaagtaaggtttattctttatatgtgcagtgcaccctgacattttcaattctatttcactacaaaaatactagtcatgacctactaaatggggtcaacagtttgaaacatactattcttagttgatggttggtatcgctgaggcacttatgatggtagtaaagacagggatttggtaagctgaatgtctgatatgtcctataaacttgtttcatctgaacattctgttgaatcttctgccacaagaaaagcactggtaataaacattttcttcagttcattccccatgattagcaaaaggtttagactaatctttctggatccctttgttccatttggaacaagaatcttcctctgtgtatttcccctcttttcttactcttgcgcttttatctattagtctgccacttatttagggatgtaaggaatccaaggaagaatgtctcatttacagatcctggttctctgtgtacttgttctgagccttcatcttggggttgaagctggtgctctgaaaagctaaagtttctttttcgctctactccttcaaacatatacacctttacacacaactcctggacatctctcctctgttgaaactttgccaagatataacagaatagatcttgcctgctagtcaggcatacggaactgacttctgggcttcttcaaaagcccccataaattaggactttccagaagagaagcttctgcagatttagctatggaggagagaagggttaccactgtacctgtgtccacacaagctatggacaggccctttgttagcccatttctgtcactagaaatgtttgtacactcacctgtgttaacaagagcttcaagaatacaagagacccggcaatagcacctttcagcaataaaataacttttggtgagtccccattttgtaaatgtttttaagtcataaaggcatatagggaaccacagggtttttcctacctcaaagtgtaaactatggtaatgtcttgagcctaaaaatcactttttcctaaagcaaattttattatctggatcatctgaactcatagagtaaacttgacaacagtttacttttctgaaaaagattgactgtatggcttttcctggtggttattaagatgaatacatatacatatgtttatgaaagattttctaaatcacaaatcatacaggattgttagaggaattttaaaaaacacacagaaaactttggaagcactgagattcttgaccatgtttcatgcttaaactttaaaaagtatatcatgccagatataagtttgtcatatttttacattttttcaagaaactcatttacacagcagctcagggatgtggaggccttcaatttatactcacataattaagtagaaaatgtgattatgaaccctcaaattagaaacttgtaaaactaaaacatatatattatgccatttaatttatggcaaccctgttgaggcatgcctaattggggtatttgaggcttagagagactcagtggctctcttagcttggtttcctagaagcaaagcttatggtttgttgagggaatactctcaggaaaaaaacctataattgaggaagggaagcaagaaagagctaagcaaggatagagtctcaggtaaattctagcaccacagggttcttagaaacataaatactgcaaggttgtccttccactcacctttgggggctagaagtctggcttcatgttcctccatatcaatcaaacattggctgcctccaggaaacaggtggggaggaagaagtggctcctatcagctgaggacaattctctggagaagagggcaactgtgagttatttgcagtcaaaggctcccagcagctaggagatgggcacaccagcctgagtaaaggggatctgattgaggaataagcagtatctaccgcagtgacctaagagaagactattaaaccaaggctgagaggtacatcagaatcttctgactttaaggcaaatgccctttctttttcccttcctccttttgtactttctactcttcctacaccttttcctccttttgttttaaaaacaaatactgtttattatgttagaatttttataagtcaggatctgggcatggtttagctggctcaaggtctctcatgaggttgcaagcaagttattggcttggcctgcagtttcatctgatggctcgacttgtgggtgttatgtgtgtgtgtagctggggagatcttcttataaccttacttatgttattgttggcaggcttttggtccctcaacacatgggccactccacagggcgccctcatgacttggcagctaacttgacccggaatgagtgatccaagagagagagtgtgagacagtattcaagatggacaccacagtctttttataacttgacttcaaaagagatatggtgtcccttctgccaaaatttattcattagaagcaagttaataaattcattccacacttaaagtgaggagttacaaaaggttatgaatgccaggggacagggataattgggggccatcttagaagctgcatatcagagtctaccctctggcacccagtgattatttcccaccaacatgcaaaatatactcactccccccccccttttttttttttttagaaaaatagcatctattcacagctaagcagctcactgagcctgctttctgacagtataattgtaggggatcaaagacctctccttattccttaatgtctctgccttcctaagtcaagctagtgatatttcagcatatataactcttttaagaattttgtgggtctcctgtgaatcttcttagaattcactctattagacaaaagttcaccctattagccaccttacaaatctcatagatatagactcttctctgtttgattgagaggaacttgagatacccttaatctctctaaggggccttttgtaagactgaaggtactttaaggcactaccttgatttaacaaaggattttacagccgtaattttgccttcatctttaaatcatgtttttctggcaatgccttggatttgatctttgttcagaagctattcaaatgtccttcatactgtaccacagctgctctgtaatccattggcagatcatttgttagcactaaatcatctggctcccacaaataaacaccctatggcttccaatagtacaaaatacccttttgtaaacatccaaatctgcagtattgtcacagtttaaatttatatacggaagctggactgattagaataaaaccatccaaaattataagcatgaggacataatttatgtgtcacaagaaatttaaggcagatttttctcttttttctccaacatttttaccaattccaaatcatatactgggtatacaaggtaaattagacatagttcccacccctgagcaatttatagacatgatttatctccatagaatacttttaaaaagttaggtctaggcctgtgctatccagtatggtagctattaaccacatgtggctatttaaatgtaaatttaaattaactaaaattaaatgaaataaaaacattcacttctcttgttttactagccacattttaaatgcttaataaccacataggactagtggctgccgtatttgacagtacagataaagaatatttccatcattgcagaaagttgcattggacagcactaatctagaagaaaccagtatgataagcatttatcctttttaaaaacatatttgcttctctctccccaacactaaaatgagttaaatatcaaaaagaaggacactacatgcttcttcagtaaatattctaacatgcttaacaataaagaatgctgtaagaccatggcttttaaaatttattaaaatctactgaaagctaacatctttttcccctagaaaaagcatgctagtaccaaaaggcatgtatcaaaagcatgtaccaaaaaacatgttcaattacaaggggttcatgggccctccaaagccctttcattaattctgtagtaggccatgatcctcaggttaagaatccctactgcaaagtaaattttattttcccattgactttcagtataaaattgatggtgcaatttactattaaatatgcttctttctgacaatattaaaattatgtctagaataatgatgaagggagaaacaaaatgtaaagaatgaagaactgtcttcaaaatgactaaaaaataaacccaacactttgagctaaaaatataatacagagccagcaaatctaccaatttgggtcaggtatcataatcaataaagaactatgtagttttagcaaatttgccaagttttccattagtcttaaatctctaccacatccctaccttacggtgagaaaccttatggcgtgatagcaggaacactctactagccttcagaaatctagtctcctgatgtaatttcaatacatataataagtattatttaagagtgactttggtgcctcgatgatcttatctacctggacattcagaatgaatgggtggggttccataggccaggaagaccctaatttgaactttggaaaaaaaaagagtggctatttctttgaaaatctgttgaattagagaaagtttttgcaaggagagcaaaattataaatgcagttggctccaggtatggctgagagacagaatcctacatggctctgagtttctgatttctgagccaacgtacaatttgtatttgtgtggaagaagcactgaagcattctttccagagtggtaatctgaaccatatgtagactgattaatagttatgtcataataaaacctcaattagcagaattctagagggatagccttttataaataaaggaaagtttactaagaaacctcccttctcccatcctccccaacttctttctctatttttcttccttttgaaaaattttaatggtggggaaaatctttccccaatgtacataaagctcctctgctgctttagtaagtacagtctactgaacataagtgagtctgtcttcgagcttattgtatctttcagggtgtctattttgcagactagtcatcatatttttatagaagttaatatatgagctcaggctgaaaataaactggaaattttctgagagtggcagctaatacccatttattttcttttcacttaaaaaacacctatcaaggctgagggcagtggctcatgcctgtaatcccagcactttgggaggcccaggcgggcagatcacttgaggtcactagttcgagaccagcctggccaacatggtgaaaccctgtctctagtaaaaatacaaaaattagctgagcgtagtggtgcatgcttgtaatcccagctactcagtaggctgaggcacgagaatctcttggacccaggagatggaggctgcagtaagccgggatcataccactacactccctcctgggcaacagagcgagaccctgtctcaaaaaaaaaaaaaaaatctatcaagaatatgcagtaaagttttcattcatttgtgtatcagtttatatgcatacagttgcatgtaacaaacagtgctactcacagtggcttaaattgaaaggatatttattgttgacctaacaagaattgtggaggtaagatgtataaggttgatgttgtagtctggtgacatcatccaaggtcctgggttctttttatctatccactttgccatcctcaactgaaaatctttagtcctgtgacatcttaccttgtggttgcaaaatggctgctccagcttcagacgtttatctttacacaatagcctccaaagctgaaaggcagaaaagagggaaaagtcttctccttgcgcagttttctcttttatcagggagaaaaatctttcccataagctccctccccctgcccctaagcagacttcattttacttgccattgtccaatattgggttacatgcttatccctggagcaattcctggcaaaggggaattaattttttgacttaagagtcatcatggttcatcgtttggggagggacacattgctgctgaacacaacctgtgatcttttagtaagaaggaaggggagaatggctgctggacaggcaaccagcagcttctgctacacatggattcttcattttgcttctgtgggacccactcttggcatatttgttctcacactactgaagaagccatttgctgtttgcctatcagtgatcccaaagccagctatctcatttctttgaaattgtaggcgcagaaggcagtaaggcctagtgaaaaaagaatgatagatttgaaggccaggcagacaggattcgaatccctgatttaccatttactggctgcataaccttggacaagtaaagacgttagagacttggtttccctaatgataaatctaaaatagtaccaaatggccagtgttattgtatagatttaatgagatagtgcatagaaattgcctagcatagtacacatatcataggcacttagtgtgtgttatttcctttcccatgtgaattcaattgcacagaaatcagattgcatttagcttagcagatagaccaattcggaaaaagagtaagtttgactccagtaggttttttttttcttttttcctccttactcatctatgttcacataaaagtcccctctcttatctacaaaagacttgtgggtagaaagcagtgtgccctgtgttagggtagtgtccagttactaagagaaagctataaaaccatatattcatttcttaattggtttgcttaaatatctgttaggtttaatataggaaacagaatcctctctaggtattttatgcaaaaaatgatttaatgcaggaaataaggtactcacaaaattggaagggctggagcaatggaagtcaagaagtctgccttaaaggtcaaatggcaccatgacttcagtccagatgccagaaactcctcctatcactcaggctaggaaactgttgctgccgtgattatcaccactgccaacgtcactatcctccctaccacacaaagctgatgaggggacagtggacacagttgacaacactcacatctgctgtagcctattttctgcatgcacaactgtagaaaagagttccttccctttgattccttccaaatcactaaaagtagaccctttcacaacctagggataagggaatctagaaactgtacttttcaacccaatgccaggctttcttccgccttacccatgtgaaagccctccttatcttactaatctgtgattcccctgctgggctatctgcccatgtgcattctctctttgcccctgttttccctctatgccctgtttgggctctgacatcctgctctggcctaccatgcctccctgtcctttctggtacagatgtctgccttgctctaaaggccttagaactcagttgttcaagaagagaagattaggaaagggtaagaggtctccttgctttgttaaaaattaccgtacatatctttgtatttcccaacaatttagtgttagaagtttttgaactttataaaaaaggagtcgtatatatagtatatagtcttctgggaccaactttgctcacaatattattttagttttattcatccatattgttgttctcacacatgagctttgccatattttaaaatcttaatgcatttttgcattttgggggttatgcttctttctttattcattcagcattctataatattttcccatgttaagaaacctcttcaaaatgaacattattatgttatgaatggatcataatatgattgaccatttcttgtagttggatatttaagttaattcctatcttagaatgtggtagatgaagaagatagaagaaaaaaaggctgagattttccatgtggcagagtagctggaagatggttatttgctgaaatgggaaacactgggggatgcacaaatttggtgataagaaaaggaatctggttttgagcaggttgagtgtgagtgtggagatatccagacaacagttgaagattctagcttggctcttaggagacagttcaaggctagaaacaatggatttatcatcagtacatggggaatggtttgaggcaagtatgggagtgagatggcccaggaaaatagtctggagatatgtaaaggaccaatactggactcctgggaaatacttatgtccaaatggcaggctgatctagatgtgctgtccagagagtctgtttagaaaggaggaagaaaatcgggaaactgttgtcatttggaagccactgcagaagagagcttcatgaaatgaatgggtagtcattcatactaaatgctgtaaatactgtagacaagttaaccaggatgacaaccgagggcaaaatatatgtatgtgtgtatatgtgtgttggagggctgggcggggggagaaagcttgctgctcatgtatctggatttttttttaatttggatgattgaaggttcacatgcagacatgcagttcaactgtttccttgggtagattcctagaagtggaatgacttgatcaaagggtttgagcataggcctttgattcatgttgttaggtaggtttcctggttttcattgttttttgttttgttttgtttttgagatgggttctcactatgttatccaggctgttttttgaactcctgggctcaagtaattctcccactcagcctccctagtttctgagattacaggcatgagccactgtgtctggttccagtgctcatttttttatatgcaatgatgaatagtttgtaattttgtacacatctgggtgtgcagagacaaggtgaggaaatctgcagcaaaggaaaatacagaattgggcttctgtagttgcgggtcttttcctaatgaacacagtccagccctcatctcctctccactttcagtttccacactctacatctctcatccagaacacaagtggaacagggaccattactcattagctgcatggggatttgaataacctcacagtggaggatgttcttgtctgttatggtggcaagtaactacaactaaatgcgtgaccaagacagagctaactcgagtcattaattagactgtgaagtctggagggaagttctctgaatttaagattacagttttgaagtttggcatctgctaccacttcaaggattaaggatttactgctcactggaattcaatatttaatattttaaaaaccattcagctccagcttgcaaatgagttaaattaaaataatacacagacgttctctctgaggccgtggtttttattggtagcaacgctcattaagaaattttactggctgggcacggtggctcacgcctgtaatcccagcactttgtgaggccgaggcgggcagatcatctgaggtcgggagttcgcgaccagcctgaccaacatggagaaatcccgtctctactaaaaatacaaaattagccaggcatggtggcacatgcctgtaattccagctattcaggaggccgaggcaggagaatcccttgaacccaagaggcggaggttgcggtgagccaaaatcacaccattgcactccagcctagcaacagagtgagactccgtctcaaaaaaaaaaaaaaaaaaagaaattttacttgagccatacgttcatgagaggttctaaataagcacacagatagtctatttcagccttcatttcctacaaatgctgtatatagaagcaactttgtgtttcttttgtcaagataagacatttgatttacctccttatcttgcatttaaatttatttcacaagatggacctgttttcaggtaccataaacacccagttctactgggttttctttgactgctggggaaactgtggactgtgtctgatgcacacattttattgcatctcccctggcatgagattcatatacattggcatcttctcagagtgaagttgactctctctgtttccctattccagaatttcacttggcatatggtgattccaaaacagtttgaggctcattttgcttggtttttggcaatctcagctcagccggtttcactctgagagatctcctgtttgttccttcatgaatggccacagaagcttttgctcttggctctgcattctaatagcacctcctgcatggtctgtggcaaaggaatgctttgaaatatgcgtccatactatgtggcttttcttgctgcagtttctgttcttttttattgtaggatcgggagactcaccactagaagacgatgaagtcgggtattcacaccctagatataaaggtgaatgctttgcttatgtgctaatgaggacctgctggtgccaggagaactttcctttatgccttgtgaaacagattgtaataaagtgaccagacaacacatttaagttctaattatctatcaaggaaaaaaaaatatatatatatactcccttttttaaaaaaggaaataaagcaaaatgcattggaaatctctgaaatgctgtctttcagcatcccaatggtcattttattctcataagtttctttactgtcctcacttctgcaaaggcagctgtagctgatgaaagtgaaaatcaagcctaattcatacattacagccagaatcatccagagtaaaccacctaaggtcaaatctggaccaagtgctgataatgtactaagatgaatggggaaggagaaaacttgattttcataagctcatttcatcgtgctctttctgagcccagcatggcttctgaaacggtatgttaaagtatgttgctcaaatgaaacttaatgataaagaactccatctctacatattcccagcaatccactccccagcacgtataaaaagcctaaacaagaaccttctgtccagactcaggtaagtatgtccacaaatatttctactggtgaaacatttctctgaagcttagggaaacctgggagaaatgaaggtaaatttagagatgctttctctctgaatctagttcctcttacagtggaggaagaatttgaaaaaaaaaaaaaatggttaacaaagtttcactgcggcattttgccctggaaatttgtcctaattcctgggatgaggacatggcccttgtttgttgtgatgtgtctcagatacaggagaatcagggtaggactggacaacttttgactggagatgtccttcagttgttttctacacaagtgaacaatatttccaatataatgactggtgcctggtgcttatgtgcaggtgtgcttcccatcacataccacatttttttgtgagatctgaatgcaaatactcattcctacctatagtttctatctccatagcctcaggaattaaccaatcaagcaaagcacaaatacgttaatcagatgcttggggtaaggaaaggttctaattcgcaaaacttcttaactatttatgggtttagatttttttttctttgagtcccttgttgaaaaatcttcctaaaacacatgcatgcacagatgacccttcacatctacagcaggggttgcctagtgccctcaggtccttgttcttcacatccatcttcacctcacagcattgcaaatgtgacaggtagaccagatggccaaaatgtgtgcttgccctagaacttaccctgaatgtttaagaataaattttcttagggcattgtttctattgtcagttaaattgcttactggtagcaatcatttcagtatgtataagtatatcaaagcatcatgttgtgcgcttcatacaataaaatttaagttttatttatttttattattattttttgagatggagtctcaccctgtcacccaggctgtagtgcagtggcgtgatcttggctcactgtaacatccgcctcccaggttcaagcgattctcctatcttagcctcccaggtagctgggactacaggcacacgccaccacacccagctaatgttgcatttttagtacagacaggggtttcactatgttggccaggctggtctcgaactcctaacctcaggtgatccacccaccttggcctcccaaagtgctgggattacaggcgtgagccactgcacctggccaagtttttttaattttaaaagctagagacaagccattattaagtgagggtttagttttagatcctgaggcccctgcacaatgtccagcacagagtaagtgtttttgaattaaagtaaaataagaaagaaaattaaatgtaaccaacatttacggtgctcctggtatgtggcaagcatggcttttgattcttttgcttggaataccatcatatattcatattaattgagtgagtttgtgatgtatgagtatgcaggtcatatatatacatacattagttcccccttatctgcggtttcactttccaaggttccatttaccttcagtcaaccgcagccccaaaatattagatattttgagagagagacagtacattcacctaactttcattacagtatattgttataattgttctatattattattagttgttgttaatcttttatcatgcctaatttataaattaaacttcatcataggtatgtttgtgtaagaaacaaacagtatatatagcgttaggtactatccaaggcttcaggcatccaatatcccccgtgggcaaagggggagtactgtatatcacaaatatatgtagtacatacagattatattaaaacccttagaggaaggaaaatttattcaaggaagttctttaggccttgtgtgagctcctacacgtttatatccacatggttaaatttaatcagctctaggttaagcctttaggacatcacctttacctagaaagtccagggaagattacttgagtcttgagtttagggctcacttgcagctgtctgcaaaacatgatatgacgaaagtattagccagaccagggacggtggtgcgtgcctgtagttccagctacttgggaagctgagacaggaggatcacttgagcctaggaggccgagactgcagtgagcaatgatcatgccactacactccagcctgggtgacagagtgagaccctgtttctaaaaaagaaaaaaaaaagagaaagtattagctgaaggaaatgtgaaggcaaaactaaaacagtggtctatgcataagacgtggccagaactgttggtttttgtaactgagaagcagttggaggcatatcctcagaagagaattcctgggaaagtaaaacagggtctgtcctccttcctggccacatgatggcggtcttacctcactcactgacagctcaggtgctgggttggagtgatgagccaggcagttgcagggaagtggctcctattcatggcattgagagcccggcaggctttagggaactcctcactgttccccatcaattgtgggacaatggggcagtggctgctgtaggaacttatccaccaaggagctagtgttgcccttatattttatggatctcaaagagaacatttcaaaagcacagcagggaggttctgatttattcatttcatcccagctgtgctttgggcaactatgagaccaaaatcaaaacacctgcaactttgccatctggggagggtgtcaccctgttacgtaaatggggcataactggggacacttctctatggagagcaattgttctgtgactttaagcgaaatttatatcttgttacaaacacctggaaattgtagcatcatttagattaatgccagtattacaacattttagagagaatgtgcatacggctcagacgaaatccaaattaaccaattattgaatccctaccgctatgtatgacatcagttgcccttgaaagaattatctaaaaaataaaaataaaaaatcttatgtatctagttaagggaaatactaaaaagaacaagcatttattgaacatatatgctaggtactgtgctagatgcttgatatgcaatttttatttcgtccttgtaacagcactatggcataagtatagatattgactcagagaggttagctaacttgtctaagatcacacagtcagttatagaggaactcagattcatgttcagatatatctgacacttagtcccatgatcataacctccctacccggagacacctaagaaaacatggggcactaattgaaggtccaaaatttggaatgtagccagcctgggacagtaagagtaaggggacacattttctgaaagtgtcatttcatatttatctcctcttttgtttctgctacttgtagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacgtgagtaggccagctctgtgttgggtcctcagggatgaccagagccaaagttcttttgctctgagattgaggattttcactgaatattgatgagaaaaattctccttatgatcagggggacaccagggggattctaagatatggtggaagtgagttggctcctctcagagagaatgatatgatcagctgtttgagaaaaggggagagaagatcattgttcagaaaatgagttacatttgttcagttagtgctggatcctgaagaggtgttggggatttagaaacaaataagacgcacatgggtcctgccatgaagaggctttagtaaggcagaggtgtcaactgggagataagtacaagaagggtacaaagtcagggacatatggtagcagattaaagaagagttctcctggctgggcgcagtggctcatgcctgtaatcccagcactttgggaggccgaggcgggtgggttgcctgagctcaggagttcgacaccagcctgagcaacacggtgaaaccccatctctactaaaatacaaaaaattagctgggtgtggcagcgtgcatctgtaatcccagctactcaggaggctgaggcaggagaattgctagaacccgggaggcggaggttgtagtgagccgagattgtgccactgcactccaacctgggtgacagagcaagactccatctcttaaaaaaaaagaaaaaaaaagtgttctcccaaggagtggggcttagggaggcaggaaagagtcacagaagaagtgatgcttatttatgaaagtgagtgtgcctcaagggagaagcttagaggagcagcatttcaggggctggcttttagcttcatgacaagtcatacctcatttggaaaattgcaagtggtacagcattgttgaagcacattttagatgtctttggtattcaaaacagccaccactttttgagcgcttatggtttgccaagaatttcacatacatttgatttttacagtaacactatcaatatgggtgccattatgttaacttcattgtcagggaaactgaggtttcaaggctgcagccatgtcatcgagactatgcagactctgcaactgggtgactgtagtggacaatctgctctacccagatctcctcgatgccttttactagttgtatgtatccagtacccagcttctgagtactttgctcttaaagacttggaacttcaaccttattcagaagactgctccttcagaggactgatcccactcgctctctctctctctcactctctcactctcgttctcttttcacaagagaaagcatctcctgtgagcagcctgtagctgcccaatgactgactgataaagaattatgaaagcccagcttccttgcctgggggcaggacagaatgagctgtcattcacactccagagcttccctatgggatcaggctgctgctgactttgcctgagatctcatcttgnnnnnnnnnnnnnnnnnnnnnnnnnnnnnnnnnnnnnnnnnnnnnnatctcatcttgcctggatttctccccttccctgttctgctttcctcaccccctcactagtctccctgggagcactttcttactaaacctcatgcacataaatccgtatctcagaatctgcttctggggagctcaacctaagatagtggcttagctgggttgccaacccaagccagtgtgacaggaaactttgtgtcttctgtgtgacataaaaccatccattgtttcttaaattccatttgttttatttatttatacaaagtcgtgttcttgttgcccaggctggagcgcaatggcgcaatctcagctcgccgcaacctctgcctcctgggttcaagcgatcctcctgccgtagcctcccgagtagctgggattacaggcatgcgccaccacgcctggctaattttgtacttttagtagagatggggtttctccatgttggtcaggctggtctcgaactcccgaagtcaggtgatccacctgcctcgacctcccaaagtgctgggattacaggagtgagccactgcgcctggccttcttatatttaaattaacttttcacctcatgctttcagagtttctagactctgaaatgaaactctatagacaaaaactaagaaatgctgaatatctgattttctcattttcagaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtgggtaagaaaatgccacagcccttaggaggcacttgctttgggaggagcagggggtgttcacatcgtggattgtaaagggagcatcactattcctcctgtaaggcctaagcatgcaactttgctctcagtagcatcactggttctctggctcagccctagatctaacctcagtgtctatcctggagctgacttcgtagctgatggcttccatctgacttttgtctttttcttggtttgctattgaggcaactacaggctggcagagatgtggcatactcctgctgattttagttcgggggcctgagcaaagttattgacactatagggacagtccagtagagaacatctatgtgtctttcagccccaatgtagcttctttgtcattgactctggtggtcagcaagcactcaatttgttcagctggaagggatttggatattttgccttactctgggtttgttgggcagtgagtggttcccatggtgtggtcctgggagcagaagcagcagtagcatctcctggtctaagaatgcaaatttttaccaacccacccccaccacctgctgagtcagaaactttaggggtcaggcacagcattttgttttttaatgagcattccagggattgtgaggcactcaaatagagagctactgatctaaggcactgcttctcaaactttactgtgcagcgaagtcctctagggaccttgggaaaaatgcagatttaaattcagcaggtctgcggtgggtcctaggattctgctaaacgatgctttagggcaaagtttctgaacctcagcatgatggacatttggggccaaataattctttgttgtggagccctgttttttttgtttgcaggatgtttagcagcatccttggattttattcactaagtgccagtaacactgcccacagggggcacctcacagatgttgctttcaatatcctcccctgtgattagctatgtgcatagctcttcaaaacaaaccaaaaagaaaattgaatctactccctcatattggaaggggcagaggtgatggtgggaggagagaagctcaaaaatctttctgctaagcaagctttggcagagtactctagggatcatactgtttaaatttccagattgtgtgcaacaatggaaagaaaatgctgattgttctcaaaaaccaacagcatgtcttaagctggaccagatgcgcctggaaccttcccagaggaagagagaatgaaccccaaattcaggagattcatattacagtttgtcagaacaaggttcaggcatatttgggagaaggaggattgtacatgcaattagttagggatgacaaaaaggggtacagcgatccacaagagagcctagagctcccaggaaaaaagagagaaatgggcaaagcaagcaggcaattctttctttgattttcgcgacagacaagctgaggtttgtccccagtgaattttactccaggggtattatttacttttttggctttaaatgtattaaaatagtttaataaatttgtttttgtgttgacaggggtagggggtccttgagcgtaactcagaacttcaacctattttaggaggtgacacatagtggctaagtagttcccagatttccacacaaccttcaacagtcttggccagagctgtactgagtggtgagaaagttgtcccagttctcttctagactgtgagggaagagagaagactgggcttactttggactctgaggtggtcagttctgtggtctggctaatttgaaggtgccacaagttaaaattaattctcttacacagaccatactctggcaatgagctgaaattcatagttatttcagaaacagatatagataaaaataagtcaatgtaggaggaaaaaaaatactgcaaattgcaggagggtaaaaagtctttgaagagccacaacctccattgatctggaagaaaataaaccttagaatgtaaccactattgttttcgggggatatttttctttctttccatttttagttatttttggttatgttggcatttagatagaacaatgaacagttggaatcacaacaagtcctcatgtaaagaccagattttgagtagacacatgatctctcctttagaccaacacttcttcctaggccaaaacaggaagaaaacaaattaaagatactttaaaaaccacggacaatgaaaaaccagcaaaggtcttttgacattcagagagtatccatttaattactttaacaaaagacaatgtacaaactttcctttttgccctgtggaacggattgtaataaagtgaccagacaacacatttaagttctaattatctatcaaggaaaaaatatttttaaataaatatattttattttttgctcacttatttttttgttttctacagagtagaataggtggagatttattaacacaaatgaaattctggaataaaacattttggagatgtaatatatggaaattgatggcatacgtttcttgtgtcccagctgtctcacagctggtttacccaatgacccataggaatgggatcattgcattattgctgggctgcattgcattattcagttgatgcaaacatcagtagggctaagaataaatgtatccatgcattgttgcaaatgatgttaaattgtgctaaattcttcctgggttgacaaatacacattcttttgcaaactttcagaggctagtttcagttaaaacaacttgattgactgagatactgattcactttttcccttacatgatttgttagtacaaacagaacaggtcaacttttagtggctctctctaatataaatgtatcaccaatgaatttttatttgggcttctttcttgtgaagatgttgacttttagagatgaggtctcattatgttgcccaggctggcctcttgctatgtcgtccaggctggtcttgaactcccaggcttaagtgatcctcccacatcagcctcctgagtagctggggctacaggcatgagccaccacacccggctatgatcatgacttttaaatgtggatttcattgcctcccttcttgcctcttttgtctgttttggaaagttctctggatttttgtatggtgccaaacagaggaaaccacttcccagagccatccacagagattacgctctggctgggggaagcaaacaactggatgagttttcaatggccaggtttgttctgcatttggcagtcactcacttcctatgcccccttgaaaagaactcttcctttctctatcaccaaactcaaactattttatatttgcatcagtgatctgttgctgcacaatagaccacacaaaacttagtggctccaaacaactatgttattgctcaaagattctatgggttggaaagttgggcagagctctgtggggacagctcatctctgctgtatgtggtaatggttgaggtgaccaagtggagctggaggattcaagatggcttcactcacaggtctggtacctcagttgggaaaagttgtactgactggggtctggctgagtctctttctctctctctctctcatttataatttctcatcctgattacatggcctctccagtcaattggacttctttagatggcagctggcttttaacatagtgaaagcagaaggcaccagattctttgagggcctaggtctggaactggcacagggtcacttcccttgcattttattgttatctgttgggcaagactttgtccttttgagcttcttccttatttccactacctaccgggttagatgtgtcaaggatttccaagtaaatagttcagcttcagctgggtgctggtggctcacacctgtaatcccagcactttgggaggctaagacaggcagatttcttgagcccaggagttcgagaccagcctgggcaacatggcaaaatcctgtctctacaaaaataaataaataaatgaataaataaaatcagctaggcatggtggtgcatgcctgtagtcccagctacttgggaggctgaggtgggaggatcacatgagtctgggaggtcaaggctgcagtgagccgatattgtgccactgcactccagcctgggtgacagagtgagagcctgtctcgaaaaaaaagttcagcttcttagataaatagtagttgatacaatgcaatatatttgtatctcatattttatatgcacagagataactagagcacagagaagggagacagtttgtcagatgtctccaatgaatgtggcagagagcaaaggccagaattttcactgaaggtttcaagatttttatataattgcaggcatcctaattcaacaggggatagtaattatgtttctatagtaactttgttcctttcattcatggaaatgtataacttataaaatgctatcggggccaagtctgggtaataacaggcttaggtctctggagcatcagctgaagggcagaccagcttgtctcaccagccgagagagaaggcagctgcttgaggatgtgtcaggatcaagtcctgcagaggctcttcaagggttcatggggaagctatgacagaccatcacaaaacagtatgtgtgcaaaggttggcggaaaacactaggtcagcagcaggcagatacacaaaagggtttggtttattaaaatagctttaaaatatgtaatggcatttaaaaatcccagaccacaaagaaattccaaaagagaggaaatgcttcttcccagtctataaatgaggatgctaataacactgcttagtctaatgggtggttgtgcaaattcagtaaaataatatagggagggtacttagcatggggtgggcatgtaggaaggagtcctccaatattagttattatttgtaatgatttatttcttcttgtttcttctttggaagagcactgtttctgaaaagctaggccagttcagctgatcattgttagctagagataagctggctttgggaaactctgagactcttcacccagataacctatcttggagcctgtgtgcttacactgttagtacatcttgatacagaaaacaaacaacaatgtatcatccagacatttagtttacctgacagagactaagttgcttttcactctgaccatgctgcaccaagaaaatatggtaacacaatgtaattttacattgaaatctgtatgctaataaatatactttctataatgtaattgccagctatatttgaccagcagggggcagtcattatatacttgtctttctgtgaaatgttcatctgaattataaaagtttgtcttctatcacctatcatagtaaaaaattaaatgtttttaaaaacgtaacagctgagtatagacatcttgaatgcatttaaagcatcttccatttcatcatagtatttgtatactttattttatcaattctgagaagcgtattatttctaccttttaatatccctgaaatagggatgcatttcacaattaggagtgacttagattcaacaaaatatggtggttattcaatttaggattggtgcattaaggctgttaagttcacactccactgaagcacgacatagaatgaaaatgaatttggatagctgaaggcaaaattgtttaataagttattcgtaacttcttaccctgaataaaatgagaaattattagacaagacacaggagaaagtatataaagaattttacttggtgcatttagtctctcaaagacatctgtcattcagaatcaaaaggacatttaactttcattaaggcagtaatagcacttaatacttatcagttgatatgtaaagtaacatgaagctgaatgtccttaatttgctatgccttctttaaatacattctctacctgttcagaaatattaagtagaatttgcagaaatgtgaacttcctcttgtgatttcacttcagctataagatgaaatacaacccagtgtagagttgacatctcatttactttgagccctcattaaccacccatccttgttatcactatcgaggcagaactcctattaccaggtagagaaactacttgaagaaatttgggaggcttttggaggtccagagccacagtaaaactgctgtcccagaacataaaaccataagtgtagttcagtagcagttcaaggggagagtggacccagacagaccattgcctattttaagatattaagcaatatgttgataatagatagcaggaagagagagagcttgttccagtggcaagtgctccgacttagattgtaattcacagtgccattatctacatgtgtggtcttaaataaatcatttaagttctttgagcctcagtttgcacatctgtaaaatgagagagttgggcggctcctctacacctccatagcattcacttttaccttgcctggggcaattgccattttctacctcatgttatatttcatgtgtgataatgtaatccctccaatacatggcaaattctctgaaatgtcaggagcacatgattctcttgcctttgtgcacccccaaccccagcagttggaatgaagccttggataagattggtactcatgaaaaatttgttgccttgaattgaatctgactagatgatagctagaatgcctttctgtaatattccatgatgctgtgttcaaagcaggaagtactcactaaagccaaatgacttctagtttcagctgggtaactgccatgtggccttcggtaggcagagtttggaagcatggggaggaaaggctgtaactaatgaattacccacaggacaccttgcaaggccagttgattgcaggtttagccctgcaaatgtgagtatttaaacaatcttcaaaacttagcaggagagtaaaagcattatgaagggagaaaaggggaatatatagggtgaacaaactctttgaaaatggagaatacccagaggctttggtattttaaactgtgggtgttgaaccccagtttgactagatatttcttgatgatgatgagaatgttttggttatattttcagatatggaacctcctagaatcaagtgcccaagtgtgaaggaacgcattgcagaacccaacaaactgacagtccgggtgtcctgggagacacccgaaggaagagacacagcagatggaattcttactgagtaagtgaaacttggcagataaaatgatgctgtctcttttatgtgagatgtttactacccagagtaggggagtgtatatatgctggtctatttatgctttcagatgtggtccccctggtcactacctaacatactatatatgtcacctatgtatttgttgattgcctgtctctattataatatgttcactgctatgtccttaatgcccagaactgtgcctggcacatagttagcactcagtaaatccttactgaaggaaaaaggagaaataaggggtggtgaatgatgtgattattatgcattgcatgcctgtatcaaaacatcttggctgggtgcggtggctcatgcctgtaatcccagcactttgtgaggacgaggcaggcggatcacttgaggtcagaagtttgagaccagcctggctaacatggtgaaaccccatctctactaaaaatacaaaaattagccgggcatggtggcacacacctgtaatcccagctactcaggaggctgaggcatgagaatcgcttgaacctgtgaggctgaggttgcagtgagccaagattgcaccactgtgctccagcctgggtgacagagtgagacgccatctcaaaaaaattaaaaaaaaaaactcatgtaccccataaatatatatacctaccatatactcacaaaaattaaaaataaaaaaaatgtaaaagaaggggtggtgagaagaagggaaggaggaacagaaggggaaagaggaagccagttggttaatttaagaatagagccacccccattgcctgcccaggcagaccctactcatgcccccaggccattacctgcactgggaagccatctgtgtctcccaggtggtgccaaaggctgccgctcttgtgctctgtgagtacagtttagtgcaaaactttttcaccccttgttttttggctgtatttatctctttcaaagctttttaatttatttttaaaactcccgatcatatcaaacacttacagatgcttatttaaaaaaagagaaggtatcttctgctttcttccccacctctaccccattctcctggaccaatttcattcatagtttgacatgtatctgagttgctttttgttggtgtgtttgttttaccaatcacaatgagaagcactgttaagaagcttttaaaaatgggtggatccctttgtgagggttagctatgtgttgttctaatctagcatttgggcctgtacccctgcaactgtttggttggccttcatattccctggagaccactacttcatgttagcacattcatatctgtgccttaaagtttatgggcatattagagttccccactgagttttcatctgtagatgaaaggatacctctaacttatctcctggtgatccataaagcaggaaaagactttctagaatcctatcaacccaggctgtgcatgacaaaacatttttacacaatgattagcaataacagtacagtttctagtgagaggagacaggacattttgttcctacattccaataatcttcccccagtgcctcatctagcttaagtagtattactagttatgctctcccattgtaacttctcaaagataaagtttgaccattaaaaaattatttgctgtcacatacacatcccacaaattcctttggagaaaatgtaggcaatcagaattgaaaagtaagttgatgttatcagggattgggttttatttacctttgactcttcagggtctagcacaatgtctggcccagccccagcacgtagtaggtttttagatttttgcagctctgactgctgttgaaaaaacctgtgtgataaacacaaaacatcaagccatcagatgactctatttgtctacaagctttgtgagaatattcaccttgttctttttatgggtaacttgcgtaatatggttaggagtgttacattttatttgatttttttattttttgagacagattctcactctgttgcccaggctggagtgcagtggcacgatcttggctcacagcaacctccgcctcccaggttcaagtgattctcctgactcagtctcctgagtagctgggattacaggtgtgcaccaccatgccctgctaatttttgtatttttagtagagatgggtttttgccatgttggccaggctggtcttgcactcctgacctcaggtgatctgcctgcctcagcctccaaaagtgctgggattacattcatgagccactgcacccggcaggattgttacattttaaaacagcatctcagtattctcctgtccctttgttcagagcagctgtctgcttccagagttctacaacccagaggccagaaaggcttagagcaggatgtggtgggaatgcactccaacaggatgaggagttcagagaaggctgtcttgttcccttttcgctctcactagggctccttgctgccctggcatttctcctatgaccccttccaccatttcctatccaagctactgctctatcgctcccttgtgagggagaaggttctagtgtcaagctctgagacaagtgcttcttgtgagttcccttatttactccttctgttatttgcatgtcacaggtgaaacaaagtctcagaaaggttacatccacttatatttgaagtatcactcctctcaggtttatctgaatttaaactgtgctttctaaagaccttaaagcatctaaagccaacagcagcatgtctcaaaatagtgggatttctgacattttcccaagacccctctctcatacctggtaaacagccacctcacccacctacatgtaaggctttcctcaatggtgacaatgataattccacgtgttcattattagcaaatattctcatcattcccagaactgtagggagatggggaattatatgtatattgaaaaacagaacgtggattttgatcctgctatacttattggtgtcctcattaggcagccaagaaaaaagataaactcaccctagctgtgtgaccttgggcaagttctttagcctttttgtgcctcagtttcctcatctgtgaatcagagataatactacctaccttatagggttgttggattaaataaggaggattaagtaaatatatgcaaaatgcctagaaccatgcctaacatgtaaggtttatgtaagtgcaaagaacactttttgtcattattattatgttattaggataaccaaggaatcacagagaacttgcctttaggtctccactgtcccagacagaaagaacagagaaagttctagcacccacccccgccccgcaggcccaaattgccagtgactgcttggactatattctctaatgattttcctcacagaaaattccctcgtcttcccaacagtgaggcaattcaggtcccccctggaacaagagtgagattgaaggaggagacttgggccctatatttttcatcctccctcccccctctacccacttccctaccattctacccttcagcaagaaaaaagtctaagcttcccagtagtttgggtcttccattttctggtcacaaactgctcttctaaaacagactaaagcttaggagattctattcttcaagaaatttttgttttatttaaactggtctaatggttgcccctcagtctctccatgtcctgtaaagagtaggggatcgtcacttgcttgtcaggtccataatgtcatctttcctgtttctgattttttttctctaagtgtcattctaaaaggcctccccccaggctccaactttccagaaggagaccacaagatccagtacacagtctatgacagagctgagaataagggcacttgcaaatttcgagttaaagtaagaggtaagagtactgcttattggttttgtttccccctctctttagaagagcaaagggaagtaggtcctcaagccagaactctctcaagtgcctactgtggtgggagacttgccagctttagattagtctctaataaggcttggggaagtgccctatcttaatgcctgaatttcacgatacacatccggatgggcgtcagtgttgccagattatttaaggagttcccaggactagtcttacaggatcccatagctgactgtcctagaagaatattattcaataatttttccatccctgagcttaggtggccagctgaagcctgtgaatccatctacaaccagggtgaataggagccccctaatttgggccaccaggagaacatgtttttagtgttctagtaccattggtatgaaagaaaatgtttttaaggattattttatgcctgatggtttgggcaactaattgctaaccatctttactccttactcttctggacttcacttcctcatctataacactaggggcgaaaccagttgatatcagtggtctcattggtatggatggtgaccattgcaagactcactcactgaccaaatagtcatccctcctccctcactcatttcacaggctgatgtagaagcctgattgcaaagctgatgcctctgcatcctcaccttttctgcttactctgtggatgggagctcagcactgagacccctctggacttgtgtccctacagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcaggtaggtatgccgcccctccagcctgcagcagaacctgtaaaccccttggttcttgattccagtgcaagagaggtttcccttcatatactttgagaagttcatggccatccctctttatctgagtggatgaacatagtccctagatccctgctgcagctcatctcatctgccatccatcttgcccctgcctatcctctaatttccttttcatgtcctctaaggaagaagctcaaggtaggaacctagggccagcctttggtgacattatgaatcagcaaaatttgctctagtttcctttgttctagaaatgtaaggatcttatttataaagctagtaaattgccatgtagagacaatatcatacctgctttgcatcactggcatgaaagttacatagactttgggcatttggaatctttcctcctatgtaaaatgaagaaaataatacctcatctacctcttgagttgtaaggattaaatgaggtcatctgtggaacagtggaatagagcagtgcctggtacaggcaaagccttatgccagctcttattcctgatgaagaaaaattgggctgggtaatgagtctgaaacttggactagccagaaaattatgtatgtatctcttgtttatagacttctctttttctcatttcctggcaccctttcatctttatcactttcttttaattgaagcccccatttagagttaagtgacagagagacatatataccatcagctaaatgcctgagattcttcaatttcatgtattaaagtagaaagaacacacctattatagactccctacctaaggacttcatgcccaccacctatgaggctattctgaattgagatatgctataagtgtaaaatatataccaatttcaaaatcttagtgtgaaaaagaatataaagtatcttaattttttatattgattacatgttgaaatgaaatattttggatatattgggttagataaaacataaaatcatttctacctatctctttatattttttatttgtttgtttgtttgtttgtttgagatgtagtctctctctgtcacccaggctagagtgcagtggcgcgatctcggttcactgcaacctctgcctcccgggttccagtgattctcctgccccagcctcccgagcagctgggactacaggtgcctgccaccacgcctggctaattttttgtatttttagtaaagacggggtttcaccatgttagccaggatggtcttgatctcctgacctcgtgatctgcacgcctcggcctcccaaagtgctgggattacagatgtgagacactgcgcccggtctctttacacttttttaatgaggcaactagaaaatttaagattaaatatagtggcttacattgtatttctcttgaccagagctatcctagactctgagtccctggggcagggaagagggcaggaaagagggcaggaactgtgtatcactcagtgtgacatcctagtacctagcatagagcttggcacatggcaggcactcagtatataatggctgaatgaatgaatgtgtgaatgaacaaatacttcaatgcaaacctaaaatgtgaaatatgaaaaccaagattataaatcatacatggcatctactagtttttctcttattatttcttctctggggctaagccttttgcttgcctatctatacgacatccttcattgaccttgaacagctggaattagttgtcatttatttgcttaaagggaagacctattataaaaccgccttgtcccatgtcctgtttgcctgtgttgtttgctctgtggcctttgtgccccacattgctttgtcccttctgcaccaaggaggcagacttcagagattctgagccattccaaagccagcctggccactgcccattctcttacccttctgcctctctgcacccctttccccagcagatactatggtgcttggcccatatgcctttcacattcccatctgtgttcaaaaggctacttactgcaattaactgggtctgtctgtctgagagcatttctttcctggctatgaaagcattgtcagcccatgcacagagccagctggaagtgatggagagttagtgccccagaagcagccctcagcaatgatggagcaattgtataaatactccagttccctccagtgggttaattctggaggtatgttgtatatcatctcctagagttccccagtgggagtgagttccaaatgcccacagcaaaaacttgcttgataaccaattggtattgttttctttccttcactgtctcacttcctgacatagacagaataatggtccaccaaagatgtccacatcctagtccctggaacctgagaatatgttaccttacatgaaaaaagggactttacagatgtaataagttaaggattttgaaatgggaagagtatcctgaattacccagtgggcccaatgtaatcacaagccttcttatataaaggaggcagaactgatgtcagagtcatagaaagagacgatggaaggagaggtcagagagaagagagatttgaagatgctacactgctgtctttgaagatggaggaagggactactagccaaggaatgaatgtggcctctcgatgctgaaaaagacaagaaatcagattctcccctagaacctccatgggagcatagccctgccaacaccttgattttagctccatgagaccaggatcttttagatcctgacctgcagtatctaaaagaataagtttgtattatgttaagtcactaagtttatggtgatttgttacagcagcaagaggaagtgaatatacttccgtactcctccacaggcgcttcttgggactgcctcccaaataaactgtttacacttgaatccttatctcagggtttacttcttacacaaatggttctgtgtgtcatcataggctctgttgagccagaacaagtggaaggtttctgacccatgtggccatttctgattacagccatgaacgtcaatgtgggtgtcagaacggcagctgcacttctggatcagttttatgagaaaaggagactcctcattgtgtccacacccacagcccgaaacctcctttaccggctccagctaggaatgctgcaggtgagtcctcgaggcagggccaaggtgagagggagacctttaacaggaagggcccagccatttcactaaaagcaaaggccagattcagtgcctaatgcacttacagtgagtttcaggaagtggcactttagagctaccaccattcatttctggttctgggccataacctgattaacattgactccttagagttaacccaatcgttttccaactaatgaggtttgtctgtcttcaccaataagtctaattgacatgctgtccaggcctagccacagaacaattgtctttgccaaacctgtccaggatatgcctggctggaagcaatcaattggttgcctgcccacatttttccccagggaatttctttgactcagagggtgacagccattttttcttagaaaagtggttctcaacgtgtgatccatggaccggaccagaagcatcagcatcacctgggagcttgatagacatgccaattctcagggcccctcccagacctactgtgtcagaatctacacttttaacaaaatctccaggtgattcctaagcactctaaagtttgagggtcacttttctgggaaatgtgtccttctcagctatgtaaattttgtagctactaaatgaggcaaccaacatcttgggtgtgtggggaaggctgactagaaactgtaaggatcaaactagaaattgcttgcttttgtcctgaggctggtttgcaaaagagtggccaacttcactgaatactaaagaggcaggatgtatgctgtgccatggatacagtgctgcacatttttttgagactattttattcatttattacagtggatagaactaagtgcttagaacagtattgatttaatcaaaggctacaatttacttctcatatcagcattaataaaatggataataataagtctcttttcactcttcccacgtacttgaagaattgcctatgaactctgaagagccatataaaatttttgtgagttcccttgataggaaccaaattcattgcatctttacccctggtccccaccagcttacctccccttgtatctccttgtccaagccaggggcttgctcttcagaaaacacaagcttatacctctgtcttttgtgggaaactggcattgcaggctatattccatgatcatgcatttcctcatctcttcttattccataggaaaatgaattaagccaaacaacttgcttttcctctgtgtcagcaaactatggtgacccatggctagtttcggtaaattaacttttattggacacagccacactaattcatttgtgcatgatctacaactgcttttgcactacaatgatgggtgaagtggttaggacagaggcaatccaaccttgccaagcctgaagtactctctggccctttacagagaaagattgccatcgttgctctagtctgtcccatcccttcagacacttgctaacttaacaactggttggataagatattttatatcaagatgttttggtgtgccctcctcctccaaatatacttacatttgcattttaaccagagccttcaaagaaaggtttgattgacttaggcatttcagtgagagtaatacaaaagtctatttctaactttttaaacttttcaaccagttctgtaacctcatatagggacgtttcagtggaattttggtaaaacatatttgatgttttcgtctttcaagacttcaaaatttcttttcccatttagccaaattcatcatatttgtcttacattactttttttttttttattgccattgccattcctgatgagccctcctcgtggttgactgggccacattcccaaggttcttgccaagagccagcttagaggcttggaaccttttatcctcttttcccctgggattgggtgtggagggcatagggcaggggagtgtggagagtggaaacagggcagagaagtggactctggaaatagtcttctctccttgcaaagaaaaattagaatcctctggggtggtcttggatactttttaggaaatttgactcactcaaggtctcaccctgtctggaaatacatagactgcccttttgcttaggttttcaaaatcccactgtcaagccatatctgaatgattcctctagcaaaggtatttaggttttatagccactatcttaaccccaatttctcatctgttttcaggacagttcagagtgagcaaataaacttccagagacaggccagtgctgcttctgtcggtttctagtttgataaggatgtcttttttagccatgctcatacttcccctgttgggttttctttttcccagcaagcacagtgtggccttgatcttcgacacatcaccgtggtggagctggtgggtgtgttcccgactctcattggcaggataggagcaaagattatgcctccagccctagcgctgcagctcaggtagggggaagttctgttcttaaatcttatcccctgtgaatgcatttttaactgattaggttccctggtttctttctattcaggattgagttcaggcaaccttcaatgtttaattgcttttattctgggagtgttataaccatactaatcagtatgttgctgtttgttcaaataaattgtgcagtgggtaattaccagtgttctttcttactccctccaaccaaccgtttttgcttcatgtgtgtgtatgtgtgtgtgtggttggtggaggaaggatggttaggagaggagcacctgaagaaaagacttaagcaatcatggtcttattagaagagcatgcatccaattagacttcccaggcttggtctcttttttctccatgcttccagaacacttgttcatacctttattttaacaattatattttagtttcataacccttacaaagttggagccatggattttagtctctgaataatgatgtattaaagaagcagaattcaacaaccaaaaggtaatttcagaataacccaaatttctacttgcatctcttgaccactgtgaaatcgataattaggctaaagcaaaactccttaaaatcttcctttctcacccagccttttctctcacacactgcatgggagagtacagatctctgttttcagggtcccaggctgctccctgtctctcagggcctcaggcagttacaaacatctcgaacacgtggctttcaggcttctgcaaaagtggggaaagagagtaaaaactcacactgactcctttatgcttcacgttggaggtgccacaccttgctcactctcttagttcattggccagaactagttacatgattgcaattcacttttaagggaggctgggaaatgcagtctttctgtattgccagaaagaagaaaatgaaatgggacttggtaaaccctatcacacctgttcagaaggcacagaaattccttgagaggttatatgatagaaacatatccttagcaaatgatgctatagatagacacaatagcttctttctctaatttccctgttttccagctgcctttgacccatcccatgtttgatttgtaccactttccacccaaaaagattctgccacattcctaccaaggtaaaaaaaaaaaaaaaaaaaaaaaaagaaagaaagaaagaaagaaaaaactcagagggccaggatggaagaaaaataagatgattcatgagttctctttagtcggctgatgaatggagaaggctgggtacactcatatgcttttgtttttgttatattttactgcatttgcatgtagcacctccccataccgacttcagtagcagagctttcaaatattggctactcagtacctagcacagtacctggcaccatgttggcgctaagtggagtaaatgactcaaaatttcattgaaacagccttactatttccagaggtgataatagcttttaaaagtatattgtatatctacagttagtatacaaatacttcaagttgaagtgtacaaaacttaagacagagagttgtgttgatatctaaatatttatggtgaatattttcaaagtaggttttatgaagctgttgcttatttagaactacttgctcatatcctgtgtcaatgattttttaaaacttgttgcagaattttctgaatggtctttggattgaatgtgtgtgtatgtgtgtgtgtatgtcatcttcataaaatcttgatgtgattttaaactgtttaatctacttgaagaacagaaaaatgtgattaaaaaatacttgtcattcagattgtatatattggggctaccatagacttctataggctgaagataatttttaaatacattatgtcgtggttctcaaatttttaacctccatcagaatcccctggagggcttgttaaaatacgtattgctggagtctacactgtaggctctaaactgtgtttctgattcagtaggtctctggtcgtacccgagaatttgcatttctcgtgagctcccaagagaccacatggtgaggaccactggcctagttttttaccaaagcctttacagtttgaaatagaatttttgcccagcagccttcaaggaaagggtcaatcactattttgcagctggatgatagtccaggtaaatgtcatacagaaatgatcactcaggtgcattacctaatggattctgtgtcaggccggcatgcctgtgttatcaaacatatcagtgagaaacaaagagcttggcagaactttttccctttgaattggaaaggtgttttttagacaccttggagtctagtgcagaggaaaaaagatgatttaggcaaagaatgggaagcaaaagaggagaaggaaaagcataatgcctgcataatgtaaaaattctcttgtctggctattttcaaatagcaccaaggccgtgataaaacccttgaagggagtcaacagaaagaagagactgggtgcctggggttgcagggtcaccgcctaccttctttcttaccctcatttcttttttatctggaggtatgatctgattcatgctttccagaggaattttccagcaatctcaaggaagacagggaccaagaaagccatagtttctatacccacattattctttgagtctacagtgttccctggaagactttccaggaagaactccttccaatctgacgacagacacatatgtaactcaggcatactgtcggcatcacacctcatccccgattttgtgtggtgtttgatcattcatccccaagatttctgtggtctttcggccctagtgggatgcattcctgtggctgctgctagcctgctgatccaaccactcagctcttcccatgacagttttccctctttacattctgtgtcaatgaaggcacaagacttacacaggaatgtgtatggtagcagatggtggcaccgtggtggtggtggtgggggttcccatcctagtctcacaagcactataaaaaaaatgaatgctccaatttcttattggtcaccctttcccacaggcttcagccaccacattccctattcctctgtttcctgagagctccctgtaccagaactcctccacgctcccaaaagaaaactcaatatccttccccttaaagatgcagagcattttatctcttcattcacacctttgcagcctacattcgcgtgttcagaactcattaatgcactttgcagtcatctacttctgagctcccctcttagcactgcaggaaacctggcagaggtattgtcatgtcctctttatttcatttctagtcactgggagtgaactggcaatttagctccccactgggataaaatacaaattattcccttcttcctcgaaactccctcttaaaaggcagaaaaaagtagtttgtgttctatgtaatgattttttaaccttgatctgtttgtatgaggaaaacatattttactttaaatccagatggcagtgtatattctgcctcatacataatctcaaaatatctaaactgaaaaaaaaatctggagaagagactgagtgggctcatttattcattgggctcagcttatctgtttgtttgctttctctagctattcccatctaaatatgtttgtgttgatataaaaatcatattttttagtttaaattctagtgtggtagagcagaaagaacaccagacacttgaaaccacttcatattcttttttggaattatttggggtacaaattatgattaatcaagtcagaatacatgggctgtagaccaagctcaatcccttataactctgcagtcctgagctggccactgaacaggccagaactatcatgctgggaaattatatcaatcagctttacctagcccagagtttctcagccttggcactattgctatgtgggaacagataattctttgtttggtggggacagttggctgtgcattgcaagatgtttagcagcattcctggcctctacccactaaatgccggtcacatcttcactctccactgtgacaaccaaaaatatctccagacatggccaaatttcccctgggggtggggagcaaaatcacccctgttcataatcactgactttgtcctagtgtgtatgtggtcgtgcaacactagtcagcaaacgtgggttttgggttgattccaaacttggattgattccaatttaataaaaaaaatctgttagccttgtatgcaccttgtaccaaacgttggtatgtggcaccattgtacgcctgaagtcttcctgactataatctaaaaccaaagcagtgcttttcaacctctcaggtacataccagtcatctggggatcttgatagtaatgcagacactaattcagtaggtttggggttgggcatgagagtctccatttctagcaagttctcatgtgatgctgctggttcaagggtcacagttggagtagacagggtctaaaggatgattcagtccttcattgtatcaaagctttctctgcacactgtcacagtaaggctctggttgatccaccaggacccttgggagtcatggtttgacttagtctcctcttttctttgtctgccacaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctggttgattttgtagagaaattagaacccataaccatacacaggctatcaacatgttattcaatgtgacacctaactcttttctattttgttttttaagtaagacttttattaataaaacaaaatgttttggagcaaatttagtagaactcactttgtttgtcaagcaccagccatacttgttcagtgtggtcagtggttttaggattgtgattcttagtggtgttttaagaatggaaaaaatttaattagtctttttaggagctctgctgagctgggagagagctgagctgtcaggtgttcaagtagccaattaaagccacaagctgaaaatgaaagagttaagccttcagtcacagtctaaaaccagaggaagcatcaacttcactcttccattttcccctgtgggacagcacgctggtcaagattcaagtggagcagcacagacgtggggtcatctttatattgagggagtcccgaacaaaaggctctggcagttttacggaccctggagtcatgtggtggggtaggagtggaaaagtcctgggcactgaggcagagtgaaggaaagtatcttcaaattttttcccttttccttaccccataagatctcagcagaggaacctgaagacctcttgcccaaggcctcagataaagggcctagaaatgaaggcacagggctaggaatgtaaatatgtgaaagagcatgattggccagggggtctgagtctttgactgcaacaccccacagagactgccatacgctggctgtgcaccaagtctggtgtgtggagggcagctttcccagtgaagcctgccaggtaaagtcttcgtcatcgcctatgatcaggcctgaaaaatcacacattggtttttaaccagtagccagactcctcaattctcccatgcaaatcttgaaatttttcctccatttttagaatatcagtttggttcacaatctattcctaaataaaatgactaagtgaatgatgtttcccactggtttcccactgaaaatcttgcagaacttttctgtgcaccttttggaccttatagaaacaatagataaattctaacatacagagatttaacacagaaagcagatttaacatttttttttaatattaggcagggcgattgctgaactgccaataggtttacactctatttacaaacatgattttgttcacagagcatactagaagccagtttttgacttctgtcttcttcagatgtatcagaaaggtcaatggcatggctcatagaggaatgtcaaatagtgaccaactggaaaccatgaaaagttcaataggggtgggaagagggtgaaggataaaagactacaaattgggttcagtgtacactgctcaggtgatgggtgcaccaaaatctcacaaatcaccaccaaagaacttactcatgtaaccaaatagccacctgttctccaaaaacttatggaaataaaagaaaaaaggaaaagttcaggagatcatttgttacaattaagcaagcatatatctgcctctacctttgttaaagctctcttgctttgacaagtcagcctgtgccctttgccccataccctgaaaggttcaaaccttgaagatgagctgacatttaaggaactacttggattccttcaaaccaatttacctgatgacttggaatattgcaagcacttttcccaacaagatcaacagactatttgaagatcaatgaatccactatggtattttaaaagtaaataccctgcatcaaaatttggggacatttctaaagattaattaatagcctctctctagagaaccggtttcccactggaaatcttgcagaacttttctatgtaccttttggacctaataaaaacaaacaaacaaaaaaaaaaaaacagttcctaattctgcttgcttacaatttggtactgcagaacttctacacatgtatgcaggttgtagtatacacacacacacacacacacacacacatatatatacatatatatgtgtatatatatgtgtgtgtgtatatatatatatgtatatatatatgtgtgtatgtatatatatatatgtatatatatccagatatagttgttgtctgtgggaggttagtccaatagaa

SEQ ID NO: 17598 - DNA, 50269 bp, Human
aagtataatgcaatacatgacattaatctttagtcaaaacccattgaggtgtctgacagggaaattagcaatcataagctataagatatatattattttcaaggacaaaatggcaaatgataatacagaaagacgtgatcactggagcaagttagctggtgtgcagactaagaaggatcaacttgcaaatgctcatcagaatttagcttttgttattggttgttctgcaggggatagtactagtcagttgatattgcttccctttcatgtgggagtttgctcacagcccactgcatggtataatgaaatctctataagcaagatagagtcagaagcttagagatgcactttatggtttttacaactgctgttacaatgttctaaacactgtgatctttccaaatgtgttttctgtattcgttttgtactgtagaaaataattcgctataaactggactttatagtgtttaaagcgatgttatttattggcttattgcccctccttataatacatttatgtacagtacacttaatgtaaaacctgtgataatcctttgccttaaaataaaatctaatgctaaatattcagtgtcctgattaataattctaagctaccaatttttcctttaaagctaaccatgatgtcaagtaaaacattacacaaatactctgtggagtgttgctgctgattctgtatttgtggcagtgtatgtatcttggcccaggacatggtggccttctgggttctataaatagacattagtaatccttttagggaaagggcctgctacctctcagctgctggctgaatctgccccttaactcataaatggattttctcatgccacataaaaaacagaaaaacagcccaccacattctctccctgtacctcttttttggtttgattccttttgaatctttatattctatttgtgtttacattattttcctaaatagaaaaatgccagagatgcctgaagattgaaatcacccaatttcaacaggggaagagatcttataattatttaagtctaatccctttatggaacctgagtttcagaaagatttagtgacttgatcgaggtctgagggacgggggtggactgagtacatcctgatatcaagaagatggtggaaagttcaatgggctaaaaggagttgtgttagtcttggtattggcacaccaataagcagaggtctgtcttggaataaaaaaaactacttccttattaggccctgatctttgccctgaattacttacagttacagaggaatatattttgtaggcagtttttctgggaggtaaggacaggttcctagagacgatctttgacgccttttcaccactggaagcaatgcttcagaccactgtatttggaagacaaagggacatgctcacatggcacagtgaaaagtgaaatcttttcccacttggtggtgggtgcatgacaatatacttgcactttgaaaagcctctgtgtggtctggttatttttaaaaggccagaaatgctggccctttgaagaatcacgcgtttcctcggcccagaaaatagactgggctagaaaggcgcccggactccaattctgggcccgggtggttgcagtttttcaaagggatgtgaacggtttcccaagataggacccaagggactctaggacccagaggctgcgcgcgacgcccgcagggcgaactgcatccttttgagctcccgctccatggcctgagccgtcgtagggcgcgggttcgcggcccgccaggggacggtcaccacagagacgcagccggcactggcgagcgagcgagcaggcggcgcacggagcgcgtgggcgtgtcccggcggggctgcgcagctcgccccaccccaccccaccccagccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgcgtgcagaagcccagagccagccccaggccgcagcctcggtcctgtagcctgatctccccacctgctcgagtggagggaggcggttttcctgtggagacaggtggctgagccccaagccggtccgccatgcccctcagccccattattccagtcaggaacgcgacgaatcatggcataatggttataaagttggggcacactgaattcctgttaggttccgtcaaatgaaatagccaacattcaactgaaattgaccaacaaaaatggcagtttcttgtggttcaacctcattaaagacattggtttctctggggtcaagtaggctctgacaggattggcttgtgttgtcacaaacccttgggaagtgtgttctaagctgtggttacggggacagcatgtacaggtgatttaattttaatttatcaaacacatggagcttactgtgtgccaagcactgttctaaaagctttaacagtatttaattctcatagggaagtcaagaaatccatgcaccattcttttctcttggtggcgttacgaatattatgggatatggaaacatatggggttctagaaatgtcttccggccctggcaaacttataaacgtagccattaaagctggtgcacaatgcaccatgaaaacaaaacttgctgtgtgttaagtaaagaaaaactgttggtgacatttctggaaattaatttttattaacacaaagcaagtagaaatacatggtaataaaacagactggcttatctaaggagtttaaaatgtgttgttttagtacctttcatcactataggaaaagcaaaacaaaggccgtccatttggattagaaataagtttataatactgaattttagacataggcgacagaggaatttgaagagatggaaaggccagagagacacctcagctgccagaaaattcagctagccctaccaggaaatctctctctctctctctctctttctctctctctcttacacacacacacacacacacacacacacacacgcacacacacacattgaggagcaagataaattttacaaagttataatttttttttttttgagacaaggtcttgctttatcagccaggctggagtgcagtagcaagatcatagctcattgcatcctccacctcctgggcacaagtgatactcctgcctcagtctccagagtagctaggactgcaggcaagcgccatcatgcctggctaattttcttttttctttctttttttttgtattttttgtagagacagagtctccctatgttgcccaggctggtctcgagctcttgagttccagtgatcctcctgtctgggcctcctaaagttctctctatgttgcccagtatggtctggaactcctgagctgaaatgatcctcctgcccaggcctcccaaagtgctggaattacaggcatgagctaccacgcctggccataaaatttttgcacctcatattaaagaaaactgttccagctgacacacaaactactgacttgtagtttgcacacagtcacagcaaacttggtgaacaaatttctcagcctccagaagctgcagaatcctagaaaggaaaataaacaggtacactggcaggagtgggaggttgctgctgacttcttgatagctggggaagagtctggggaaaaagaaagggagggaggggaattttaaaagtcctgcaacctggagccatttagtgaggagagagttagtccttcctagccaggtaagccctgtggtctggactgtattcttgctcagtaaaataagtgtgatctgactttgggcagggcacttatcatttctttctttctttctttctttctttctttctttttttttttttttttttgagacggagtcttgctctgtcgcccaggctggagtgcagtggcgcgatctcagctcactgcaagctccgcttcccaggttcacgccattcttctgcctcagcctcctgagtagctgggactacaggcgcccgccaccacgcccggctaattttatttttttgtatttttagtagagacggggtttcaccgtgccagccaggatggtctcaatctcttgacctcgtgatccgcctgcctcggcctcccaaagtgctgggaccacaagcgtgagccaccgtgcccggccttatcatttcttaacattatctgtgagaagaaaacagataatgtttaagtggagtaacaggaaaaaggggaactgacatttctcaaaagcttcttgtgctagatggtttgatatgtacttacatgcctcaattcattgaatcctcaccatgacatagacgtaattgtccccattttgtaggtgaagaaaatgaggcctcagactatgttctcaagcctccttaaaaagagctaattatattccctatgctcagtggaagaaagcagaggactgtgtagtacattctattagtagttccattttaaattaagaaaaagtttggtcatcttggcaatccaataaatgataataccctatcattgctgccatttaaagtgtttctaaacacgaagagtaacccaagacaaagctaatgacataatatatataaaaacaggatgacaagtataaacctgaactcaaggaaacataccaagatgttaagaataataatttctgaatagtggggttatgagtgataatatcctggaaaatatataaaactatataataaaacaattatctacttttctatatttttcagtttttaccataaaaatattttaactttattaaggaaagaaaacttttggtgctttgaagagataacttctcagctatatataaagtttcaacactataaaaagacctatttccagaaagttctgaatgggccattgtcttcttggagcaaaaacaaaataaaagataaaaaacaaaacaacaggcaaaccccttccatcaacaaggagtcactgattctaatgcagctgatttatttcaaggagttattggacccatgaccttagagctgagatacaaaatgtggttccaagtctcttagcttccagattaaaagaaaagcagtttgttcttgtgtattagcctgacttaatatcttactggaatttcttcctgctgactgtttgattctgttttaactctaagacatcagctttacataaagataaaaattatttccctcaaacaaaggagaggcatggtgattcttacccccttccttatggattggatttaataatatttctaaattgttttttgacagtttaactcttcttgcctttggatgagtactagccaaactcgtgtttttgctaggtagatgctgcgtttgagttcatgcagcacgatggcccagttaaactgcaatacattacactaatgattctggactaaatactactaactaggctttgctccttctttcctttagggaggcatagggagagcaccatatttcatttgtatcagtcttgtatttaaaatggtagttacagtttttatgattgttttcacattaagcctgagtttgaatgatacgaactttggataatgccttgaatttatttataattttaaggaaaatcttattgcgcattataatagatactctagcaaaccagagcagggaaaagatctcttacctaaaacacaaaaacattttaaaaattctgtttatcattcttttacatttatgctaatttttataaattaattgggaggaataaatataaatgagttacaatttcaaggaattcccctcatttcttttttattactggtatagtgaggaaaaaatggtacatgaaaaatctgagcttataaaataaaggctaagaagttcccgaaacctttccagaacattgcaaaatgattcaccatagtatatctttctatattaaactttataaagaatttaaaatattaatagtctacatttgaagagaatttttttttcatttgcaaggtgcttttacatacagtatttaatttcatccatggtaaaaccctgtgagttaactgtcattatcttatttttacagtccaggaattgaggttcagtgagattaagcaagtggcttttcaaaggttttgcagcattttctatttaaccaatttgggttttgtgtaggcttacagagcatgtgtgtcatgtgaagataatgtggcttattggaaattatagtatttctttggaaaaagtattttaattagggtctctggtaccacagattatttatgctcacatcagcatgcatgatttcagctaaggaataagctccttctgctatgatacttgaaaagtgggatatatgatgcttgaaaatgggataaagtaaaaaataaggatcaacctactgattatctacattggggttagcaaactgtaccccacaggcctaatacccccatcacctgttttagtaggtaaagtcttattggaacacagcgttgctcactggtttatgtactggctacaactgctttcacattgcagagacagacttgagcagttgcaacagagaccatggcgtgtgaatcataaaatatttacttttttataaatacttcacagaaaatttgctgtcccttggtgtagatgatactgaaaaactaccttgagtattcagttttgataaaagtatctaatttctggctttatttagacctctcaagcaacaaacaaataaaaaaccaaaaaataagaacagattttgagtaattagatgagtcttgcagaattccaagaatagtagtttgtttcttatcagttttcctaaccaacagtggcaggaggtcttggggccttttacaaatgtattaaacacctatgactacatgtaaaactctatgctaatacaaatgtatcacctgggaaaaaacagtggcttacaagaggttccgcctgagctttaggaccttctttcatttccatcaactgatcatggaagttttactttgtctacaattctgcagaaagcttccagtttcatatagccccttccttcgcatcaagaaaattactttctcctctgaaccctcatttcgttcattcagttcttagcatatgctggtatttaatttgtatgttttagtctttcaaaactctaagcttgattttattatgcaagtaaaacattttttgaaatgacagaagagcagaaaacagatttgcacaatgaggaaaataaaagctctcatttgactgctcagacagaacaattcctaatgtttttgttgtatatctttactaatatttttataatggtatgctagtaaactgttggggaaaacaagccctgattttcagtgtttgctgatttctcaaatgcgtatattctcatcatgattgatcaagctaccagttgtttaacaactggctcacaaaattcctattttaacagtctgctctcttgagtcagtatgagccagctcaaacatttcactgtttatatgtatgtgtgggtatgtgtgtgtaatctgtatatattttttatatatgtgattttctttttacaaaaaatggaatttaaaatatatgattctattgtaatttgcttctttcacataccaaatatggtaaaaatacgtagcctggtcaacatagtgagactgtttcctcacaaaaaataaaattagctgggcacagtggcatgcatctggagtcccagctacttaggaggctcaggagtgagggtcccttgaggccagcagttggaggctgcagtgagctatgatcacaccactgccctccaacgttggtgagagagtgagactgtcttttaaaaaaaatttatatattggtatatgtacttctataccattgatgttaaggaatgtataatgtttcattgaattgatatattagggtttatttaattattctttcatttttgggacctttagagtattcccagcattttgctattatacataatgctatgatttaaattgttgcaatacgttttcttctaagtgagatcatacgtgataacatgtcataactaaaagtgctatataaatattaattttcgtttattattattattattgtgcatatgtcccactatcccatttagattgtgagtgcccccaaatgaggcaggggtatccagctgtctgcattccccacagcacttagtaaaccacacccgcattcatctcatatttgagaataaagatgattatcagtttattctgtttttgttttgttttagtttgtttttttgagacagagtctcgctctgtcacccaggctggagtgcagtggcgcaatcttcgcctcttgtgttcaagcaattctcctgcctcagcctcccgagtaggtgagactacaagggtgcaccaccatgcctggctaattttttaatttttagtagagatgtggtttcaccatgttggccagactgatctcaaactcctgacctcaggtgatccgcctgcctcagcctcccaaagtgctgggattacaggcgtgagccactgcccccggccagttcattctgttttctaatctttgatgtgatcagtggtccaacagtgtaaagttgctaggcctcatacagtcctcagtcattaatttgagttttccttcagagaaaattcaattggacgtgcttgggattgaactcatggcctgaacttcattgacattatttccaactgaaaaaactggtctgtgtggttttacattgttttcatgtaatatattaaagtgttcttgaccccatgggacaaaatgtcgtacacaaatcaacccccccccacacacacacccacacacaccatacaccttctttctcctagcaacaaatgaacaatggtattaatcacaaaatatgtccactttgagctcaccagaaaggttcctgcatttcctctcttacatcaagctttattttattatttcaaattataaatacattccagttgccgtagtcacctcaggatgagagtataaagttaacattataacataaacattcaatgaaatagattaagccattaaaatcttctggcagcatcataaggttgttataaaagtgcatgttagaggagggacaaaaagtcctttaacaagttacaaacctacggccatgaatatttttcttactcctagggaaaacacatttttaaccagcattttattatgaaaattttcaaacacacagaagacaagtttaaggaattctatagtgaacacccaagtactcaccacctagattctacaattaacattttgtttcacatatttatccatctatcaattcgtgtgtgtgtgtgtgtgtgtgtgtgtgtgtgtgtgtgtgtgtatgtacttcaaagttaatcacagacatcagtattcttcccacttcagcatccatatttttacctagagaggaaatccaaattttaaaagccaggtattctctcagtctggaaaagtcactgattaagtctgggactgactttagtcccgccctgtaaggacttatgaaaacagagataggtaacatgttgtggtctcccagtgaaatgctagatggcaagctgccctgtgctggacgatttccgagccatagcttctgctttaactggggtggtttggggcatcttttggatgtggaacacacacacgtgtgtgcgtgcatgcatgcatgcagtcacactatataatcaccatttttcacagcaatatgacaaagtgggtattatatctgctttatagtggagggaatgtgctggggtggggatagtaggtgactcggctatggctacacagctagtatgtgtcaggaagggaaactgcacattttttctgtggctctggagccggaaccactttccattctctaagagatttccttgcttcagtggcctttggtattacctcttcatttggttctcattcaattcccattggcctgctggaaagcatcaagaggactgcatactgagaactggtccttggagtagttgatttagaagagtgactatagttcagagtagccaagtcaaggctttaagaatcaggctaaaggtaagtaggatgagcatggaaagtcagaatcctgtctgtctctaattattatgatttcctgatttgttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtacgtgtattttttatttctgcctgcatttggggatcaaaatgagaagcaaaatatgcagtttattttgtttcaaaggaaatttgttcttaagtgcacttaattctgaatctgtgttctagttactatgctcaaaactcaattaaaataacaacgtttattttgcttatgactctgcattctaggcagggctcaaaagggttacctaatctgtgatccactgtggatcagctagggtggctcaaaggtagggggctagaatctattcaaggccccttcactcacatgtcttgttgttcacatgttttgatattggctgttgctgggagtttcagatcttctccatttgatttctctgtgtgggtgagtttgggcttccttatagcatggtagctgcttccaagggtgagtgttctaagaaggagggaaggccagatggaagccacatcagcttttgtgatccaggcttgggagttgtgggacatcacttctgcttccttctcattgttgaaatacttacagagttctgcccagattcaagggagaggagagggaagcaaactctgactcttgttgtggaatggtagagttctagaagatcacctgggaccaaaaataccactgtggccatttttagaaaatacagtttaccagaggctgaaaacacagctactggaggctgcttctcttgggatttcactctgtctttcagtgctagttctaaactagttgagacagttggcttaacaactttgtggtgaataatggaacaaggccactttcctgtcttcttagacttgtaataggtatatcagtttataagtcaagacaatattctacctttgggctattctcacatcatcaaattaagagcagattttggttaagttaaaaaaaaaaaacactatttgcatcagagtcaagattttaatgaaaagcctacaaatgagaagtggaaacaaccccctcccaagtattaatattatgggtaaacgaaaaccattatggtaagttttattatcggtatacaaaatgatttaaaagccgtaagttgaaaaaatacatgtttaagaaaacattgaagataagaaagactcttatttattttacttcactcagttttatcctctttctgcctatgttttagactggctagtaataattcatgtcagagtcacaggatacttacatgttagagccatctcccttatccaggttgcctgattatgattcttaaaatatgagtcaggatcttaagtagagatcttgaaccttaatggatcaacatttatatgtaaatactttccgcaacacctggtagggagtaaaagctcaataaatatagcaacatccgtgttctctaaggaattataactggaatgggtcttgaccaagctgcatgccactatactctttttcctagtttattgtttttccaagtggcagggatacagcaagaaatcagatgtgatgatagcctatttgatttttagaggtagatccaatttttttcctcaagtttttttagtgaagattgtctcacagttgaagggttggcaaactacatcccatgggcctaatctgggcactgcccgtttttgtcaataaagttctattggaatgcagccctgctctttcatttatgtattgtctgtgactgttttgggactaaaacaacagagtcgagtagttgcaataaacataatgtggcccacaaagcctaaaatatttactaactttttacaaagaaagtttgccaacccttgttataatttttcagacataattctgttcaggaaaaataaaatctgtcttgtaaaatgtcagtgtcacaagggatatctgaaatgtcccaaaagaacttggaaaaacagaagtcctctgagagttaaatgataaatcaaatagatatggaaaaaggaagtgggcatggtcttgttaaaaagatagatggctgccatttatgcaggtcttgactaaccccaatcactgccttaacatatataaggagggaatatctcacccggaaagggtaagacccttatgaatggagcatggtctagggtgtgccacaaaggcaaatgttggtagtgtctgtcatgtggttagaaatgcatttggtgcaaggaagaaacacctaactgtaaagttaacctagagtttatttttcttatctaactggaaattggaagtagacagttgctgacagtatttcagctgctcaatagtggcaaagttgatgtccctgccaatccattggccttttgcttgggttgctactgcatttccaaccatcatagctacattcaaaataggaagaagggctgaagaaggaagggtagatatatttctctttttattaatgaatatagctttttcataaatttccctaatagactttactttgtcttcctccttttattaaaaactatagcttttccagaaatctccctaacagaaatgactttaggtctctgaccagaactgatcagtcatttagcttaaagggatgctaggaaagccaggtctaggaatgtttgccaccaatggcttagactaatattcctcaaacttccctgatgatgatgattagagttacctgggggcttgttaaatatatagattaccaggattcatctctggaaattgtgatttgctgtgtctgggatgggagccaaggttatgtgttttctttttatttcccttttgttatttaaacaagggctccaggtgattttattatcagcaaagtttgagaacattggattagactagtcatggcctgcgtgtggttgggcccattgccacccataacaaaaccatgttctcttaagatagtgagaggaatggaaaatgaataggcaactgacagtgtctgccacatcatctaaatgcagtccagatgaatagaaatgtgtccctcttgacagaaggacatagagtccatcacaacatgaccctattcagcattcaaattctgtaactctctcctctctctctgattctgtgctcattgagcaaacattgatggatttggcattagcagagtttgccatgagggagagaagggagagccagctacatggtcactggagagttattgtttttcttcattgcaatataattcatataacataaatttcactactttgggtgtacaattcagtaggtttcaatatattgacaatgttatacaatcaccaccactgtctagttttagaacattttcatcacaccaaaaataagtcccctattcattaacagtcactcttcatttcccctgcccctagcccctggcagcctactaatctacttcctgtctctatggatttgactattatgaatctttcatatcagtggaatcatatgctattgggaagttttctttctcatagtcagtgaataacggacactgtgtctgtgagcttcagtcttgggtgaatttgggcatcctgagattccctgagtctaatcagttctcagcaagggcttgctcaagtctccagatcttggaggatgggttgggttgaagcctaagtgagcataccaatgttactgtgctttgtgaaggcccctgcagcctgccatttggcttgcctggccctcacagtgcccttctctattctactcaaggtggtaatgttggtagtaaaaatggctgtttcatgaacccttgatttgtgccaggcactgtgataggcatccttgtgtttcattttcagtgtccctgaggtagataatattatctccatcttagtaaagagggaaattgagccagacacagtggctcacacctgtgatcctagcactttaggaagccaaggtgggcaaatcgcttgaccccaggagtttgagaccaccctgagcaacatggcgagaccccatctctacaaaaaatacaaaaattagcagggagtggtggtgcatgcctgtggtcccagctacttgggaggataaggcgggaggattgcttgagcctgggaggaccttgcctcaaaaaaaaaaaaaaaaaaaaaaaaaagaggaggaaaattgtacttatagtcagatagaggagccagaatttgaggttagatttgtgtgactttatttatggactcaatgagtatttcttgggtatgttctgtgtttcagaccctgtgctggtctctgaggataaagtggtgaataaggtaggcaggccccaatcatcttcaaataggatatataaacatcacacaaattattaatcaaatgcatattttatttaaggtaaatcctgcaaagtgaaagataagtagcctctctgagggtatattgggggttgtctaaccgagtctgggaaatgaggcaaatgtttccaaaacttagatttaaactgaaaactgctagatgaagaaaagaagccaggtgaagaaaaatcaggaaagagcatcccaggatttcaagctttattccagaggcaatgggaaggcactgatgagttttaagcaacaagtgtcatgatcaaatttagttttagaaactgattactctgcaaaatgtatttgaagagagtgaagaaacaaatggagaggctaggaagtgggctactatagttgtcaaggtgagaataatggcctggactggaatagtcagagtggattattggagcaatattaagaatgcgtaagtggaacaatgtgatgattgattggatatgaaggtgaggcagtgagagatgtcaagaataattcccagttcctgatatggactgctgtagccatggatctccatttgtcttggtagtgacaggtttgcgaggtatattttactttcagttccagacttaaagaaatgaatacattttaaagattctatttaactcatgagagaacaagcagatgttctcttcggaccagcttataagataacccaaaggacagacataggaatattgactagagatatcaaaatgaatatgtaaatggaagtaaaactggttttattacagcatgggggggtgacatttgaacctctactgtacaagacattgagcatgtctgttagtgacttatagcttacagaagaatgtaaatgagctcactggcaatacaaagctagaatcagagaacctggattggtatactgaagacaggacaatgttttgattgaaacacattttttttgttgttgctagaatgtttaagtcaagtacaaagttagactttcctcaaaaagacggtccagttattagggtgagcaggttcctgtcagaaacattttgaggccgggcttgatcagggctcagtgaacaccaataatatcacaaagttgaggttgtcttgaaggcagctccctgaccaaggagggcctggagcacagtgggcgggaataagcactggtacctggagaggctcaggctagtgggaaaatcgacgagggctgatcaaaacaaaactcaccaagaccatgtgaaggcaaaaaggagccttagaaaggagattcttccctgctccacaaaagcctagctgcagtttcctgttagccacatggacggctttctgcgaggtcagtatgcccagtgcctgagctcatccacacctgttttcctggttgttattctctagtatctgatggccaacatcctggagcaggcaggcaagaaggcccagaacaattgcagggtgcgcatcacaccagaacacatagagagggccatgcacaaggataagcagctcagatgcctcttggaggatgtacccaccatcaggttgatgaggtgccccagcccgagaaggagggatgcttgggtctgagaacctggcaggacttcatcaacaatttcatccagcctcaaaaattcccatagatgagagaccccaggctgctgccatcagcccatgctattaaagtctttaatgacagtgcccctgacttctctcaggttctctcattttgggttggaggtgtccttgagacatccaggagaagctatcccatagagagctgaatgggtggaaggtgttgccagtgtggggtgtttgaatcagtgattttagaaggggcagtttccagtggttggtgagagcactggccctggcgggaggagctgactggggataaagatatagagacttcctcattggctttgaactggaaggccttgtgaggccaggtagttgctgggagcctcctaggcttgataaattcctaacctgatgctgggacctagggtggagctgcagactctgactgaggtgcgggaggctttattcagaatagcaaaggtctgaagtcagagggcagtagccacagggatgggtggagagggggcacactgcatactagctggcatgaacttcatgggacaggctttacatggagattgaggagtgatggggaaaacataaggaaaaaatgcaaaaaaaaaagttatggtcatgttattttatttatttatttgtaccctgcctcattccaaaagaggacttgagacagggattagtaactggtactatgacacattgtttggaatatattcttctgtcctcttgtggacactgttaaattaagtagtaacattatataaaagctctctggcctaggacatgcaatccaatcagttcttaatggttacaaaatattacaaaacttatttgtaaatgtattccattataaacacaattatcaatcgcattcccagaaaaaataatctgtgtatgatcatgtatttcatagaacagcatagagttatcaatggccaaaaacaggttcaaaaggtatagaaataacctatgtaattctgtcttgagtgatggcctctaaagcatgtactgtacttttaaaaacttgtgctctgtactgtttaaaaaaggtgtcacatcaagtgttgtagcaatctgtccccttgcctgtgaatgtccatattttaggttttcacctgttccttggatcctctgtggccacattctgctgcctgttggccagatgctgcccagccagattcaataacagatcagacaacctgggtttgagatcctagttcaccactttctggccatgtgatcttggactttcatttactcctgctgggcaggtttgctcatgtgtaaaatagcagagagtccctctatctttagttttcccaaagattgagtccactttggatatgcacagtgtggcccttaataagcagctgcatctgtctcctcccctaaccccagacacgcaggcaggcttccccagggtacatctgggtctggttctcaggttactgttgggcacttgggccactggctgtgagagtgacatcctgctgagccctatggagagacaggagagtgcccagcagaggaaggagacagcggaagagggacacgagccaggcagtccccactctggtgtccctttttctcctcctgccttgtgactcgccctctctctgcctctgtctaagcagaaggacccagcttggcctttggctaattcacaggagtgtcctgagaatgaaggaaatagcggttatgtgtttaaaaactgggctgtgagaaacccatgtcctggacacaaagatgtttcacttcggccaggggagggggtgctgctgttgccatgaagtgatgagctgaaggagactccccacctgaagctgctggagagaggcctgcttgcagctcaaatgcacagaagaggaagcgagcagctgggctaaggctgggagtgctccacggcgctccctaaggaatcatgcagtggtggggtgggcagcttgacaatgaggtgcctggaaatatgaggttcagtggacatgatatggcaagaaagacttctgggatttagacaagcacatcttccacatggccctaaggacaaccctgacagtactaatctctaatatattatttcctaaagcgcagtctacaaagtggcatcttacaactcaatctggatggcagataggtttgctagttctaagcagacatcttaaaagaaaattaatgagctggtagcatttgaaaatcaataacattttacctgaaagtctggatttctggctctcttgagaagtaaaaaggagggtacacatgattacagtcacatagagatgactagctactgcaccatgaagactgggcctctggtttgccacattccttccacactcttccctataaagtcccatatctgattcacttcattaatttatagtagttgtctgattaatagagatacttgagtttgttactctcactacaagttaattctaagttcacagtactcagaacaatcaatctcatttaatgaagtagtatattgtgcattgcttctcaaaatatcattggggtaggaccagtagtagcaaacttccttgtttttcttgttccagtaaattgtgaactgatatgtggttgtattactagtatgccactcatatttgacttgtcatttgagtttaacaactgcactggtatataccttgttcaaaaagtgagcccactaatttaaatgttgtggctaaatcagatgctatacagattcctaaatgccagctctcaatgtccatacttatcataactgactggtaacagatatttcattgtaccagtcctcaaactttttagatttagatttagattttaaatctaatgaaaagcagtaaacaggacctacagttggtattgtttctccttcagagtcttcatgaaaacagatttatccttcttatatttaggactttagcataatactggtgaaaatgttgctgaactacttctgttaaagcaaaagatattaaggaaaccaattagcatcagtggggcatgttagatgcggcagatgtgagattgttgagttctgaaatgtaggataaaaagaattcaccaaggcaactgtgaaagggagtcttcatgaaaggagaggcagaactgggttctggtctcctacagtgtagtttacttggggacccatcagtttccagtgagaaaaatggaaaaattatttcaaaactcagctagagatgtgtacttatgactgtgctcttttcctaacaaaatagttctatggaaaatgggtaaatagggttcagagtacagggtctccattttacagctgaggccactgaggcccagtgatagtaatcagctcttataaagtcacatggtgagtgggcagcacagtagaatgatggcctggccttccttacctgttattggggctctttcctctattgtatcctgaaaaaggggtctcaaaagagaaagtgtttaatgttctcctctgagaaaaagaagctaaagtcttcaataccaaggtgttagggtctcttggatttcttgggaagcactcaataactcactcccaagaatattcacttgtgctttatttgggtaaggccagacaggtcaggagaaaagtgctgattttatagtataggtctttggactttgcaaacttagattttgttccactggacattgtattaaactgtgttatgaacacaaatttgtctcagttaaggtgttctggaaattctgactctgtccactaaccattatcttaaatgtggtgatgtgatgtcatgagaagcctgtgttcaggagcctagtctttgaagtacctgaggtagtgacgtttttcatggtgctctaagacaatccttctttgctgaagacaaaatctccctcctgtagctgattgtagggtcattagggaaacatcagtgtaaataaaaaactatctggagagccaggcatgctggctcatgcctgtaatcccagcaacttagaaggttgaggcaagaggaacttttgaggccaggagttcaagaccaccctgggcaacatagtgagacctccgtctctacaaaaatattttaaaaattagctggatgtggtggtatataactgtagtctcagctacatgggaagctgagctgggagaatctcttgagccaaggagttctgagctgcagtgagctacgattgcaccactgcactctagcctgggccacaaaatgagaccacaattcttaaaaaaaaaagtatcagccgggcgtggtggctcacgcctgtaatcccagcactttgggaggccaaggcaggtggatagcctgaggtcaggagttcaagaccagcttgaccaacatgatgaaaccctgtctctactaaaaatacaaaattagctgggcttggtggtgcatgcctgtaatctcagctactcgggaggctgaggcaggagaatcgcttgaaccctggaggtggaggtggcagtgggccgaggtcacgccattgcactccagcctgggcaacaagaatgaaactccgtctcaaaagaaaaaaagtatctggagatgatagacacttaaagtgcctgtggttcacttatgacttgtgataaagtgaaaagtctagtggaagtacataacaaacataatacaactgaagaagaaattgtgacatacaaaataagataataaagccaatgtaaaaaagttttgaacaaaacatatgtaagcataatgattaatcctattttgaagtaagtctacagtagattctagacatctgtattttactatacctccataaaaagatttgatgtgtatcctcaatttaaaaagccatgagggaagatgcttcataaaacttaaaagagaagccaggcgtggtagctcacgcctgtaatcccagcactttggggggccaaggcgggcggatcacgaggtcaggagatcaagaccatcctggctaacatggtgaaaccccgtctctactaaaaatacaaaaaaaaaaaaattagccgggcgtggtggcgggcgcctgtagtcccagctacttgggaggctgaggcaggagaatggcgtgaacccgggaggtggagcttgcagtgagccgagctcgcgccactggactccagcctgggtgaaagagcgagactctgtctcaaaaaaaaaaaaaataacttaaaagagaaagttgtgactagatagttttagaaatctactgaaatgatgactgttaacactataattttattgcctaatattatgaaggaaagcaccagcaggactatgatcattagaaacatactatggacagtgggggcactgacaaatctctaggaacttctcatacaatctagaacttctgaaatatttatactaataatatatttcatattcagatttaatctagggaaggctgagtacctcttttctttttttctttttctttttctttctttctttctttctttttttttttgagacagggtctcactctgtcacccaggatggagtgcagtggtgcaatcatggctcaccgtagcctcaaactcctgggctcaagccatcctccccactgagcctcccaagtaggtgggaatacaggtgcacactaccatgcctggctgatttttttttttttttgagacaggatctaacttatgttgcccaggctgaagaacacctcttttgattttatttttttccatgcaactcatcaatactaacagcaacaaagctaattttatctaatatctgtctttttataaggtgaaagaacaaatctttcctattttctaggtactctgttggaaatctcaaagataagtctaagtgtaaaagatttatagagtttcattttatttcatttaaaattttgaattttattttgaaaggcaaaattgctagaagatttgagaattaagttaggatcatgagtgactgagtacatgaatggttgtagcttggctatctattaattaaagtgacagtacaatgtttagataaacatccaaaagaccttgacacattcttaatgcaaattttttttgtttttgaagagaataatcaagggcatgataaagtcagggaaaaaaagtgttattgtggtaagatgccaaatccctacttttaggataggattacataggtaatattttaggctaaattatgaccccaaagatattcaggttctactccctgaaacctgtgtatgtcactttatatctgcaaagggaactttgcagataaagagattgaggttgggagattattgtattgtaggtcgtgcaggtgggcccaggacaaatgttctttttttttaaaattaattaattaattaattttattttattttatttttattgatcattcttgggtgtttctcgcagagggggatttggcagggtcataggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccccccttaatccatttaaccctgagtggacacagcacatgtttcagagagcacagggttgggggtaaggtcatagaccaacagcatcccaaggcagaagaatttttcttagtacagaacaaaatgaagtctcccatgtctacttctttctacacagacacagcaaccatccgatttctctatcttttccccacctttcccccttttctattccacaaaaccgccattgtcatcatggcccgttctcaatgagctgttgggtacacctcccagacggggtggtggccgggcagaggggctcctcacttcccagaaggggcggccgggcagaggtgacccccacctcccggacggggcggctggccgggcgggggctgaccccccacctccctcccagacggggcggctggcctggcgggggctgacccccacctccctcccggacggggtggctgccgggcggagatgctcctcacttcccagacggggtggctgcgggtggaggggctcctcacttctcagacagggtggctgccgggcgcaggggctcctcacttctcagacggggcggctgccgggcgcaggggctcctcacttctcagacggggcggctgccgggcggaagggctcctcacttctcagacggggcggctgccgggcggaggggctcctcacttctcagacggggcggccgggcagagatgctcctcacctctcagacggggcagcggggcagagccgctccccacatctcagacaatgggcggccgggcagagacgctcctcacttcctagatgggatggcggccgggaagaggcgctcctcacttctcagagtgggcagccaggcagaggggctcctcacatcccagatgatgggcggccaggcagagacgctcctcacttcccagatggggtggcagccgggcagaggctgcaatctcggcactttgggaggccaaggcaggcggctgggaggtggaggttgtagcaagccaagatcacgccaccgcactccagcctgggcaccattgagcactgagtgaacgagactccgtctgcaatcccggcccctcgggaggccaaggctggcggatcactcgcagttaggagctggagaccagcccgggccaacacagcgaaaccccatctccaccaaaaaaatacgaaaaccagtcaggcgtggcggcgggcgcctgcaatctcaggcactcggcaggctgaggcagtagaatcaggcagggaggttgcagtgagccgagatggcagcagtacagtccagcttcggctcggcatcagagggagactgtggaaagagagggagagggagaccgtggggagagggagagggagagggcaaatgttcttataagggagaggcagcagcaggcttgatcacggaggaagaagacaatgtgaggagtgaaacaagatgctgcactgctggctttgaagatggagggaagaggcaggagccaaggaatgcagttgtagaagctggaaaaggcaagaaaatggattctctccttgatcctctggagggaacatgcccctgttgacaccttgacttcagcccagccaaactgatttcagacttctgatctccagaactgtaagacaacaaacatttgttgttttaagccactgtgtttgtggtaatatgttatggcagtcataggaaacaaatttacgccaaaagtaatcttttacaacctcttattaagaacagaccagtactccaagaaaactcattttcacagaaaaactaattctagatttgtttcaatgaaatatttgcttctaaataacccactatttacttttgacagtctcacaaataaacccatcaatactgagccagatttggcaaaatgttaacacaaaattgtgttcctttccagactctttctgcaaacctcctacaactttctttattcattcaggttttatccttcaccattcttcctcattcctatcctggaacaagtcatttttctttagaacagaaatatacttttttgcccataataaaaatttcattatcttgagattcctagtaatctcattcacatgtattaattataacttttaagcagccccttgtatttcacaaagaaaatgaaggagtagataattgtgaatttctgtcattttagcagcctagccaatctcatgaatatacttcactgagctttatccagccacatacttcccttatttaattccacagtgtggcagaaatgaacatgttcatttacagacccaaagatagagcctctttgtagcatgtacaaataacaagcaatagtgtataaatgaaaactgtacttactaataaatttttcagtattctatcttacttagaaatgatctagaaagccagtgaatggccaagatcttcagttatctaaagattttggaaatgctcttcagggtaacatactacacaacctcattactatggaactataaatttatcagaacaatgattcaagttgcttaaaaatagatttaagtttttaaattattttaaatatttaacaggagtaagtctagctcatttgatcaaaaagctgtataagtttaggagaaacatactcaagagtataaaaatatatgcttgtattaaatatgacactgataaatcagagatgtttacattaaactcaaagtcttaaactagtcttatttgccaaagagttacataaattatagaagtctgaattcttaaaatggttttgagttggtttctaggataatacattttttaaactagcacatttaaaaatcaatagtacaatttccgtattttaggaaattctagttatattcaatttatataagcagttatttttctggatatgccaatcagaatagaactcttttaatttgggagagtttataatctaatatattagtactgtgcataggtaggaaaacattacacactcgtacaatcagaggtgaggatattacagacatatagacatacagatagagagaaatagagtttgtagcttcaattcttcaatttcaggcatggatcaagagtgaacacaaaatcagaaaatctcctcagtccagattttaatagctcttttcctctcaaagggcatgaaattcttaagtgatttgagcttagaaaaataaactaacaaaaaggatgacaaaccagactttctgttgcctgtcacccaatagggactagatttctgtaaaccatggatgcacttagatctccagattgttagaccttaaaattggatttcaaaccatttctctcaataagggggagtaacttaatggctttaagtgaaccagaacaaaacagaaacacaaaatttgtagagagaggatttcaaatgagaagtcgagggtgtcaacaaagctctactggtgctctggattcacctatgagagcgaagaaaggacatgcttaggctttaactgctcatgaggtgcacttccttgtcagcaatgtttacctgactcttacaggtgaatctattggacatctcattatgacttccaaagttgttaaaatatatttttcaaaagggtaaaattatgttgctcatacagatgtgaacctgttgttgtttacttgtaaggaaatgaacagatgttatggccgggcgtggtggctcacacctgtaatctcagcactctgggaggctgaggtgggtggattacctgaggtcaggagttcgagaccagcctggctaacatggtgaaacctccgtctctactaaaaatacaaaataaataaataaattaaataaaagagaaccaacaaaggattgtttagagatatcaaaataagtatgtaattggaaacaaaacttcttgtatgacattttgagagggaagacagttgaacctgtattgaacaatgcattttgcagtatgtatcggtgacttgtcagatagcctatatcctggagttgaaaaataataagaccagcaacaacaacaggagttacatcgccccacagaatgtggaaatgccggtgcacaggcctgagtgccaccgattctttaggggtgggacagtcagtctaattgacatgtcccaattcaagaagaattgctgatgcctgggttccagagcctggcaggggtcctcacagcctcatccttcggcaaaaccactcagttgaggaagccccatactgttgccatcagcaaattctctcaaaaagtttaaatccatggatgtgtttctgactcctctcagtttctgtcatttttagttggaggtgtctgtggggcatctaaaagaagacataccataaaagatttttaagatttagtatggaggcaggaatggctgtgtagcctggagagctacataggctgatagcaggctttggatgctctgagccgtatgtccatgcagctgtggtgaaagattctgtgcacgttgccaatatcctatctcgagcatgtgtcgcagcacacactgcagtgtttctcttcctttgtgcctcaggtctttctcctctggcagggaatgcagctcaggtactgatgagaagtgtgggtaaggtaatgcccatggggccacccccaaactaagggagatggtagttgatggataagacttcagcctctctgtcctttagatggataatttggggtacaatttacacaatcctttgtggatctccagtgggaatgagccccatttgctatagtggtaaccagtttaaaaatgtagtcttgattagccttgtttcctcccctctcccacttcccacccaactccttcaattctgctttctaggcttacctcccaaatgaaccacctgcacccggatgcttgcctcaagctcttcagtttgagagtagtcatctaaatagagatgataatttgaatcacagttgtctaggcatatgcagctgtgaaaaagacagctaggttcatccagggacaatttctgtcacagatgatgtgacagaattgaagggtaagcatgtttgaggtttgtgcaagagaatgaatgaagttttacaccaagtattcttagctagaagtgggaaaatagaggatttatttcactggagggtttggtaaaaattaaaaaaaacaattgtagtagctcttaggcaagcaagtcagatggatagaaggtggtggtcacgatagggtgtttgaattagtgatttcagaggtgtttattgactcttggattcctaggaaagcactcttaataactcaatcctgcaatttcacttctgctgtatttgggggcaggctgaataggctaggattcataggtctaattttatactacagttctctgaactttgataacctgatgcaatcatcttctatttgatcaggtcgctgcccagagatctactttggccagacacgttgactagattctgaaaaaaccttacttaattttttgctgttttctggaccaactgtattttatgaactaatctaatgataatagctttaattcatatattcttagaggaatattgtgaggagggagttgaagggatagctttttatgtttgtatgtggtgctttacatgatataagcttataaacttttggcacaacatcatctgttttttgcatgtgtgtactcacacacatacacagaaaacacaaaatttcagaaagtatgaagggaaatacactggaatatcaattagttgtcctgagatagcgagaatatggggtactttttttctttccatttatctgtgtttttcatgctttcacaatgagtgtaagtttttgttgcaatggagagagtgattcatcatgggctactctgggtggctgtgggtctttgttttgctcgtttgtgcatgcccagttctggcacatatgaccactcaatgtaaggtcagtgaatatgagttaggcagggaagttaaattaatctcagtttcatagacgaaaaaagtgagggtatcatttgagatgttttcattgcaagtgttagaatatgcaactaaaagcaatttaaaattgtaaaaatgtattacttcatataataagttcagaggcagagtgatcctatggttgactaacttactagcacaacagtgtcgaggatccaggcactttccatctttttatctgtcttccttggcttcttattggtgtctcccctgatgattgcaagaggaccatgtatccattatgtatttctgcataataaaccaccataaaacttagtgacttaaagtaatagcagtcgtttctcttccttatgattttgtaatttgtgtaggtatctgcagggcttaccttgctccatgtggcatcagctgaggcagcttgactaggggctggcaatttggtactgtttaatactggttgcttagctgggactgagggctggaggccttggttgttttccatgtggacctctcttggcttttttacaacatggaagctagatcttaagagtgaggattccaagagacatgaaggagaagttttcagtgtcttaatatgttgtcctggaaaccagaatcatttttgcttgatcctattaggagtcacatgatctcagattcaagaagagaagatatagaccctacttgttgataggtggtatttcataggacttcaggagccatgttttaacacatctacaggtagttttaggtctagacattacatgcagacatgatgaagagggaggtttcttcctgtgtacttctttttactgaggaagaatgcctctttttttttttttaacataattctattcagtttccgttagccaagattgggtcacatgtccatgccaaaccaatctctaggtacaggaatagaaaacgaagttacagatttctctgaggtgtagatatccttgaccctacagaacagctgggcaaggcctggaatggatagaccagcttcatcctcttaacccaatgaatactaattacaaatagtataatttttgtatttgtctgtgacagagaataagttaggagactggtctatactaatctttatttactccagtggtcaaacctgggatcatcttccttgaacacatggaagggtgagcagtacctaatcagaattagagttctgcctttaaggaagaagagaggaaggataccaattaagttggagacccacagtatctgcaacactgaggtttaggaagtttaagggcccaaagccaagactaagacccagtttttggacacttgacccaatgttagttgttttaaccaacactgcttctcatggagttggagaatgttagaggtagaagggacctaagagatcatcatgtttgattttgcacactctgtagaaaccacttattcagtgtccctgaaaggtattccaccagcctctgcttgattatattcagcagtggagctgtcagtattcaaaagacacttctattggtgaagtactccttgttagaaattatttcttatataataagaaattaagtgggacttttccttttcctgcagaaatgacatctggcccatgtgctgaatatattacattcagaaaaaaaaagccactaaggactggccagtcttcttctttcagaattttctgagagtgacaaactaacactaccacagtcaacctcacatacccctaccttccaattctaaaaggacttacctggggagaaagggcagaagagaataggatcttctgtaacttatttatggtgagaggttacttcctcccttccagaagccacttaaaatagaatttcaagatgaagggtgctagcaacaagggtagccaagccactccctggcttacgaagctgggaacccataggcctatctaacagttgctcaccttccttagagatagcttgttgtgtgtaccctggagtttaggagtatttataagcatagcgactgaggcctgcttttcatttgtagattcctgaaggagggagacttgagggaatagcctggagtgaataaagactgtggtgccatatgcctggaaagggggtgagaggtctctgctgtatcagctagctattgctgaaaaacaaaccaccaaagacttaatggtttaaataacacatttattgttgctcaatcgtctacagccctgttggtgtgttaggattctctagaaaagcattatataggtgtatagtgtgtgtatatatatatatatctccaaatatatacatatatgtgtatatatatttccaaatatatacatgtatacgtgtgtgtgtgtatatatatatatttccaaatatatacaaatatgtgtgtgtgtgtgtgtatatatagtcctctttgctttatcaaatctttacatgacatatttgctttagatatatatttttttcctttctaagcaataaaatttatagtatagttggggcaccctgtgagtcttccttgtcatgatttcagagtttatcattcttgtgcatgatttataactttgctgcataggcacagtatccataaataggatatattgattttgtaggtctttaaactttatcacactgcaaataacattctgaaacttgcattttttttcagtcaacattatagttttgagaactatacacattgatgaatgtaaacttagtttattcatttttgtggcagaaaagtgttctattgcagggtggccaacctttttctgtaaaggtatggaagaaaaatattttagattttgcaggccatctatggtctgtgtcacatattgcaaatccaagaaagaaataacttgtatatatctgatagtagattggatgccctggtacttttttcactttattggcttacatttctaacaacaattccatttaatggttttctgcaccagaggtcattttcagctatagtcagtatagtatacatagctgctatagcaacctaaacaatggtccatatgattgtgtaatggtgtatgcttattataagattatattaagtctacaagacttgaaggtgggttcatattcattcctcctaaattaaacccacctccaaatgggccaggggggagaatgcttccatccacccaccaagagttttcacttaggtttggctttggcatgatgtcggctctgattttttcctggagtttgtgaccacaagtcaatggaagttacttagtggtacacagcgggaagacatatgcctcctacccacctccacacaagggtgtcttgtcaaggctgtgcctgagtttagggaaacgtgtaactgctgcttatatagctatttgaataatccaatatccagtatagaccttctgattcctcacccacatctctgtaaagtaagtaggtcttggtagtgctgcatagaattagaggcactgagcaggtataatcacacacagaagaagtgatatcctcacaaggtccaaaccatttattgtttattctttatatcctacctgtttctaaaaggctttcatgttgtttacaaccatggacacataccaaacatgaccataaaataagaagaacaaaaaataaagtatttgaaaagagggaagggaagatagattgggaggaaaagtacactgaggattattgtggtagttgaaaagattagtggaggtaagaatgtgcatgcaaatatttgtgagtgtctgtggttcaagggttggcaaagggaaaaatacaagaaattgcttcagtcatggaggatctaatggccatgctgaattatttacaaggttcactgtacatgagtagctacattttaagaggatttgtgatgccttgccctacctgaaaatctgcagtagaatagagaaactctatcttgggattctgagtggtcttgctaccattttgctgttagataccattttgctgctaccattttgctgatagagggccccatacatgagtctaggatcttacttccttgatctggctatctaaaggaagagtttttttgtttgtttgtttgtttttttggtgtaactcaactcactgatgtcccttttctctgcctgaggcaggatgataaggaaggaggacaagttgctagggcagatagagggatctgcttctgccccacttctctctgatcattggttattccttgagaggcaattctcagaaaccagcttagcatagtgaggcttacccattcccgggtgcctgaccagcatgatttcagaaggtctttacatatgaaatattcacataatagaagacagacgtgaaatttgggctcagtggaagcaaggaagaattggacaaatcctcaaagtacgcttggtggattctccagactccttagggtcctgggcagttttaagggtagcagactccttcctgccatcaagtgataaaagagataaaatgtggagctgagaccactgctagggaaatagactaattatatttatttaggcagaagagcctactggttaaggctacgattctggagcaagactacttaggttggaattcctgctctgttagctgagtgatctctggaaagttacttaacatctctatgtctccactttctcatctctattatgaggataataacagtatctactttataggattgttgttagaattaagtgattcatacctgtaaaattcttacaatagtcccttgtcatgaattaagagtgcaataattttttgcataagaaagatgagctggaggagatcttgtcatccaggtacttaggcaagaaatcgaaatacagctgggagaaaagaacaaaatcactcaggacctctgaggattatagagtatacagttataatcacatcatgtgggttgtgagtgatgggccatagtatttgttctcacaattctgagaacaaaacaagatataaatatgtattgaaggaagagtcctcaatttttgactaaacatctggtaaactggcagatgttcaagagagattttggtaacagtgagatcttagtcagtaagactttaagaattttcttttaacagtactagggtatcatactggttatatctgcagaatgagttttgctatagtaatctaaataggggtttatgtaatgtctattttctacttggcattttgccagggtagggaaaaatatctctgaaacaacttcattgtaacaatgaaatgatagtcctttttgcctttaaaaattgtaatctaataaacatttatcgagtgcctactaagtatagtaatagtgtacctagttttttcaaatacatattattattgaagtataaagtacacacagaaaactatactcatcataagggcaaatcttgatttatcacaaagtaaacttactcatgtagttctgtatccaaggtgagaaacaaaagagtatcagaatccccaaaagactccttatgtttcttttcagtcactttcctcacccacctcccccaaaggtaaccactaagcagaaagccgacttctcacactacagattattttttcctgggttttaaaattttatgtaaatggaatcagggttctggtttctttcactcacactgtattcatgaaagttatccatattgcagtttgtaacagaagtttgttccttagcattgctgtataggattccattgtatgaatataccgcaatgtattgatacagtctgcttttgattaatatttaggttatttccagattgtgactatgacaaataatgcttctgtaaatatccttgtgcgggccttttagtacacatatatatgcagttctgttgcatgtatatgcaggagtagaactgctgggctgaaagcaatgtcaatgtttagcttcagtagagactgcaaaggcagttttaccattttacactcccataagcagtgtatgagagttccagttgctccatatccttgccagcacttggttttactttttgtgatggagtagatgtatagtatctcattgtagtttgaatttgcatttatgactaatgaactaattttcttttcatgtctttagtggccattttaggggtatgtttgtgtgtgtgtatgtgcatgcatacacatgtgtgaaatgactgttcaggtattttcgctcattacaaaactgagttgtatttacccttttggtccttgttcataccttcttgtatctccatgcttccacataggatcatttcttgtgggcctgaaatactacttttaacatctctcctttagtgcagatctgctggtgacaaattccctctcctcatttttgttttgacagaaaatgtatttcttttcccttcatctttgggactgtgttacttcctacttttagattatcattcatcttccagcttccattatttctgttgagatgctactgtcctctgtcattattgttactcgtttgaagttcatctgtctacttatactttctgactgcttttaaagactttctctttgactttggtgttcagcaattttaacatgatatgcttagttgtggttttcttcatatttacctacttgagttttgtagcatttcctcaatctgtggtttgatattttagcagtttgagaaaattctcagccttcattgcttcacatattatgtcagagccattcttttctctctctttctctctttctctctctctttttctctatctgggacatttccactctactgtaagtttttcatgctttttctttctccatttgagtgttttcttctgacctaccttctagtgagtactaattatctttatagctgtatctaatctgctattaaacctgtttatttcttaattgtaattatggtatttttttagttctagaattgtcatttgagtttttaaaatagtttccagtctctgataagttcccaattttgtcacacaattttaaaatcatataaattatagttattttaagtccatgtcagattattacaaaatctgtatctcctacaggtctatttttattatctattattatttttggattttggccattttttgttgttggcataccatgttatttttaatttaatgccaggtatttgtaagaaaaaaactagagaaaatttgaggctctgcatgaactatctttctccaggaagattttgcttttgtttatggcagtcagatggactagatgcagatcaacttgactcagtcatgacttgagatggttgaaatctatatcaatctttgcgagggcttaatctctttccagtcatccttactcctgatgtcctttgagtttctactagaaagctttgggtgtacaccaggatcattatggggcctgaatgtcaatatttgctcccatacccaccagctttgagagatttctataagttgtattcatattatttgtttcttagtactcattttcatttgggaaaatgtcttgagggaaaaggcagcttcagaattttctcgagagattttttttttctttcaaaagtcttagccccaggagtactcactgctttggaagatctctgatgcctttgaacagatgtttgcctagttgttcttgacagaaataatggattaaacaagctaatctgccatgctagtatggaaatcttttgctttttgatgccttttttagggaattcaaaaagcatgagaaaataaaattggacttttttgtcattttaaatgtttgttgatggccacaaggctaattactgttttatcctttttttcttttccttttttctatcttatgaatttcagaggtacaagtagttttgttacatgaatttattgcatagtggtgaagtctgggcttctacttcttccgtcacccaaataatgtacattgtacattaagtacattaagtacaatgtacattaagtaatttcttatcctttaccaccctcccaagtctccagtgtctatcatttcacactgtatgtccatgtgtacacattatttagctcccactaagtgagaatatatggtatttgactcttctgaattggttcacctaggataatggcctctggttccgtccatgttactgcaaaagacatttcattctctttttatgactgagtagtattccattatatatcgcattttctttatacagtcatccattgacagacacatagtttgattccatatctttactattgtaaatagtgctacgataaacatatgagtgcaggtatcattttaatatggtttatttttctttgggtagatgcccagtagtaggatttcttgattaaatggtagttctgtatttagttctttgagaaatcttcacactgttttacatagatcttctattcattttacactcccaccaacagtgtataagtgttcccttttctcccatccttgccaacatctgttatttttattacttttttataatagccattctgactggtataaaatgatatctcattatggcattaatttgcattttctgatgattagtgatgttgagcatttttaacattttattctataatatatatttggtctatgcagatctggcctttgaattctgacacactttttgggatacctataggacaatgtgaaatctattataagtttgattcatagttaagaatgaaaagcaaccacaaaatatatacaaatggccaatacccacatgaaaataggctggaaattattagtcatcagggaaatgcaaatcaaaatcacaagatacaatttcacacccattagaatggctagaataaaaaagttagataataagaaatgttgatgaagatgtggaaaaattggaatcctcatagactaatggttgaaatatgaaatggtgcaacctactttggaaaacactatggcagttccttcgacaactaaacattacgttaccatattacctagcaactccacttctataaactcaagagaaaagaaaatatatgttcacacaaaaatttgcacatgaatgttcataacagcactattcacaatagccaaaaggtagaaactatccaaatgtttatcaactgatgaatggaccatgtcttgtatatccatacaatggaatattatttggccataaaaaggaatgaagtactgatacatgctacaacatggatgaaccttagaaaccttatggtgagtgaaagaaaccagtcacccaataccacatattctattatgttattcatatgaaagtccagaatagggaaaattttaaagataaaaaatgtatcagtggtttcttaggaccagtgggggcaaaattgatagctaaagtatatggggtttctttttgaggtgatgaaaactttttaaaattgactggtgatggttgcacttatatgcgaatatttaaaaatcattaaattgttcactttaaatgtttgtgaattatagcttcattattatagaaatttttcaacatacaaaaagattgagaggatgttataatgaacccccatgcatctatcacgtcttcaacaattatgtgtttttaccaatgaaggattttttttaagatgcagctgacataggcagattcatacactaggggaaaagagtcaggattaagagagtagttgaaaatttagaagggaaagatgataattgatacagcaaagtttttgaggaggcaagtgatagagtgtagtgcaggtggggagatcccggctccagatcgtaagaaagactctttgttcactgagttgaaagaaaacagataaaaattactgtctctcagaaatctgttgaaaattctaattttcagaagcttgctttgctaacttcctccagtttccctctgccactgcactccatatcccctttggcttcgccagttacctctttgaagtcattcactaatttttttgaaaagtctattccataaaagcatttcatgagttcagtcattttactgaagattcaatgtctacagagagtaatcataatacagaaaacaaccatctaccatcctccatcttacagccagactctgttatttctctaaagcaacagacacactgttcccttgtactataaatagaattgctttcctaagaggaattctggggaagaaaatattctccataactttacatagagattaagtttttggtggcaagtcaggaaatgaacaaatccatgcctagtgacaattaatttctctgtgaattaggaaggttcatctggaaagagttcatttggctggaattgggtaggaggaagctttagaagtatgccaagggtttgaaatattgccaaagccttccttttagctttacttaaagtaatgtcttcccttctaataataatgaaaacagcaaaatgcctccatccatacacacccctaggaaatgagattaggattactaggggatgttagacttctgtgaaatgccacttaaataggcagtactgccaatttatccccttttgtgttggctctgtgaagataaggttgggaaatattgtcagggaacttttctccatttaagtctgaatcagtaggtatttgcatgagcatcattctcatcgttcattagatgacagcttaattatagagctggaaatgtacattggaatcattttgtacaagcttcttgtctcccaaatgtgtctccctccctgaccccatttctatctgtgacattttgtagtgagcacccaacagtagcaatgataattaaagccaatgatttcaaaatattttttatgcattctcagaaggtttctgtggttgattactactagacaccaactgggtaataattgcctaattctcttgatagagaaaaagatgtaatttggaaataattgactgaacaagagaaaaatggatagatactagaaaaaattatgtgggccatagtattgcttaaagcaataaatattttggagttaaaataccataaatataacaatataaatactgtacatgtgtgactacttaccttagattgtaataatttatgcttagctcatcttctgcacttaaaatatttttcttatactggagaaaacataaggactatgaaaaaatgatttaataatggatccttagagtttggaaatttgtaaccacacatacatgtataagtaatatacaaagtatatcactaatatgttctgctttacaatgctccattgaattagcctctcaggaaaaataacttagtgcaattacttcccagtcaactcaggtaatggtgtttctaccttttaaatttgattagtagattccagtctttccagtgaatgacatcattaattaaactcagtgccaaaagactatgagaaaaactgatgctttgagtaagagtgagcttctctcccaggcaaataaataccaaagcttcagagtttttatgtctaattatagatgtttttccatttattcgtaaataggaaaaacctttattcctatacattttaaattgtacatttagatagagacaattatgttacatggacagaattacatagaattaaattttaagaatcaagcatggataaagctacaacaatcaagacagtgtagtagtggcaaaagaacagacaaatagatcaatggaacagaatagagagcctataaatagacccacataaaaacagtcaactgatctttgacaaaagaacaaaaacaatacaatggagaaatgataatttttaaaattctagacacagaccttacacccttcacaaaaaattaacctgaaatggctcacagacctaaatacagaatacaaaactataaaattcctagaagataacataggagaaaatctaggtgactttggatttgatgattgctttgtagatacaacaccaaaggcatgatccataaaagaaagaactaataatctgaacttcattaaaattaaaaattcctgctctgcagaagacgctctcaagagaataaaaagacaaaccacagactgaaaaaatatatttgcaaaagacttatctgataaagggcttttatgcaaaatgtacaaagaacccttaaaactcaacaataagaaaacaaacaatcaagtaaaaaaaaaaatgggccaaagaccttaacagataccttgccaaagatggacaagatggcaaataagcatatgaaaatatactccacattatatgttatcagggaaatacaaattaaaacaataatgaggtaccactatatacctattggaatggaatatcatttaggcttgaaaaataaggaaattttgccatttctcaacaacgtgaatgaacctggaagatattatgctaagtgagataagctagacacagaaagaaatatactgcatgatctcatttatatgtgtaatctaaaaaagtcaaattgatagaaccagagaatcgaatggtagttactaggggcaggaatggctctgggaaatagggtgatgatggtcaaaggatacaaagtttcagttatgtcagataaataagttctagagatctaatatacagcatggtgactgtagttaataatacctgaaatttgctaagtgttctcacacagaaaaggtaactatgtgaggtgatagatatattagcttgactatagtcatcattttacagtatatatgtataacaaaatattatgttgtacactttaaatatattggcaaaaatccagaacactgactacagaaaatactggtggggatgtggagcgataggaactctcattcatagctgttgagaatgcaaaatggtacagtcattttggaatacagttgggaggtttcttataaaattacacatgctcttaccctgcgatccagcaaacaaatcacacccattggtatttaccctaaggagttgaaaacttatgcccctccaaaaatctacatatggatgtttataacaaatttattcataactgtcaaaacctagaagcaaccaagatgtcctttaacaagtgaatggataaataaattgtggtacatccagataatggactattattcagcactaaaaagaaattggctgtcaagtcatgaggagatatggtgaagaaaacttaaatgtatgttactaagtgaaaaaagtcaatctaagaaggccacatattgtatgattccaactatataacattctggaaaacgtaaaactatggagacaataaaaagatcagtggtttccaggagctggagactagggagggatgaataggtggagaacagaggatttttacacagtgaaactactctgtatgatactgtaatggtggctacatgtcattatacatttgtccaatgtgtaatgtccaatgcacccataggatgtacaatgccaagagtgagccctaatgtaaatgtaaactttggatgataatgatctgtcagtataggttcatcagttgtaaaaaaatgtaccactctggtgggggatgttgataatgggggttgttgataatgcttgtgtggggtcagggaatatatgggaaatctctgtaccttctgctcaactttactgtgaacctaaaactactctaaaaaataaagtttattaaaatgaataaataaacatttcaagatatttttaaaaaatgaagcagcaggcatggaagggtattatctcaattttatgggtgagaaaacagaacccagagaggttgccattttttcagtgtaaactggtgagacaagaaaaaaacgagagccaggctgtcggttcctaactcatagccctgcttcccatccttccttgtgccagtatttagagatgttggcagcctgtagtaagtgattatatttcagttttgaccacagtctacttatgggttggcatcatatatcttagatagtacaactcaaggccaacagtgctgtgctctggaatgtaataccacgttccatttaaatgagctacatcttgtctccccaaacttctgcttctattataaactggataaacccattacccataagtcattttaagaaataaacagagttgaaacttcttgaaacactaaggactttcagcccaagacagatagactctcagtaacagtgaagttctcgtttcttcagctccccacagaatttaagaatgcaaccacagtgagtattctatagtcagtgtatcagtttaaaagatcctgcagatatagaggaacatactgagcaacttattactgtttgtatatctactgctggtatgtgctgagggacatcaaaaggaaatatcagatttggttggtcggtcttgattccccagaagcttagaagccaattgaggaaacaaaacacaccatgtaaaggactctacatattcagacaggcccagatgaggtcaggaatgtattttagtgtgagttaccctgaagcaggccctacgagaagaatttgagtgcatatatctggggaggaagatgtaaggagtgtggaagaagagaaatgaggcagggaagggaaggcagccaataaagggagacaactattagacaactatcaccatgcgtgactagaagttaatccaaagagcaaatactaggaaatgtcatagaacacatgcctcagagatattctctctgatggatggggaagccatagtacttgtattccagctcctaatctgggctggaattggggcattgagggcgctctcgggagtattaattcttggcacttcagcctgacaggcacctggatgcagcagctttctgcagttctggaaaacatactcaagcacagtgggcagatgctaacaactggaagtcaggctgtgcacataaaacagaagagtccaaggaatgcgggtggggtgctgacagagtgtctgctgcagtaggattcctagtggaggtgagacttgatgatactctctcttttctccccaggtctcctcatgaccatatccctgttgtccattgtgtatggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaatttagaagataggtgagcaacttgagtgatcccaaaccaaactaacagtgctggtttgtccgacacccaaagcccacttcacacatttataaggacagagatttggtaactcatttgggtattttgtcagttttaacccttaatatacaggtatcccagctttgggcacatgtatgtccattcactttcaggaaggggtgtcagtactttctttctgtgtggtgaaaacataagccatggtgaactgataatttttgtttttaaattatttatattactgaattggcaaaattacagttcacactgcagagctaggttgtcctattggcataaaacaaaccagcaacttttctcatgtgtttggagttaaaatgtgtttttcagttataatttcaatttttaaatttcttggtgctttgtctaattaattacatcccataacttgtcaggatagttgctccaactgaattgctatcatttggctggatgggggtgaagtatgtcttcaaaatatattgaagtaagttcatcaaacatgtttagacttcctctcattgctggagacagcccagtgtagagattggcacttccctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgtatttcattctttatacaattcttacatggcctttttacttcagggactatttttaaaacagaaattttaaaattgtttcattgtaactgattatagttttataaactcacctggaaattacttctgtaggctgagaaatttgagagtgctaagattcagccttgcagaacaacaacagtccatgaaaacctctctgattgttttatagacatttactccacttgttaaaattacactgctggatactaagattctgttcagttgtccatcagttgccatgcacaatacaaaaaagagaggcaatacacatctcttctagacaaacataaatatatactgattcagaaatataaaacaccaaagaaatggcttggtattaacatacataatcaaatgtaaatggttgggaaaaacatcagtcattaaagggatcatttcagagcatgagagagacatggactgtttcaataattcctttgcttctgaaggtggccttggaatttgcaaagacttagctataggataaatctctttaaaaacagctttattgaggcacaattgacatacaaaaaactgcacatatttaatgtatacaatttgatgaatgtgtacatatgcaaacactcatgaaaccatcaccacaatcaaggtaatagacatattcatcacttctaaaaatttccttgtccctctttgtttttgttttgttttgtctttgtaagacacttaacatgagatctatgctcttaatattttaaattcacaatacactatcgacaactataagtactatgttgtacaacagatctctataacttactcatctaacgtaactgaaactttatatccattgaacaacaacttcccatttcccctaccccccaggccctggcaattgccattctatcctctgcttctatgagttttgctattttagacaccccatctaggtggaatcatgtagtatttgtccttctgtgtctagcttatttcacttagcataatatcctccagattcttccatgttgtcacaaatggcaaggtatcctttttttaaggctgagtagtatttaggaatatgccatatattctttatccatttatctatcaatggacatttaggttattttcatatcttggctattgtgaataatggttcaatgaacactggagtgcagatatctcttcaagatcctgatttcagttattttggatacatacccagaagtggggctgttggatcatacggaagttttatttttttaattttttgaggagccttcatactgttgcccatattggctgtactattttacattcctatcaacagtatacaagtgttctaatttctccaaatccttacttacatttaattttttgtttttttggatagtagccatcctaacaggtgtgaggtgatatttcactgtggttttaatttctagtttcctgatgattggggatgttgagcaccttttcatataccagttttccatttgtatgttctctttggaaaaaggtctattccagtcctttgcccatcttttaattgggttattaaacgctttcttttattgagttgtaggagtttcttacatgttttggagattttcagatatatggtttgcaaatattttctccaatctgtagatgtttttcctttgctgtgcagaagtcttttaaaataaatattttcatgttaaaaaaaactgagtattaacaattatagcattcaagtaggtcaatataaaattatttaatttggtgtttgttaatgttttattttgaaataattttaaactaatagaaaagcctgaagaatagtgcaaggaatttctttataccctttacccagactcacctattattaatatttttccatgcccgttatcattgtcactttctctctctttcttgtaaaccctttgagattacactgccaacgttacacccctttattcctaaatactatgatgtgtttttcctgtgaataaaggtattc

SEQ ID NO: 17599 - DNA, 45900 bp, Human
tttgggaggcagaagccggcagatcacctgaggtcaagaggtcgagaccagcctggccaacatggtgacaccttgtctctactaaaaatacaaaaattagctgggattggtggtatgtgcccataatcccagctactcaggaggctgaggcaggagaattgcttgagtccgggagaaggaggttgcagtgagccaagatcatccgactgcactccagcctgggcgacaggagtgagactacgtctcaaaaaagagaaaaagaagtctcagtatagtgttaagcttttaataacttcaggagtataaattatatgaactcatacattatttgaaagtaaaattatttaactgtattaactataaaattatttaactgcctatttggtttgtgaatttttgaacagaaaatgtgttttaattttttgtttcagtcaatgtttgccatcttccgttaaagggactaaaaaatttaaaaatgttcaaaattcacaaaataaaataaacatataagaaatttaaataaaccttcaagtgactttttgcaagttggtagcattaatacttcagaaattattaaagcttaaaacagcactaagtcttttgggatacttgtatatggaaaactgtggagtaacagggtgcttgaatacaaacttttataatttacacccagctatgtccaaagaaaacggaaataatttataacaacacatacacacacaaataggcaaagatatgtaaaacagtcataagctgtcttgaagctggagaaacatgtccctaagtgagtaaaactttaggaaaagcagggagaatgaggcaaattagtagcaatatttgtaatataggtttctggtattattgtatattttcacttggaagggggttgaggatacatttttatttgggatacttgttcttgagatagtattatgttctcaatattttggtattagcattattatagctaatgatgcttttccagaaaagttgaaacaaataacttttaaagatgcacataaatagaacgtaaaaaaaccccaataaatagttttcttttctcttagagattatctagttcagtggttctcaaccttggctgcacagtgcaatgacttgaggagcttaaaaagtataaatgcttgggtcccactgagcatctgatttaattggtcgaggatacagaacgggcatcgggaattttaaaagaccttggtgatcctaaagtgcaggtaaggttgagaactgctgctctagttcaatatataatcaggtatacattaacgttaaaatgtgtaggtgttcagagttctgatttttaaccatagcaccatctcaaatattataaaaggttgaaaaaagagcctaatttaatcaacatggataaatttcaaaaagcatgttgaacgatacaagccagacacaaagagtacttattgctttctatttacataaagttaaaaataatcagaacagggggaggggctactgactaggaagggacgcaagaaggaaattcctgagagggaaattttctccattttgattagggtacacgtatatatatatatatatatatttatcaaaactcacagaaatggacaattgagctctgtatgtatgatttcattacatgtaaatttacacttcagtaaaaaggataaacaattaaatctggatatctatgacagggtcggggagggagagattattacttcagacgaccccaaatcctcatgggttaaaagaaacagcaaacccctgaccagaactggcgagaatggagagtagacagcagggagggccaaagcctaagaaatcgctacaagactagatgccgagttcgaactactgcctggacggcagcgcccgagcgcccgcaaaaataagcccccgtgccatttccggtactagcaaatcctcctgtatgtccccactggaagagtccggtgggaaaccgtgccaccgcaaggaaggagccggcggtagcttggttcctgagcggatgctggggctgtaaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaaggtgagggccttgggcctaaggtccaagcccgcggtgcccatggccggagcgcaaggccttcttttctcttcccctgcctggcgcctcccgggctggacggtgcccacgtgcgacagtccgcgtggtggatcggcccggtggagtaaataaaacattgccggccgcgggagggttgtggcggcctgcgcggctgccactgtcgcagtgcggggcagtgcaggcccttcagccttcgggtcctgcccgggaggcgccagtggtgggatcgggagggccggggccctgccagacccagcagctgcagtgcagcagggaggaaaagaaaacgtctgcttagtaaagacagtgctttcccttattgtttttaagttcaaaacgctctagagactcagatattggaatgaatctaaatcaagtcgtgattgaaatcagtagtctcaaatttttaaatgcatatgatcatctggtttgcggtcaaaatgcagattccgattcagcaggtctgcggcaaggcctaaaattctgcatttctaaccagttcccaagtgctactgatgctgccagatcacagagtgtacttcaaagtagcacactcaaatagcaaggatttacataaccagtttctaactacttgaattctgatttacacgctgcaccccacttcttcacactaaccagataccctgggtgcacggtccattttccagttatttgagaagggtagcaaaaaatcaggaagagtcgtctgaccacatgcttcaggcaagcttttggaattgagtactggggggtaggggatggggaagagtaactatatatgtggaataagatcatataaattctcaagtgtttaataaaaattccagttatggatagcaaaatcttcatgttatgaataccatttaaaatagaaaaccatagtattgcatgttttagctttaacaataaaatgaaatgagacttttccttctatcatttaaacttgtaaagtgcaggaggttacatagcgtagtccttagatccagggctgggcttctagccaatgtgaccttgggaaaattgctatctgtgccttggtttctcatctttaaatagagataatagtaaggatctcctaagattacagagagaattacattagtgtatccacataaagtctcgctcctcaacttgaggttcaaggaccagtagcacttgcatcatttcggagcttgttagaaatgcagaatcccaggcctcacccctgacctagggaatccgaatctgcatcttagcaagatcccaggtgactcctctgcacctgtttgtgtttgaaaagcactgatgtggccggtcacagtggctcacacctgtaatcccagcactttgggggaggctgaggtgggaggattgcctgagtccaggagtttgagaccagcctgggcaatatagtgagactttatctctacaaaaaatttaaaagttagccaaccatggtggtgcatgcctgtagtcccagctactctggaggctgaggtaggaggatctcttgagtctgagagtcagaggttaacaatgaaacaagatcgtgccactgcactttggcctgggtgacagagcaagaccctgtctcaaaagaaaaagcactgatttaaagtacttggcatagtggttaacgtgtcataagcaatacaggccacaatgattttgttgtttgaaaaagccacatgagccaggcatggtggtgcagcctgtagtcccagctacttgggaggaagaggcgggaggatcgcttgaggccaggagttccaggccagcctgagcaacatagtaagacacacacacaaagccacatgatttcttcatgttgcatatgtgaaaaaaatctaaaataaaaagaacttttacagtccctagtcacaagtgtgtgaggtgaccaagatgtcactggtttcagtaacaacccctagctccttaagaatgcaccaacctctgagcaaaagacctaacgcctactcagagtatctgcctgggaaatggagagacctcaacttttaggagcctgcacctttagtttctctgcctccagcttggtctgctgatccaccctgggcttttctaggatttctgcatagacatctgttagagaagttgtgtcactccttttccaagtcttggaaaacaagtacacttaaaatttaactacctgaagactgagagcagataatactacagatccaaagcaaacagctacctatattcagactatggtcattttttaagactatgatagggctaagatttccttcttggacagataagtttctcacatgggtgggcatgaatatgacaatacttactgtacttactgtgtcaggtatataacacagccttatgtcatccaaaatcctatattagtcaaggacttcaaacttccctaaaggtaaaactcttgttggggctgtgtataagcccctatccccacaaccccagagaatttaagggacattattgagcccaagatggctttagataagttttttactttttacatgatcgaggttggcctaacttcttagagttgttgctcagaagaagaaagcaaacactgatcgcaactgtcccttctcttggattggtagggtttttttttttttaaattataacacaaggcttctggaccagtgctgtccaatatggcagctattagccacatgtggttattgagcctttagtcagagctagtccaaactgagatgtgctgtaagtataaagttgatgttgaaattcaacgaagtaatgccccccccaaaagtaaagtatctcaccaatagtgtatgttgattacatgttgaaatatcttggatattttggggcataagtatacgaaaattaatatttaaaatttggctgttagaaaatttaaagttatatatgtggcttacatttgtggctcacattatatttctattggacaacactgttctaagcaggggtcagcgaactttttgtaaagtgcttggtagtaagtattttaggctttttgggccacagagggtctctgtcgcatatttttggtttttattgtctttttataatcccttaaaaatgtgaaaactattcttagctcacaagttgtgtgaaaacagtctgtagttcggatttggcctgtggcccatagtttaccagaccctaatctcagtagaccggttaggtctgtgacctttaatattctgaagaataaacataaagctttaagattataaacatttgggaagtcagcatcttaatttcctctagaaaatactttgtgttattttcttacacattataaattgttcttcaaaattgagtgatgtagaacttttctttctctcttagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggtattcttcatcttcttttgtttggtttaggttaatcattaagtgatcacgacagacagcttgttaaattaactatttccattactttgcagttttctgagttttaaaatattgacaatattaaaactttctggttttatataaccttatgggattgtatcattgtggcttgcatacattaaaaatcaaggcatttatggcaatttatagttaggggctttacaatgatctctgggacacccaagatacaggcaggttctgtagatgagagaatgtgagggtcaggggtggcatggtctagatttctttttgttaaaaatttagccccaaatggattagagctaaatgtaaacaatcagatcatcagagttagcagaaaatgcaatagcagatcaaagcatacaaagtggaaagaaggatataataaagataagaacagaaatcagtgaaatagaaaatatacaatagagaaaatcagcaaagccaaaagttggttctttgaaaatattaattgggccgggcgcagtggttcacacctgtaatcccagcactttgggaggctgaggcaggtggattgcttgaggccaggagttcgagaccagcctggccaacatggtgaaaccctgtctctactaaaaatacaaaaattagccgggcatggtggcgcacgtggtcccagctactcgggaggctaaggcacaagaatccttgaacttgggaggcagaggttgcagagagccaagatcacaccactgcactgcagcctgtgtgacacagcaagaccctatctcaaataaataaataaataaataaataaataaataaataaataaatagaaaatattaattgataaacccctaccatgactgatgaagaaaaaagaaacgtaagtaattaaaaatgagaattgaggccaggcacagtggcccatgcctgtaatcccagcactttaggaggccgagatgggcggattgcttcagcccaggagttcgaaaccagcctgggtaacatggcgaaaccccatctctacaaaaaatataaaacttagccaggcgtggtggtatgggtctgtggtcccagctacttgggaggctgagttgggaggatcacctgagctctgggaggtgaaggctgcagtgagctgtgaccgtgccactgcactccaacttgggtgacacagtgggaccctgtctcaaaaacaaaaattggaattgaaaagaggacattactacagattctataggcattaaaaacatagtaagactattaagaaaattctatgcctataaatttgacagttttagtgaaataaacaagttccttgaaaagcacaacttaccaaagttagaaaacatggcagattatctccactatacaatggtagcttttaataattaaaacaatagaaaaaagaaattattattaaattataccatgttaatatttaagctcattttatcacaaagtaaagctgaaatacgatgcagacaatagaagaggtagatgaaaaaggatggatgtctataacgtcaaaagggctttcataacgatataaggacaagatcaaaacaatattatgtaaatgagcaagtgcatgagaggaaacaaacttttttattgggaatgatattcagattctttagttatcagagaattataaattataaaactgcttaaactagtgctcatgctgcagtcaaatatttgaagttcatgtaggaaaaagaagcagagttactgaaattttttagccattattttaaagctatgaaatgtggctgcttagtgaatttgctagtccatgaattgagagaaattgtaaattaacatgatttttttcccttttgacaggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggtaagtatcgtcttttcgctttaaataactatcgaaatagagatgcaagataccacttatgatctagtgtaactcctatccataatataaatatgaaaataaattaaaagtctcataattttcaaattacctgcttacacaaaaaaattaataagaatacagcaaggaattgttgaaatatttggtagtagttgtaatattaatggtaaaagagaacaaatgaaccatcattaagactgtcagcaattaaacagatacgtgactgtctttttaagatattaaatgattgttattttcaaagaataggcatgctgatttaagatctctataatgtataagtaaattgcattctaattatatgcaaagtgtttccctttccttttcatggccttcagagcctaaccaataatatccttttaattaaagatataagacctttctgaatggtcactgtgatttcttaatgtgaagaataatgtgctgagttgtactcctttaaaactcatgtgtagacctataccttatcattttatgtctccaaagtttggaagggggctttacattggctcacttttatttcacatttttacatttatagttcccatttccatgagtcatggatgttgtttttaatcatgttcttattaatggagtagactaaggattagtaacagattgggtttttttttcttgtctctttgtgtcctctactaggctgggtcactgggaagatttagaagtcatttgtagagaacaataatctctcctatggccatagctcttttttagagattaaaaagatttagcaggtgaggcctcagaagaaattatttctttcttcagcaaacattccctgccttacagatgagaaaatcaaggcacagacacgttaagtcacttgcctgtggtcacagctcataactagtagatccatcatcactgatcttacagcctatagacattatgctctattattattttattatcattattattattatttgagacggagttttgctcttgctgcccaggctggagtgcaatggcgcgatctcagctcaccacaacctccgcctcgcgggttcgagcgattctcctgcctcagcctcctgagtagctgggattacaggcatgcaccaccacgcctggctaattttgtacttttagtagagacggggtttctccatgttgatcaggctggtcttgaacttccgacctcagatgatccacccgccttggcctcccaaagggctgggattataggcatgagccactgcgctcggcctatgctctacttttaagagagacaaataattcttcaaggaactataagtaattttacttacagttttaaacctctaggtatatggtgggaggataggtgggactggaggcaagagaacaggatagtgcaggatataaggtgggagatacaggtagggtctaggttatgaagtttatgttttacctgtaggtagcaagtctgtacaaaatggaccaaagtcattagagtgaagatgtggagatcatttaagagcagtaatttattttagaagtgataaagatataaaattagtggcaaggagaatgaaggggatggattcaagtaagcttttggagtggaattctcagacattggtgattaattaaatgtgaggctggagggagaaggaaaagtttaggatgactctcaggttacacaattggttcttgttcaacaagaaagagggtaagagagaaagaagccagttggagaaaatatgatcactggcttatctgcctgctagaattagaatggcaaaacgttgtttagagaagaaattatttcttctctttgccactcagtttattcatagtactcacaaaaatgtcagctctattaggagatccgtgctttggaaccattaagaagtcagctgccctctggagcccaccatgcatattcatgtataagtttaagaatgttatgaatcctgactttgacatgagctcttgtagcttaagtaacatactttctgtttactctataattcctgacagccttgttcagtattaattctccaaaccatggcactctgtgttgttgaaagtattctgtattcagtattctggtacatctgataccctgtgtgaatcatggcagagacagatgggcaatcgtgtactgttgccagcaaataagacctaccatctgttggtattatcacacattcaaattcttactttatctcactcactagtacatgcagaaaataataaagagaaggaagaaatatcctattggaccaagcttactgatttatttgaaataaaggtaaggtaagcaggatattttgtgatatagagggtatgtatgacagtcttaagtatgtaaatttagagaggggtcagagaaaagtataatactggaaagatgtctgacaacttaggaatggagcaggtatataaaaagggacatagaagttcttgagaaaagttgctcaatagggtccaagtaaagagaatttcagataatgaacattataaacatatccatttcctttgactctttacctccacatctgggactctagcttaaggaaacactttcaaatatagaaaaaatagtattcattaagctctttagcctaacattatttattattatgaagaattaaaagcaaccaaaatatctaattgaggaatggttaaattattggattgtcattcaattagatattatgcacacattaaaaatgattataactagtttcggccgggctcagtggctcacgcctgtagtcccagcactttgggaggccgaggtgggtggatcacctgaggtcaggagttcgagaccagcctgggcaacatggtgaaaccccgtccctactaaaaatacaaaattagccgggtgtagtggcgtgtgcctgtagtcccagctatttgggaggctgaagcaggagaactgcctgaacctgggaggcggaggttgtagtgagccaagatcacaccattgcactccagcctgggcaacaagagtgaaatcccagcactttgggaggccagggtgggtggatcacgaggtcaggagatcgagaccatcctggctaacatggtgaaaccctgtctttactaaaaatacaaaataaataaataaataaaaattagccgggcgtggtggcggacgcatgtagtcccagctactgtggaggctgaagcaggagaatgagatgaacccgggaggcggagcttgcagtgagccgagatcgcgcgactgcactccagcctgggcgacacagcgagactcgtctcaaaaaaatatataaataaaataaaataaaacaacaacaacaacaaaaatgattataactagtttcttaactagagaaaggacacttggaattaatggaatttagaaaatgattcaagcagcattgtttgaatcttcagttactaaaggaagctttttagatgagatttctgtgtccataaaaataaattccagttgaattaaaattaaaacttgaaaccataaaaggccttgaaagaaaagacccatgttatcatttttatgagcacagaatgaggaagacatagagcgaatagtagaaaccatgaatattttttatgtaacagtaacacctttattttttattttttaaatactttattagagcagttttagattcacagcaaaattaagaaggtacggagatttccccccttacaatgatgaaccgacgtgaatatgtcattaccacccatagtttacattagggttcactcttggtgttgtaggaaaccatgaatactaatagatttgactacctaaattttatatatcaaaaactaaaaacaaagtaaaattaaaaggcaaacaaactgtggaatacatttatgtcatgtattacaaaggaccaatgctgatatttgaagtgatcttacggatcagtaagaaaaagttgaatactttaggagaaaacaagtcaggttatcagtaggcaactcgcagaaggaccaaaaaatggtcaaaagtacggggaaagttcagctttacaaatggtcaaagaaatgtaaatcacattgcagatttgaataaaacgagcttgcccaaggttatgaaagggtctgcttttagagtataatttgatgacatgtatcaaaatcttttaaattttgtgtaataatagcatttactaccctctctgtgaggcataacattaaacattggacaaagattagctcatttaatcctcaaaattacccttttgtgcaaatgtggttatttccattttaatgatgagaaaataggaatgttggaggaataatgccaactttcccaaggtcatttagctagttaagagatagagacaggaccggccgggcgcagtggctcacgcttgtaatcccagcactttgggaggcggaggaaggcggatcacgaggtcaggagattgagaccacggtgaaaccccgtctctactaaaaatacaaaaaaaaaaaaaaaaaattagccgggcgtggtggcgggcgcctgtagtcccagctactcggagaggctgaagcaggagaacggcgtgaacccaggaggcggagcttgcagtgagccgagatcgcgccattgcactccagcctgggcgacagagcgagactccgtctcaaaaaaaaaaaaaaaaaaaaaaagagacaggacctcaaacccataacatgtctcaagagcccaatcccttagcaagtatgctcatctaagaatttcttcctccaaaatatttaggtgtgtgtgtccaaatatctttatcacattataagagcagaaacttaattaaatgcccaacagtttattccatagaacacagtgtagctattaaaaatcatattgaaatagaaaatactcatgggaagacgtctgtgatactgttaagtgaaggggcaaatttcaaaaccagatttataataaaagtatagtttttaaaattatgtgtacaggaaaagactagaaggacatacatcagaatggttcacaatggttttatatgtgtatgtatgtttggggagcagaattttaggcttctgttttgctttgaattttccagttttcttgctttaaacatattttttataattaatataattataaaagaaagcagaaatttcctccaaaaggataccttttagtcccaactcctggactgtaagaaatagattctcagtatgtaaatggtattcctgagcctggtgtgtcccacttagcctaatttattgtctctctttaacagatgacataacttgggagtgattacttatcttacgagaatatatctttgctatctaaaaaaatttgctgtgcagctcttatcttcccttgtgtatgcaataatatatacctgcacattttaggagcacatgattgtaagacaactcctgcttcatatgtttgtaacatgtctgtaggttccaaatgccttaatttcgacattaaatttcaattttaatgtatttgtgtatctcttccacactatttttctgaccaacatagtagaccaactaatggaatagaagggtatggtgctcccacactgatcgggatccctattagaccagctttcattaccaactcacctataacttgaggatattaaaatgaaactcgctgattaataatatggagttcctatattaatcaacacaagtacttggaaccttgcaataacaattcagcggaaggtctaggaattttaacaaggattcccaaatcaggcatccagcccttgaggttgggtcagctgctgcctgcttcactgtcatcctgcattccttggcactttgctgggctccctcattctttcccaaggtgaagactccaggaagctaacatctcaactgtttaacctggtgtttctcattctctttagactggtggtgtgcttgttccagagaaactggctagttcgaaaaatgaaatagcgtttttgctttttattatgatagaaatggagaagtgaaccattgtcatattacttttagtttgcagaacattcagcttgaaggtttaatacagaatgaacatcatgtatcttagtgcccaagtgggactcccctgcacccccactgataattgctgccatattgtgtctatgaacaggttcctggtataaatttacccgtcaatcaactgacctatttcttcacggcagttctcattagtggtgttgtacatgaaattggacatgggatagcagctattaggtaatgatatttacctttttctttgtactacatgcaaaaaaaagcttttcatttaggaggatttattactaaaatctgctatatttgatacttcactatttttctttctgcggctattgcctagtgcatagccatcatttgttactttgaggaagcttctttttttatagagaagattaatatgttgatgaatatgctccattaaccatgggcatatctgtaatcagggtctttctatcctttgccttttccagtgtggttatcctcatgatgcctcaaagttttttaccaagtcctaaaagccaatctttctgttcatcgagtcagaatgataaccactgtactcaaaacccactcaccttagaacttgatttgacttatcagctgaaataatttcctgcttctgcttatgtcctctgctggctagagcaagaaaactgaaagcactgggtttaacaaatatcatagtctatctagaaacccaagtggaagataagaagacacctgggactagctttgagtatcactccctgttcttggtcttggcttcccaaatgtatcattgtaactatacctaagcatttagaagcctataacacatataaaatcatgatggggagagggccacgtcataactcccctgctacctccactgataattacggccataattagcaagcatgctaataggaatgtgttttatcctttcggtgtgtggaccagagaaaaggttaaaaacctctgttttggcagagaagatgtaatcacttcttattactttccagttgtttatgaacaagagtctatttattggcaataaatcctcatcttgacagagcatatactgttacacagatgtgcacaatagtggcttaaagtggtggctgctgggttttttttttcttttaaaatcgccttcagtgctttgcagcctttaggattttacctatagacacatcgttaataacagcttaacaatttacagtatgtttgtaaaaataacttgggtaatttttttttaagtcccaactgccaagaaaaaaaatgaactgtacggttgtcttatatatttagtattaagcaacagcacaatatatttaggtgatacttttttctaggggggctgtttggttttatgagacttaaatattaatttttggaaaatgaactgataaaaaatggttctctttttttttttaatatggagatcaaaacctgctgaaaaaactggttctcttaaggacaatctgagcattatgcatgtttaaacatacttatttaacgttagcttgataggaatacacctagataaatctccaccattatttataattgctaagacaaatacaagttattaggtaatttacttgaattatatcgtctcctatgttcttctctgaaaatagttcagagtaaaccataaaaatgtttttcatttagtttctcataaaagccatttctgtatatatgtgactaacttcaattatttgctcaacatattggtttctaaaaattttgaagttatgtctatttcagtatgccctattttgcaaaattcaatttcacagataaccaaatctgtacattattataaaattaagattatatatagtatagatataatttttttggctgttcagagagactttctgttttttaagcaagaattcaaattacagtgaaaagttttaagattatgtacactattaatttgataaatataatagtattagtaaactcctttttcttatgtgatttcttagggaacaagttcgatttaatggctttgggatttttctcttcattatttatcctggagcatttgttgatctgttcaccactcatttgcaacttatatcgccagtccagcagctaaggatattttgtgcaggtaacagacttaattttgttttaatattcatctgtggttttggttttgattttctatggttagtgctttttggaaaatatatcacaaatgacaatatcttatcttttggttaataacttcagtttataagaccccttcaaaagtagaggagtaaaataatttacattccagttgcttccttaaaaccaactaaaaacaacataattttaaaaaatttaaaaacagaggaaaactttgttttgtccacaacatgaaatcacaaactatgaagaatgtcaactcagctgaaatagaatgaaatttgcatcaaatcaagggagaatatgaagaattgactaagagataaatcaaaagtatccaggaatggaaaaaaagggttatgaaaggatgagtagtgaactctagcactgtcagagttcaatcagagaaacagaatcccttggagatggaaccacagttccagctgagtgaaactgacatacgacaaatccatcacaaccctgcatcacttttaatggaataactgaggctaagcaagtgtggagttagaattctcaaactaacaacgacaacaacaacaaaaaaaacctgaaggtgggaaaaacaaaaacgggaaatataaatactaatttcctcaacttcatagtggagaggacatctgcctgaacctgataaatcaagaaatagaggcttgagtatatcacttaagattataaatgtaaatactacaagatctaaaaacacacataaacttttcaagttatcacagtgaaagcatgaaacacagaccaaagaaaacagaccctatatcaaaagataaaccatggtaatgaatttaagaccaaaacacatttattttgtcaataaacataaatgaaataagctcacctactgaaagaaagatgcccttagtttgtatttaaaacatgtcccaaatatgtgatgtacaaaataaatctgtgtaaataattactcaaaaataatgaaagtaaaatgatgagcagaacataacatgcaaatgggaacagaaaataagaccaaaagcattatattagacattgggggccatttaacaataataaggaatataagccacaatgaaaatataacagttgtgaatcttactgtatcaagtaacaaaccatcaaagcaaaacaaaaatgggaaaagtataagaagaaacaggtaataaaaagactcacgctttaatacatggcagataagtataaaaaagttaggctaaggtaaaaataggtatgtcaaactctataccgtgaacacagaagacaatattttttcaagtgcccatgggacttaaagtcacagtaaattcccaagagaagactagcaaactaagtaaaaactacctgaaatttagaaatttatcttaatcacaccttggatcaatttaattcaaacctgtgatttcagtagatctaaaaattatgatgatgaaatcattttactgagataatgtttaaagttttgctaaaagaaaaatgcactgccttaggcagtcatgcaaatacaaatggaaatagattagttgagtattaaacttaagtgagaaaagaactgtaaaataattaagaaatgatgacgtaattagtaaggatataggcagaaaataataaattagaaaaaacaaaactagatctgctaaatccaagagctcttaaaaaaaaatcaaaggtcgaacaatgagaaaaagcatctaaagacaattagcaatcagattggggaatgacaattgataacagagaaaataaaaacaattataagtgttgtttgctcatctccacaaaaaaaatttcaaaaccctgtataaatataagaaaataaaaatagctgaaattaacccaagaggcaatcaaaaaaatctaaataggcaaataattacaatgggagaaattaagaaagttgataaagaacgccctttttcttttgagatggagtctcgctgtgttgcccaggctgtagtgcagcggcatgatctaggctcactgcaacctctgcctcccaggttgaagcgattctcctgcctcagcctcccgagtagctaggattacaggcacgagccaccacgcccagctaatttttgtatttttagtagagaaggggttttgccatgttggctaggctggtctcaaactcctgacctcaagtgaccctcctgcctcggcctcccaaagtgctgggattacaggtgtgggattgctgtgcccggcccagctactctggaggctgaagcaggagaatcactcgaacccaggaggcggaggttgcagtgagccgagatcgcgcgccactgcactccagcctgggcgacggagcgagactccgtctcaaaaaaaaaaaaaaatccttagtaaaagtaggaatagctgcatacatcataatagcacaacactttgcattcctattaaaggacaagacaaattctactatcaactattactgatattaaatgtcgtattagtgcaattaaataagagaaaaaagcataaaaggagtaggcttttttggcagatactgttatatgggatggacaggaggggaagacatgaaaatcaactaaaatgaaatacataaaaaatcagtaaagagcctgcttacgaaagtggaaaaacaacagctgggcggggtcgcagggtggcaaacgtacgcgggcacgtgcacgtgcttttggggccgacagacgcgccagttgcctaggcgcatgcgtctggctatcccagaagcacctgcgccttccggctcgtgctttcctcagtctcgcgcctttctctgcagctcgcgcctttctctgcagctcgcgcctttctctgcagctcgcgcctttctctgcagctcgccccttcctctgcagctcgccccttcctctgcagctcccacctcactcccctcagcgttctttttcccacggtcttcccgttgccgctaacctaactaactctcagccatggcctccaacgaagatttctccatcacacaagacctggagatcccggcagatattgtggagctccacgacatcaatgtggagccccttcctatggaggacattccgacggaaagcgtccagtacgaggatgtggatggcaattggatctacggtggccacaaccatccgccattgatggtgttgcagccgctcttcacgaacacgggctatggcgaccacgaccaggaaatgcttatgttgcagacacaagaggaagtggtgggctattgcgactcagacaaccagctaggcaacgacttggaggaccagttggccctcccggatagcattgaagacgagcacttccagatgaccctggcctctctgtcggcctcggcggcatcaacatcaacatcaacccagagccgcagcaaaaagcccagcaaaaagcccagcggcaagagtgccaccagcactgaggccaacccggcaggcagcagctccagcctgggcacgaggaagtgggagcagaagcaaatgcaggtcaaaacgctggagggtgagttttccgtgactatgtggtcccctaacgataacaatgaccaaggggcagtgggtgaaggccaggctgaaaacccacctgattattccgagtacttgaaagggaagaaacttcctcctggggggttaccaggcattgatctctcagatcctaaacagctggcagaatttactaaagtgaagcccaaaaggtccaaaggagaacctcccaaaacagtcccttgctcttatagcggctgcgaaaagatgttccgggattacgccgccatgagaaaacatctccacatccacgggcccagagtccacgtatgtgcagaatgtggcaaagcttttcttgagagctcaaagctgagacgacaccagctggtccacaccggcgagaagccctttcagtgcacattcgaaggctgcgggaaacgcttttcccttgatttcaatttgcgcacacacttgcgcatccacaccggcgataagcccttcgtgtgccccttcgatgtttgcaacaggaagttcgctcagtcaaccaacctgaaaacccacatattaacgcatgtgaagaccaaaaacaacccgtgaaaaggagaagacccctctcagacttgggaattatcttccaggactgcggtagggaataaatatgcctctcaaagctttgtatgttgtttctaagagttttaaaaaaaaatgaatcctgcacatttaaggttcgtgttttgttagagtagtaaaaatagaatttaaacgtttttaaaaaggtaaaccttgacataagataatagtgctaagatgccatagcttgttctgtaactatttttgtaaagtttggtcccaacaggagaaaaattcgtagacttcacatcaagagacggttcttacaaactgtttaaaatgggacttttcacattcttagaaataggaagttcatttattgtttacaatgtttttaaaaaacttgttaaaaaattcaaagtgttcatgtttatacttttaggaatatgcttaataagtctatgtatggtttttctggaggttgataactttgggaaagatttactttaaaagagtgaacaattatatgcatacgtgaagtattttcctgcttaaaaaagttatataggtgttatttgttttaatcttggttgtagtcttggatgttaacacatcttgcattttagctgtattaggtcatgtagtattgatattaggtgatttaatagtactagtttaaacctattttagtcattttattttccccaaaatactaccagatgctgttgtttagtgtaatttctttgcctgttcagttaaagtagtgcttgcttgtagaatatattgtgtatatgttgactttaacacttaagaagtacatcctgtgtaatagaaaaagcaaaataaaacacctcttctaaagaaagaaaaaagtagtttgcctatatcagtacagaagttagaactaaagaaaagggggagggtgctactggcatctggtgggtggagggagatcagaaatgccactaaacatcctacaatgcgcagacagccccacgaagcacataattatttggccaaaatgccaatagtgtcaggtgcaggggctcaggcctgtaatgtcaacactttgggaggccgaggtgggtggatcgtttgagctcaggaattgaacatcagcctgggcaacatggcataactcggtctctaccaaaaataaaaaaattagctgagtgtggggcgcacacctgtggtcctagctactcaggaggctgagatgggaggatcactggagctggggaagtcgaggctgcggtgagccgtgatcgagccactgcactccagcctaggtgacagagtaagaccttgtgtcaaaaaaaaaaaaaaaaagagaaaaaggggcagaggggctgggcgcagggctcctgcctgtaatcccagcactgtgagaggctgaggtgggtggatcacttaaggtcaggagttcaagaccagcctgtccaacatggtgaaaccatcccccggctacttaaaaatacaaaaattagctggggttgctggcatagcacctgtaattccagctacttgggaggctgaggcaggagaatcgcttgaacccaggaggtggaggttgcagtgagctgagagagtgccactgcactccagccggggtaacagagtgagactccgtctcaaaaaaaataaagtaaatgccaatagtgtccctgttaagaaaccctgctgtagaaaaagtaaaagtttataagaaagattccagaggtttgcagtacttataatccaatcattaatgggcaagaggttgttcagatgaaagaaatgtttgtgctccaccaccctcattgccgcttaaccagcatgggtaaatccagaatcagaggggtgatctggtactagctacatgcctgacgagataagagactacacaaatagtcaaggaatcagtgctgctgagtgtcccggcttttactcatttgttcatgtcttgtttctgtgactagcaactgagctggggttggggggaattcatagtagtatcctaaattagtttccccagagtaaattactgtgcatcaaaggattaggttttttaaattttgttttaattttgttaaggaagctatgaaagcagtacaagaaaacacaagtgaatatcttttataatcttgaggtggaaaaggcttagtacaaggaactatttgatcacacaaaaatttaaagtatctgtacaggcaaaacaacaaaccacatcaaacaacaaactggaaagataaaattataatacctgttacaaaggaccaaattcctccctatatagattataaataatagcatatacaaattagtaaattaataagacaactcaatcaaaaaatggcaatggatagaaataagtagctcttaagaaaatgggctttaatttttcacccagaagactggcaaagagtaaaattatgatagcatccagtgtcattcagagagtggaaaaatgtcaattatgagagtataaattaattcaataatgcaaactcattggaggtcagctttaatgttcatattttttgacccaacatttccatttctaggtaatttttcatacccttgcagatgcatacttaactggacgcctaacattataagcaaagctgtgtattgcagtattatatgaaaaggttaaaacaccctaagtgattaatagtaggataccttataaataagttgatatgttaataaaaatggattactctgtagcagatataatgagattgatatttatgaacagatatggaaaaatgtcaaaaatatataaatttaaaagcaaatagggtgtgatggctcacacctgtaatcccaaattttaggaggctgaggtgggaggatcacttcaggagttcaaggctgccatgagctgtgatcacagcactgcactccaacctgggcaatagagcgagactgtctctttaaaaaaaacaaacaaaaaaaaacacgaaaaagcaaaatatagtataataatttgataccattggtatttttaaatgatgtatctgtatataatagaaaagatcatttacctgataagtcctagaccatactttgtctggctatttctggaatttaataatttacaacactttaaaaattttaaaaggaacattttacaatgtgaattcattacttggaacatgtgttagctaggtatttggctgctctaataactaaaaataagtggcataaactttcaaaacattccaaatataagtagttcagtgttgatcggataactctgtaatttgggtacacaggttctgtcttgttagctctgctattcccaacatgcagcttctgtgtcgtggacctaaatccagctccatcatagctacattacagcccacagtacagggttgtctccatcacatcctggtgctagtagtgcccataccccgccccataaggaaaactgcaataggaaaagggaagactaggtatgggggaaggggttatctagtggcgtgttaagtgaatgtttaacatctggctctgcagggctaaggtagggagctctgatggtagcatttgctggtttctgtggtgtaaatacttgcaccgtggtcagtttcaagctgcaaacctgcacttcctgaaggaggaattaggaagaaatgcacacaattaactctggcaagctggtaggagcaggcttcagagaaccactgggttcatataaccatatctgccataggataggatataagatgctaaggggaaaaaaagagtttaaaaaatataggcctggtgcggtggctcacgtgagcctgtaatcccagcactttgggaggccgaggcgggcggatcacgaggtcaggagatggagaccatcctggctaacacggtgaaaccacccgtctctactaaaaacaaaaaaaattagccgggcgtggtggggggcgcctgtagtcccagctactctggaggctgaggcgggagaatggcgtgaacccgggaggcggagcttgcagtgagccgagattgcgccactgcactccagcctgggcgacagaacgagactccgtctcaaaaaacaaaaaacatatatatataaaaaacatatatatatatacacatatatataaacatatataaatatatatacacatatatataaacatatataaatatataaacatatatatataaacatatatatatatatatatatatatatatatatataaaaccgactgggcgcggtggctcacgcctgtaatcccagcactttgggaggcggaggtgggaggatggcttgagctcaggagttcaagaccagcctgagcaaaatggtgaaacccctgtctctagaaaaaaaaacacacacactaaaaaactagccgagcatgctggcacgcgcctgtagtcccagctacttaggacactgagtcaggagtgttgcttgagcccaggaggcggaggtttcagtgagccgagatcacgccgttgcactccagcctgggcgacagtgagactgtctcaaaaaaaaaaaaaaaaaattaaatttaaaaaaaaattaaaaactataaaactgtcttgaaaaagttattagaaaacttgctgctttgtactcttgagtaaattattaaaattattacacatgtatactcatatacatgctgatgtgggcagagaaaatctggagtaatggaaaatgataacagtatgcttactgtgagtcatggggctggtggttgagaaatggtatttgggaaagatgactttttattacttctatattgtttggaatttttatagtcagtgtgtattttttagtaattttttaaaagccaattgaacatttttaaattaatttcatattagggttaaaatgtactgagacttctttttccttaaaattgacacctaatgtccaaaactaagactaaagaaggttatatatatccccaccaataattgggtccacgcacctctttcagagcttattaaatggtatagaactaactagtcccgctatcccaaacatcacctagcccattaacttctcattcccagttgtgagttgtcagcctagtagacagctgaacagctttgccctgccgtctttcccaggcaagggggcaaggttaggggtggggaggagatgcttatcttgccctgaattcaagacaggacaaattcaaagatctggaattgtctctaaaaagaagagtttagtatccctgctaaatgtttgctgagctgtgagctcaccgtggtgtagccatcaaagtggaagacaacgtgggaaacctgtgtgttcctcaaagtttagggatgtacataaattatgtatttagagggagagagaaatatgtgtgtaccctctgcctactttattggttttaaatttaggaatataatttcattgcttctaaaatgtcttcccacttccatgtaaaaagtccagggtgtcatttaaatctagttttttgttttgttttgttttgttttttgtttgtttgtttgagacggagttttgctcttgttgcccaggctggagtgcaatggcacgatcttggctcactgcaacctccgcctcctgagttcaagtggttctcctgcctcagcctccgaagtagctgggattacaggcacctgccaccacacccagctaattttttatgtttttttagagatggggtttcaccacgttggccaggctggtctcgaactcctgaccacaggtgatccacccgcctcagcctcccaataaatctagttttataatgctacttttaaagagttgcatatataggccaggtgtggtgactcacgcctttaatcccaacactttgggaggctgaggtgggcaggttacttgagctcagaagtttgagaccagcctgggcaacatggcaagattccgtctctactaaaaatacaaaaaattagctgagcatggtggtgcatgcctgtggtcccagctactcaggaggctgaggtgggaggatggcttgagcctggggggcagaggttgcagtgagcagagattgtaccactgcactccagctggatgacagagtgagaactctgtttcaaaagcaaaataagttgtatatgtaataggtttttttctttttttctttctttctttcttttttttttttttttctgagacaggatatcaccctgtcacccaggctgaagggcagtggtacaatcaccgctcactgcagcctcgacctcctgggttcaagtgatcatcccacttctcagtctcccaagtcgctggcaccacaggtgtgcaccaccacacccagctaatttttgtattttttgtagagaggcgggtcttgccatgttgcccaggctggtctcaaactcctgggttcaagagatacaaccacctcggcctcccaaagtgctgggattacaggcatgagctagagctaccacacggggctatttctttaaaaaaaaaaaaatgaaatatatactgattttgaaaagaaaaagccactaaacatctgtctgaaatttggtggggaaaaaagagagatgagatgagatacttcctgagcacactgtaaatgaagatgtttaaattttgaattatggtgtatagaatttttagaagagggattaaacaatacctgctatctggttccaagtgaagagtagattgctttaaaaaaattctctatgctttgttgctaaaaattcctttataaatagtggaagtaaaatttgaccattctgtttctatacttaaatgtttttaaatccttcttaaatattgaaaaccctgttcttatttgtataagccagttgtaagtttatttgagggcaaagtaaaaaacattggtgataaaagtgatgttgtgattatagtaagctggaatttaaacttagaacacagtgtaagccttgccaaattgatagtttacattctttcagctataactactgtgagttattcaaggaatattgagttgttattttacctattcagtcatctggtgacctgtaaatcatttctgtgtgtttagagaattaaggtagttgtggtttttttttattattatttgcaaaccacactaagcataagtagggcttgattggggtagcccttagcccccgcttaataataatcaccagcttcaagtctatgggtatcttgctgccttgatgacaactatagattttcttctcccttgacccatgatttttgtttgtttgtttgttttgtttttttgtttctttgagacagagtatctttctgtcacccaggctggtctcaaactcctggtctcaagtgatctgcccacctcagcctcccaaaatgctgggattacaggcatgagccaccgtgcccggccccatgatatttttaaaccctgagtctcccatattctgatttttctactgttgccccagtctcattgcttagtatataaaccagaataaaattgatcctcaattccatctaagtcctactgtttcttggctgttgttttattaaaatcatgaagaaagcaaaaaaggcattccatcacaactattgaaaagtgttctagaagttacagtcattgctataagaccaaacaggaaggaaaagatgaggtatgaatgttggaggagataaatgattattattagcaaataatggaaaatccaagagaataaagactaagacatcctaaatggaaagttcagtttggtgattaattacaaagtaaatatacaaaaataaatgtagtattcctgtgtatctgaaagaaacagatcatgtaataggaagaaaagatctcattcagaaagtaatgtgacatataaaaaataaaaaactaacattttaaaagaagtacacagggcctatatagagaaactacaaatctgtactgagagatgtagaagatttcagtaaacagatgtcgtgttcctatgtcagaaatgtaaaattatggatttacccctagttattgcagtcattgtagtgacattagaaatcctaatgtgggccaggcgtagtggctcacacctgtaatcctagcgctttgggaggccgaggtgggcggatcacttgaggtcaggagttcaaaaccagtctggccaacatggtgaaaccctgtctctactaaaactacaaaaaaattagccgggcgtggtggtgggcgcctgtaatcccagctactcgggaggctgaggcaggtgaatcacttgaacccaggaggcagaggttgcagttagctgagatctcgccactgggcaacagagcgtgactctgtctcaaaaaaaaaaaaaaagaaaaaaagaaaaaaaatcctaatttgaataatatttggtggttgtcaaaatgattctcaaatttatcagaaaggataaggggagaataaccaaaataaacaaattgaaagtatttatttactaaatactgaaatattactaccagcaacagctttattgtcactggaatagtggaaaagaatggaaattccagaagcaagccaaagaatagatgaaaatgtattgtaaattaaaagttgcatttaatttagtagggaaagaatgcactgctcagtaattattagctaaacatttgaataaaattagttatatgtatcagtcacaccatacacaaaaataaattccaaatggtaaaagatttaaatgtaaaaatcacacacatacacaaaaataaattccaaatggtaagagatttaaatgtaaaaataaaactatttaaaccatccttctccacaaaaagagtgattacttacataatgttaggggcgagaaagtcttcctttgcacagctgcaaaggttgaatatataatggaaaagattaatgaatttgagtacctaaattttagggtttaaaaaaaaataataaagacggttttctctttttttttttttttttgagacggagtcctgctctgtgctatgtcacccaggctggagcgcagtggcacgatctcagctcactgtagtctccgcttcccgggttcaagcaattctccagcctcagcctcacaagcaactgggactacagacgcgcgccaccatgcctggctaatttttttgtatttttagtagagacagggtttcaccatgttggccaagctggtgttgatctcctgacctcgtgatccgcccgccctggcctcccaaagtgctgggattacaggcgtgagccaccgtgcctggccgacagttttcttatggtttgttgctttatagtctgtgacgtgatgtaaaatatatgctcggtttgttccaccaatattgttctgcataatagtttagttcttaaaacaacctcctttttccaagtaccatttgagtttctgtacccctgtttagcaagagttttttttatttgaatgtatatgaggtttctttcaaagatcacaaatatgtttaaattagtgatatatacattttctgaaaagagagtataattagtggaagatattagttctatcagtatcaaatcatgttagcatgtggtcttcctagtgtggtattaacatgcccattttagatttcaatatctaaaatgaaagtaactaataattgaacatctgtctgctctactaataagtagatatttttgcctcattgcttcttctgatcactttattaatttatcagaatgcccaagtgttgtgaggtccagctacttatatcattcctgcccccggttgagcttattgctttttttcctctctttccaggtatctggcataattttgtccttgcactcttgggtattttagctcttgttctcctcccagtaattctcttgccattttactacactggagttggggtgctcatcactgaagttgctgaggtaaataatggattactcagggcattctttcatcagatgttgtgatgtaatacctagcatctattcagaaacttttattcaagatctcttcatatacaaaatgcttagtttcttctgaagaaattactgtagtcctctcaaatctaacaaataatgttgggaaacacattggtttttttaaagtttcatgaaaattgtttttgtcctgatgctgtacttaggaagatagtatcaagattttctacctgtagtttattggtaaaatgcatcatttaccttttctgtttatttttatatctctgcttttgagtcaaatgtctttacgcctcctaagtagtaagaaagatgaaacctaggctgtccagccgtaacatttcataggagtttaagttaatgtcttcaactctgtatttcactcccttagacaataactgctatgatggcatcaaatcttgtattcagacattagaaagaggaaaattacctttgtgagcaattggcttacatatacattgtactgatggtattgcctgcatattggggatatgaaaggatgtgtcttattgttttatgcgttaaggatataggaaaggcaagacagtctgatgatactttcaccaaaaaatttttaattggcagtttgggaaaaaattttatcattttagtcttaacagtcagcaagtcggctttttttcaattgtgaaaaattcaaaatcttggagaatttgggaaaagcaactataattgttgggttttattttaattttctaggactatgtcttgaattcaaagctggattattttctgcattcaaactattcacttaattaactcagtgtctttattatttgctcagattaattatagcttgtcttcatgcattatctgatttggttttaccctcttcccaaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagaggtgtgtatatttcctcaatataatataatgcttcaagcaccagtacctgccattcactaatccttaaaccatgtctatacatttattctgttctaatctgtttaaagcaaatcagtaaagtaaatagattccaaccaatagacatttttcttggtaagttggatgctaatatgtgtttcctttattatatattgttgaacttctaactattttcattatatcatatttaacttttaggactctaatattttctgctttcaaaacacttgtattaaatcatagccgggcgcagtggctcacgcctgtaatcccagcactttgggaggctgaggcgggcggatcacttgaggtcaggagttcatgaccaacctggccaacatagtgaaaccccatctctactaaaaatacaaaaattagcagggcatggtgacgggtgcctgtgatttcagctgctcgggagtctgaggcaggagaatcgcttgaacccgggaggtggaggttgcaatgagccgagatcgggacatggaaagagactctgtctcaaaaaaaaaaaaaaaaaatcagcattcaaggtcaatcataaccaattaactaattccaataatcaaataccccaatataatattatctttatgcatgtctgtagatatattatagtactttaaacttttataattgaaaaagggaatataagtaataagaaccggttctactttgcataagcttatgtcagaacagataaacaacgatagttaacaactaaatatataaaaatcaaagcataaacattctgtattaatatattgttagcccaacacagacatgcaataaggaaagattacaagaaataagaaggaacttggcaaacaaaaaaccccatctgggatttagaaaaaattcccttacttcttaaaaattcccttaatacttaaacagttctagtggaatcagtgttggcatgtctgattctatctggggtagagttattttatgtattttatgtggcagccatcctaaagaagttgtcttggcttccaaaaataccatgtgaagtcagatatgttgctctgtgcagcagatgacagagctgaggcaagtttcttctcggatcctgccaaacttatttagagttatttcagctctgaaaaatcagcttcccaattctttatacaaaatcagcttcccaattctttatacaaaattggaggtgttagaaaatagaaattatgctcacagactatatctttaagtaaaaaaatatcctgatacttgtccacatctattggtgtagggaaatatgattaataatcaagaatagttttagtaaagtactgtgtgcaacacaggcaaagtagtaagaactgatttttttaaaaaaactttttaaaatttactcatttgtaagaatttttttattatcaaaaatgtttagacacgatggagaatatatttcctcaatataatataatgcttcaagcaccagtacctgccattcactaatccttagaccatgtctatagatttattctgttctaatctgtttaaagtaaatcagtaaagtaaatagattcaaaccaatagacatttttcttggtaagttggatgctaatatgtgtgtttcctttattatatattgttgaacttctaactattttcataatatcatatttaacttttaggactctaatattttctagtataaacgagcccacatgtatctttctgccagcttcggcagttattaacattttgccaattttttcatctaagcagtccacttttaggggaagtattttaaagtacatcccaggcatcctatcatttcatccataacctttcagcctgcctttaacggatgatgactcattaaacacgaccacaatactgttataattcctaacaaaataacactaatttctgatatctggttggtattcagttgtttctaattcttttcattatagttgatttaaattagttaggatgtcttctaagactttttaaatttgtaacaattttccttgacctgtttttgaaatgttatttttttgttgaagaaactgaggcatttgttttgttgaatttcctaaattctgggtttttctggttatatcttatcctcatgatgtcattaacttgttcagatgtcttccaattttctataaactgctaattaggtccatggcgttgattagattcagaatcctttttttttgtttgggttttttttttggcaaaaacacttcataaacagcgcttggtacttcctgtggcatcatattgcatccagtatctattgttctctgttttaatggtgttaagattgttcagtggagcaatctgattctttaaggttgaaatatttataaattttccccattctcaggagcctcttaccatcttccaaaacttttaagatgacagaagattaatatgtaatccacaatgtgttcttctttaaagaaatgatccattattttccacttcttaagtcctttatccttttcttttggtttctctaaatttgatgtaatgtgtattgaattacaaaaaccaaagtgacacactagttaaataaagttctcttcagtaggattgttttacttaggatatctgcattttcagatgtttagggttttatccttttcctgacagacagactgtaaataaaaattttccctgaaacactcagaaactctcttcttattaactgtttgagtatttcactgttgtggatcatgtgctacattttggaggtatttgtttaaatacctaaagcagatattactctttttatactacaatcaatccagaagtaattcttttttttttttttcaagccctgggctgtcccagcccaagagtaattcttcaatatctattttgtctcagtatacatgtttattttacatgattactatatctgataaatctgtgcctctatttaagcttttgaaaatggagtatgtatacttagccagtttaaaggagtattaatgtctgtaaatatcacttaaaatacatactatggctggtccaaatgcagttgtgcttacaattaattgaacacaaccagttacagaattctttgttccttctctattcccactacatcacttgactagccttaaaaaaaaaatacatactagattaattttgatggcaggcttagcccctgggtctgtggacatttaagaaagctatggattgatggtattttatatgtttctaggtaacttcgttatccttcattgtaagtaggagtgaaagatatggtcagatatactattacagagtgtccaatgatccaaaagttattcatgttcaatttagagtagaattcagtacacataactaaattctaggaatttataccatttcagagcaataaagccacctaggaaagatcacaccctggaagtgcttgtaaaccatctccaccaattatctctagcctcttatttcatatcctgtctctctcagatgcagtattagatttaaactctttgaaggttaaacggccttttggggaaactccaagaagaacactgagtgagggcttagagccctttgtacctggaatagatctctggtcttatctgggtcagaacagaaaaacatacactcttcccccattcatattgaagcctctgcttttagggttgctggctgtccatacaccactcagtgatttaaatagaactgaaagttttagacaataactagtatggctcttttgggggactattttcctagcaagtactttgtattttcactctttattttgagggaggcactccttatttcatatatgcataaagctaaattcctttttgatgaaagcattgtcttgagtaagaaaggctgtccttagcaagtccagcatttgaactacattttaaggagcacgagacagaatgctaaggcaactctgcttaaaatgaagctgtgagcccagactcaggcatccaccgtgaacagtttacattcctgttcaaaggaggtgagggtttatgcccttacctgcctggcaacagaaatattaaactgtcttacgtatctttaactggaatgagagaagacccttcttgacccagtttaagataataaaaggaaaactctgggaatcttttcaacaaactttgagaactcagattttttttatgcccaaattgctctaatatttgaaaagcaaaaagacctttttttgttattatgagcatcaagttatggtccaaggtttctttgctatcctaaattgaagagtaagagtgtgtatataagtatatatgtgtgtgtctgtgtgtgtgtgtgtgtgtgtgtgtatatatatatatatatacttttttttttttttttttgagatggagtctcactctgtcgcccaggctagagtgcagtggcgcgatctcagctcacagcaacctctgcctccctggttcaagcaattctcatgcctcagcctcccgagtagctgggattacaggtgtgtgccaccaagcccggctaatttttttgtatttttttagtagagacagggtttcaccatgttggccaggctgttctcaaactcctgacctcaggtgatccccccgcctcggcctcccaaagtgctgggattacaggggtgagccaccacacccagcctcgtgtgtgtgtgtgtgtttaattttactacttgttactaggcaatgatggcataaagtcagcaacagaactgagaataaataggcttgcttccctgtgttggagccctagctatgtgttatatatttaataagctagggtaagaaaattgttcagttcatattagagatacagaaagtggtaagcactgtgaactagagactgaaaaaatctcttctctccagctttattccacagtcacctctggtctagaccattctttgtagactggactatttctgtgactatcttcgggctcatcttagggtacattcaaaatatacaagttctccctgtagtaacattatgaaacttttctggccttaaatttttctgattgtctcccacactggggatatttaaaggacaattctaatcttctagagttaaattgaacccataaattcccctggggacatcctattgcaatcttgaatattagttccaaagtagaattgtattggcctctcgtaattaataaaaatacatgaatgtaaaaattatctgtgttgcaccccctcatcttatagattaagaatcaagtcacagaaattggttgagtaacttgttctttatgtgacccagtagaaaagattctaaaattaactgtttaagcctataactttttaaaatagtgatagagaaatatcaagtttacttctcacatgcaaacaaaatatttcactctttattggaaaattcagtatgttaggaggtacttaatcttgtcagggaggccacagccatggatttctgttttgcttggaataaatgccagaggaagaaaaaaccagagatcacaaattggtggcagcctccaggccaaatccagccttagcagatgtatttgctttggcttgcccagtgtttttaaatttttaattggctgccaatgtttaaacttcaacaggcttcacatgaaggttcagatttctggtttctgttgggacaaaatggaagatctgtcgattctgggccccaaattgagtggcctggctgctaaccccctagaacaggccatgtattttctagttcctcacagttcccaccactttgttttttctgcatatgatccacttcatttatttggtaccagcttggcccatttaagcatttatattagcaaacatgccgtatcattagcgataataaattcctgacttccaattctgtattgtacccagtcctcttaagaaaagttagtaattaagcatcagctgtaaacattttaagatcattactgatgcaaaggcaaatcgggtataacatcatttatgtattcagtgtatattgagtaatccaccttatataagacactgagaaacctttccctcagggagctcaaagttgagtcagaaaaacagaccatacccacattattacagtacaagtttaaatttaagtaatgacaggcaatactgggaaatgataacagtcttgactgagaagatgaaggcaggtttcacagcatcagcccttgaactggccgtcaacagtgagtttacttttaggacgtcaagatggacatggacctcagcaccatagaatagaaggtggtcaaggaactgccagtaattcagtttaggaagagaatcatatgagataaggtagtttaaaagtgagaaggaattagtctgcactcaagagggaataggtaaggagaaaaatgaggaggaggtaaaaatccatgggacttggcaatctgatcaaagagaatactgagggttttagcttggattgatttttctaaagaattcctaaacaactttttaccttatactttaccattagggctgacagatgattataggctagcatttgtctgtgtcattagatgctcacagtctcctttaatattttaaatactgctcctcactcaaaattaaatacccattcagttatgataagaagacagaacaggccagctcagtggctcatgcctgtaatcccagcactttgggaggcccaggtgggtggatcacttgaggccaggagttcaagaccagcctggccaacatggtgaaaccccattgctactaaaaatacaaaaaaattagctgggcatggtggcacgtgcctgtaatctcagctactcagaaggctgaggcgggagaatcacttgaaccgggaggcagaggttgcagtgagccaagatcacgccactatactccagcctgggtgacagagtgagactctgtctcaaaaaaaaaaaaaagaaaacagaacaaagaacaaaattacccatacagccaatcaccagttagtttcctttgcctctgtttggttctttgctatgttttggccaaggagatagagcgacagtgtatgcctaggggaaatccagtataaccaatacaaagatgtcttcctcaaacaatagagtaaaacaaaacaaaaaactatttaaaaacaagcaagcaaaaactttggctgaaatacaaaatttttataaaattaaaattacattgcatatcaactaagtttttcatgctaagtgctcctgaaagcactcttgtaatagaaaagctttttgtagtcctgagaaacagggataatttggcgcttgagtctattttcatcagcacatctgagtatggtagtttatattcaagattcacatttaattggtccttgccacccataaatttatactttaccagtttgatgtgttggaatgcagcaaacattcctaaataaatacatgaaatcattttttgtcccaccttataagtgaagtagattccttattctgctcccaaataaagcagtctactaaagaactttaaaaaataaataagccaggcgcaatagctcacgcctgtaatctcagcactttgggaggccgaggtgggcagatcacttgaggtcaggagttcgagaccagcctggccaacatggtgaaaccccatgtctactaaaaatacaaaaattagccgggtgcagtggcgcatgcctgtagtcccagctactcaggaggctgaggcaggagaattgcttgagcccaggaggtggaggttacagtgagcagagatcgtgccactgtactccagcctgggtgacagagcgagactctatctaaataaataaatggaatgaacagttgccccattgctgttgtcttccaaaaatggtaactggattactggtgtacaggcgggtatgtgcacatctgtgggtcaaattgggcatctctggttctctagggggagccccaaagtaagcctggggtagaatcggtatttggatataatggggatgtcttaggcaacctctggccccctctgtttaccagcaccacagtgcaggggttcagcagtaatgttggatcattggcattcaggcacataatagtagttcattaaatgtttgtgcttgaccagccagacttattattgtgaaacctactgagacactgcaactccggctttatgggtagctcagtttatatgaggacaactaacctagggtaactgctgcttcatgatttaaaattgaatggatctcttttggtaatgtaaaatcaaactgcagcaagtagccctcaagctgaactctgaattatacagttgcttctaaattcatatgccattttacttattctttttgtcttaaaggcattttttgttacaaatgtatttttatataagagactctaataaacagtgtatttctctttagcatacaaacgactagatggttcaactgaatgctgtaacaatcacagcctcacagatgtgtgcttttcctacagaaataattttaataagcgtttggtaagttgtccctgaagcagtcttgcttgtctgatataattactaaaaaataagcatatagagctaaaatggaatctatggaaacttctctcttttgctctatttgtatcattttattaaaatctctacatttcacatgtcacatttcatctgaaaatctttaaaaatttatagtgataatatcttatttgacccaaatggggtacttgaatctattttatagtagatgcacataaatggcatttcttttatatgaacctcattcctgatatgctaggtgacatgaaaaatattgaaggaatgtaacttaggtttttcttaatcatttttaatattgactgattaatattttatttatagcatacatgtcttcctgcccggaaagcagttgaagcaactcaagtttgcagaaccaataaagactgtaaaaaaagctcaagttcaagtttctgtataataccttctttggaaactcacactcgcttaataaaagtaaaacacccacctcagattgatatgttatacgtaggacatcctctgcatcttcactacacaggtgagtatttttgtggtagacccttagaaaatcattaagatcacatatagtctcagtggtagagactcactacaaatccttgaattaatacatttattataagtttgatcatttatcaaagtcttgttaacttgttcttaagcattaagtgaaaattatgcagtaggaaaataatctgaatttataaagtaaggtggagctgaatccatgcctgcctatggagagtgacacatttttccttccctaccatttatgcccaggtcaaataggtgatctctcagatgtcctctgagagtttattaaatttatacaagctccccaaaacaggcaagagcaacataccctagagaatgccaggatgcatggggatgtaactgtaatttatgtgtgacacatgactttcatatgaatatactttcaaaactgggccagcataatcattttagcagtggcagcatcattggactaagttctttatggctaaagatcatgtagtctaactcattttgttgtacaagatttttaaaatagtttaccatgcgatttacccattaaagtttacagttcagtggggttttgtttgtttgtttgtttttgttttgttttgagacagattctcactctgtcgcccagactggaatgcagtggctcaatcttggctcactgcaacctccacacctcgggctcaagtgatcctcccacctcagcctcccaagtagctgggactacagacgtgttccactgtgctgggctaattttttgggttttgtagagacggagtctcactttgttacccaggctgatctcaaactcctgagctcaagcaattctccctcctcagcctccaaaagtgctgggattacaggcaagaggcactgtgcccggcccagtgatttttaatatattgagttgtgcaaccattaccacaagctagctgcagaatattttcatcaccccaaaaagaaactccataaccattaagtagtcactccctgtatctccccaacacccccagcccttggcaatctccaatctactttctgtttctataaatttgcctgttcttgtcatttcatataaatggaatattttatgactagcttctttgatgtagcttaatgttttcaaggtttatctgtgttgtggcatgaattagtacttcattctttttaaggccaaatgatattcctttgtatggatagaccacattttctttattcattcatagttaatggatatgtgggttttatgttattctttttttttttttttttttttgagacggagtttcgctcttgttgcccagcctggagtgcaatggcgcaatctcggctcactgcagcctctgcctcccgggttcaagcaattctcctgcctcagcctccagagtagctgggattacaggtgcccaccaccacgcccagctaatgtttggtatttttggtagagacagggtttcaccatattggtcaggctggtctcaaactcctgacttcaggtgatctgcccgccttggtctcccaaagtgctgggattacagcgtgaggcaccgcacccagcctatgtcactctttaaaagactctctcattgctccatagtcatatcctgagatacaaccgaggtcatttttcttatctattagtttgacactaaattactgtagactgtaactatgaaataaaacctcaacaaatgaataaatgtccctagtgggggtaattcaggaatgtgtactgtgagttctgactaattacaggatagttttaaaatgttttgaacaaaaacaggattatggaatccacagagtagatgagactttaaatcccctcatcttaatccttggtttagccatgaagaaaaaaaaaagacctgaaagaggttaagtagtataatagtaggagtaaatgtaattttaaggttatacctctttgaaagggtaaggactcttaatgtaaatttcttactctcgcctcaaaatgtaagtacacactgggacgtattttttcattctgctgtttttattagatgttctagaagtattgattgcttttatatatgaggtatatggcctgcatatgtttaggaagggctttctcaatcagtttaatctgctagcccaatttttaaccatatggtagaattcataatgctgttgattctctggtatgaataatatttattattccttatttttctttttcagtgagcatcaccagttttatcccacgttttaactttctaagcatagatctgccagtggttgtggagacatttgtcaagtatcctttctggtgtgaaacatgttttaaaagtgtgttacttggatcttgatcaattttaccttgaatacagcattacaaatatagacctcacaagtatcacttaattgctaacaactaaaaaagagtcttgaaagatgaaaaagatcagattgtacccaggagggaagaagtcagaggagaaagattaatcagagtgagaaaggtttagatgtagaagggaaagaacccagaatacaaattgagaattgaatttacaagtctaaaacattttagtaagtttataaaggatggaagcttcagttactactgaggtaatgaattctgccccatccgagattgttagttctgaccaaatagagaatgtaatcgcataaccaggaattatgtaaatcccagggaggaatgcacaagaaagatcgagctggtttcaactactaagatagcaattcagagggccaaatcttattgtggtctttcgcatattatgattgcacataaaagatgaattttttcatattaattattatgcagaattgaattactggaaaattgtggaagagttctttatttttgtcgcttttaaattttttaatgtcgttcctcaattatttaaattaaaaaaagaaatggaaaacaaatgagcagttatttttaaaaaatgtgtttaatcaagattgtggccaggcgcggtggctcacacctgtaatcccagcactttgggaggccgaggcaggtggatcacctgagatcaggagttcaagaccagcctgaccaatatggcgaaaccccatctctactaaaaacacaaaaattagccgggtgtcttggcatgcacctgtagtcccagctactcaggaggttgagacaggagaatcgcttgaacccgggaggcagaggttgcagtgagccaagatcgctccactgcactccagcctgggcgacagagctagactccatctcaacaacaacaacaaaaaagattgtactttatagactctgcagctttgtcacaaagagacttatgctataaccttacagagggtagtaaaataaagtaggcttcaaggaccaaagtctttgtttcctaatataaagtaatactttgtaaggcccaaagagtaattttccccttatttcttattccttccacattcctttccctgttgtatcattaaaggattagaaagacttagtcttcctacgagttcattatagattggcttagtttataagtggttggcctttatttttctagtcaaggtttttgaactttgaaataatataaactcattttttttaagtagtagagatctaagaaggaatggcagagatttaaagaaagtagagaagtcaagtgtaatctctaattcagtcacagtaaaatatcttctgactcatagaaatatggtttctactcagacctctcacagttggttccttaactgattttaacccaggtacctgatttccctctcaggagctctggctattgttaatgcagtaccctgctttgctttggatggacaatggattctaaactctttcttggatgccacccttacctcagtgattggagacaatgatgtcaaagatctaatagggtttttcatcttgctgggtggcagtgtacttttggctgccaatgtgaccctgggactctggatggttacagcacggtaatgtttgcactcatctgacagaatccctgagttacagtatacagctatgtggtaatattcattgccattgaaattcttacttggtatgaaatataaagtgtttccttaaaattacatcttagccaacaaccctgagctcctcccatatccagagtacccaaactctgtggtagaagataagcagaagaaatgaaaggcatagtccctgactatattctaatttaggactgaatgtacccagatgcttgtggaataatatctaagcaagtgcaaattcatgtaataccgttttgtctgattacatattgtgttgaaatagtataaaggagaacagaactgggtggaattaattgggaaaaacttcttacaaaagcatcattaatcaaaatttgaaggagaccagactttggccaagtggaaggatgaccattgtcttggcctgtatctcttgtcctttgtcttgtttgaaaagtattttaaaacttaatggtgtattattttgtgctctgaaagctgaggtctgattacaattagtaaaattctatagaagaatctgctgacgtgaaagggaaaaatctttgtcaaatgataccaaataaatgaacaaaacaggaagtagggcctatgatatcgtgagacatgttttgccccacaagagttgcatcttttataaggtgtctctgccccctcataaagcagcactagctttgacatccacggtgagctgcaggaagcatcacacaccagcagcatgtgagcagagggaggcagttggggttgaacttcggaactaggccgggtctcctgacagatcacaagacaccccagaggatcttcagcagtcctacttcccattctctatagagctttgaagcttggaacccttccagggtaaacattttctcttgtgctgctcaggacatctggggcctagctcctgggttcctgtctccaagaagcaatgaccttaaactctgagccatactctgtcctcaccagcggctcccatgtttttctgtgtcaggttattaagtacctagtccttgttttctgtctctctcctaagctacctctctgggtccacagaagacttggtagtatagtgagaatggctatacgtgagtacaaacgtggattttccagggcttgggaactgattcttgagcccagaagagccacgcctgctttgaggtcttttggagtggagatgcagccctgggaaatttggggagtcagcaggccagtgtgaagctattggtcctaggagtatatgagcttgctgtttctttgatggaaaatacatgcttctcttgtatactcagaagtgactaagggcaataactcattaatagccatctatccaacttctttactgagtgatgtattccatggggttacctttttcagattattgagttgctctgtaagcactaaaactttttaatcatttttaagaaactttttagattgtattacaaatttgccttaacagtaattagatgttgaatataattttaacattttattaatgacttgggtcatcagttaataccagtactaaaaccatacgaattattggtttattccagaaaatacagtatttgttctatttttaggtagacaatcatttgggatcagagtacattagcatagtaatgctcagtcagacctgttcaagtagtagagcttggagaatgccatgaaatacttatataattaatttgattgcatgaactaagcaattttactaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaata

SEQ ID NO: 17600 - DNA, 50383 bp, Human
ttttacagctcaagaagctctactgttcaccttctaaaagtcttttgtgacaggaaatgcttttttgacagcaggactagcccacctgcccagtagtaagtctgaggtagagagatgcaggctctagaccttgaagattgctctaatgccaaagattcttatatctggtgcaggcaagaataggtgggtgtgtgcatatatttagtattgtgctggcgcagatggagcccactgtgtacatctcttcccaacactgcattcagtgacatggtgttggtagcttgaaattgaccatggcaatcaacaaacactacaaataaaggcttggttttgtttgtttgcttgtttgtttttactttttttaaaagagccgattattaaacatttacctgtgcatggctgaatatattccataatttatcttttcttttagtataaacacattttccccattctttaccataacaaaaaaacttcaatgaatatgctatgtggaattttgtgcacatatgtgtgagttcctttagcatatagacctagaagtgaagtttctatcttatgaactgtgcacatttcaacttcattagatagcatcaaattgatgtcctactagatttcctattttcttaccttcttgttgacacttgatattgtcagtcttcttaatttatgccaatcttagcttgaggtggtattttactgctatttgaacctataatttttctgattacttacgaggctaaaaatctttttacatatttattggccatctgggtcttttgtgaatttgctactcatattttttgttcattttttccttagataatctcctgttctttttattgatttgtagaaattctttacatatcctgaatacttattcttattcaattatatgcagtatacatatcatctctcacctgtggcttgtcttttaatcatgttatgtttttgtcataaagaagtttaaattttgatacagtcaaatgtattattcttttcctctgtaatttctatgtttttttcatgtttaagcaatctttcttgacctaaaggttaaaaatatgttcctatattttcttttttgaagtttatattttcatatttaaatttttaatctatctagaatttatttttgtcaatggtatcaggtgtacatttaatgtatttcctcatatggaaatgcaattattcccacattattatgaaagagacccaagtttccctcttgcctttttggttcctcttatacataaaagccctgcatatgcttgcatctatttggatattacctattccagtctatagattcattttatctttatttttggaactattacactctaattactgtaactttaccaaagctcctgatattcttttgaggcaattcttttctctttattcagccttttcagaattttcttatctattcttcaatgtttactctttcatgcgaattgaaccatttgtcagcttggcaagttccactgaaaaccctgttagattttttactagaatgacaatgaatttatagattaatattaaaacaatctattaatatttcatacatatgtacatatagagagagagtcaggtatttttatgtccttcaataattgctttataacatttccataaaatttgaatttatattttattagaattaaataataataattttataaattatttttatttttattgttaaggggatcgtctatcctgttttatgatatgaatggctatggctgccctataggaatgttattagttcttatatgctcatttccgtattaatttttcaaacttttccccagtctttggagcttaagcatttaaggtaaacttagtgtttgtcctcgaaagagtcaatgatgttatctttgacaacctttattggcactacggtacatatggaagggtcaaagtttctaatacgaccgtcagggtaaagtctaaacggtatttatgacaaggtgtgtgctaaaatcagctcacttgcagcaatggcttggattagatccacttgcattctcttttttaccttgctttttgcccacatagcagctgtaccggtaagtcgagtcctgctttttggatatttagaaatattaattctagtatacattatccattttctgtatatttatttttttcagattaagtatcttcctgaagaaaatggtaagaattagttcaaatgcacagagagtgtttttgaacttttttccttcggcaagactaataataattttttttctcacttttaacagtacatgatgcagattttggtgaacagaaggatatttcagaaatcaatttaggtgagttcaatttttgtgttattaaagtcttgaaattacttgaaacccagtggtgggattactgaacactttccttcctaatactgtattgtgattctctgggggagaaatattttttggtgctttgtgagaaattgcattttctgaaagataaaaatgcggaaagagaagatagttagaccagactttctaggagagctaggaagtcctcaatggatctagaaatatgtaacaagtttctctttataaaaattttatttttccaatttgtatttggaggaaaaggaaagcaaatagataattattccgattgttaaagaaaaatataagaataagcctctggttatatttagtggggaaacaaaacccaacccctccactggcccatcatattcactaacaactcctcggttgagacttaggggtgagtgtaaagcaatctccacttagacatctcatttacaaatatatttcttgaagaaattcatcagtctcatccattactgagaggagagagaagctgagtcatcatctctgttttctctctgttgtcctgcttctgaaatgagagagaagcctctgcattcccagtgtcttaggtcaggatttgtggaagcagagctattcatgataataagtaccttcagtttacaaaagcttttatatgcaattgcatatttatttgtccagtcttgtcgtggagtaagtgctgttttcatttttttgggaagcgacaggtggcttctcatgggtagagtgacttgctcaagatcataggtagcagtgatggggcttacttccagatcttgtagcccataccttaatagctcagtgctatctgaaggctacaaaactaacataccaataactaagggtcaatttttctggctttgtctcactcacagagaagccagttagttgatatttaattggaatagctggagaatggctgcataggcagagcagaaatagtttaggaaggtaaatgggtgaatgcataaatgggtcccaagacttcagagccaggcactaaaatatctctctttagagttagccattgtgtaaacagttcagagaatctgctgtattttacaacagaaatgggattagaattagagtttttctaatctcatcattatttatctaataaaaattaattatttacctctttgccattttgtactctttaggcccaccaccacctctgatccttgaccccagtggagaaatctcattaccatgtaaatcttctttttaggccatttcaaccaaaccaccaggattgattgggttagccatatggccagattctaacaccataaattgggaaaatcatatagagaaaattgccacctttttaccatcttctttttgcctcacaaggctgagtaaacgtttcttatcctccatcccaagacctgctcctctcagtccttttcatttcagtaaatgtgactcactccttctagattttcggctcagaatgttagagttgcccctaactcttgcttttctctcacacctgacacacaatctgtcagcaaatgttattcgatctactcgatctacttttcttttttctcttttcttttcttttctcctgagatggagtgttgctatgtcacccaggctcgagtgcagtggtgccatctcggctcactgcaacctccgcctcctgggttcaagcgagtctcctgcctcagcctcccgagtagctgggattataggtgcccaccaccatgccaggctagtttttctatttttagtagagatggggtttctctatgttggctaggctggtcttgaactcaagaccttgtgatccgcccaccttagcctcccaaagtgctgagattacaggcatgagccaccacgcctggcctagatctactttcaaatcatactacagttgagacttttcagcacttttactgcccctaccttggtcagccacctcatgtctgggctggtcctttgacaggcctcataactgtgcttccctttctgcctttgctccctaaagactattctgcacaacatagagctctccttttaatatccttcagatcatgtcatttctctgctccaaccatctaatgacttctccttcaacataaagtaaaggccctagagccttgattcccaaagtgtggtccacaggccaaagtgatctgtgtcactcaagagctttctcttagaaatgcagcatttgaggatccaccccagacctacagaattagcatcttcattttgacagacccaagtggtttctatgcacatcagagtgtgagtcaatctgcccctgactactcttccccttcctacttgagctttccagccaccctgactgcacagctactcctctaaggaagtgattttcgatgtgttgtccccaagccagcagcatcggcatcaccaggaaacttgttaggaatgaacattctcaggcctcaccccagacttaatggaccagaaatccaacggtgggggctcatcaacgggtgttgaccaagccttccaagggactctgatgctcaagtttaggaccactgccctaagacatcaaggctttcctgtcacaggacctttctatctggtgttgcctctacctcccctactcttccttcattccctcactctatcatatttctgctaaaatgccacctcctgtgggaggccctgcctgaccactctttaataaaatagcaaacctatctcacctcagcactctttcccactttacctttcatttgtttcttttttattgtacttttcaccatttgtcacactttacagttatttgtttatttgtatgtctccttcttcccccaatcaagagagtcatctccttaaggacttgttttattctctactgtatcccagcatctagaaaaatgcttaagacacattaggcatttaataagtgtatactacatgaacaaattgggtaatgaatagattgaggcttgctctcactggatgtacacttctttgggaggttctccctgccccccatgactccatccattctgactgaccactggggccaaagtctgagtgggcttgttcacttcactctgaaagagctccctcaatcccattataatccaggccaggtgtcaggaaatacagatttttgctcaggacaaacctcaatgtaagaatagatggaccagaacaaagtccctctgtttaaaagatgattcaaatctgggtcctactgacagtgggacagtgatgtcattactgtttgtggttaatcgtactgctaccataagaataggtcagggttaaagaggttaagcaatctaggaaatgtgtgcatgaggaagggaatgatacagggatagccctagttagtcactggcaagtgaaatcatgatgcctgctaatacctaacacctccttggtgtcctatgcataaacggagctggttcctgaatgagccacaggctttgccaaatgaggtctctgttggctcgtgagactgtggtaattaatctctgccttggcttcccagcctgtaaatcagggctgtcctcagaatgaagtacaatccagtgattctgtctgaagttgttgcattttacagaaaatgtttcatgtcacatgagagttatgataagtgatgctcttttaatgcttgagaaattttcctacaaagatcttcccttttaagagtcttgcttactgaaacaggatgaggcaaggattaagcaataacagcaataggagagtatattctgctaagcacctgagaacagatgtttggagatacggtttagaatggatctatccatattcccctggtcttcctcatgatgtgggcagcaccttgagcttggttttggagggtatcatcgttttttcatgggaaagagcaaaacacactcatttactttgggacaagaggcagaatggtacactggtagaaagagccctggatggaaaggcaggagttttgatgctcacttggccacttgattacatagtacatcacttcatgtctctggactctatttctttctccatttctctcaatagtctttctttctttttctttctttctttctttctctttctttctttctttctttctttctttctttctttctttctttctctctctctttctttctttcttactttctacctttccttccttccttccttccttccttccttccttccttccttccttccttccttccttctttccttccttccttccttccttccttccttttttcttcctctttctttttttgtgagacagagtctggctctgtcacccaggctggagtgcagtggcatgatcttggctcactgtaacctctgcgtcctgggttcaagcaattctcctgcctcagcctcccgagtacctgggactacaggtgcacgccaccatgcccagctaatttttgtacttttagtagagacagggttttaccatgttggccaggctggtcttgaactcctgaccccaggtgattcatccaccttggcctcccaaagtgctgggattacaggcatgagccacaacgcccagccattttctaaatagttttcatcctccttatcagtgctgcatcgaatcccttttttataatcagtgatcagtaaaatcccttctaacttatgtcttacttctaagattcttagacaagatttcttgtcccaaaattgaaaacagaggctatgacaatatgtgatactcatcggccattcacatttgcttaactggaatttttgcattgtttcaaaaagttttgccacataaagattaatattcaaagatttataatggcaaatactaattttattacgaaagatgccttttaataatgttcactcaaatattctttttttaaaaaaaattccacttccagctgcaggcttggacctctttcaaggggacatcctcttgcaggtgagtacctgtcaatgatgcaataagtttctcaggacaggcagtaccactgggtgtgagtctctgctctgcggccagccctgggatgggcactgtgaaggagatgagagaaatctcatctataatctgttccagtgaggagttccactgtagttcctaaggacaaaaacagagggaaaataagtaaacagcacaaaagggtctaaaatgattaaatggcttatctatccagttttcttgggattgcaggccccctttattttgttcttaataatttctctgatttttccaaattatctctcaaggacttctattgctttcataatcaaaagacaaattgccactaaactgtttgagttgtgtgatagactgtttgctctgtgagagtttagtgaaggaggaggtcaaggtgaccttgaggactaggcttcccactcacctttacctttgttttcacagaaatccagaaatggcctgagagacccaaacaccaggtggacgttccccattccttacatcttggctgataatttgggtaatattaattgttcttaattaggaagtttcagtttaactctctctctcctctcagcctgtccatgggcttcacattgggagtaaccaccacgatctaagagagttttcaagtcctgatgcatctttatctaatggggagaaagacataacattacatcaaaagcattgctgcttaaccagtctgagatacacagaatccaagaataacttttaaaatgcaacacacattaaagtattagtataaccaggagaacataaaagagcaaaacctaatgaaatataatttgcatcagaacaaggaaaagtttgcactttgtttaggtgaatctaaatgtagtgtgaggatactattttcagcatattgatttcttctctttttcttacaagagaaacatgccacactttgagaaataggaaagtccatatttcacatgttcacaatccttttttcttggtgttattaatgtctactcttttctctctcttaagaaaaagatctgaatatgttacattttactcattgttagaaataatgactagtagaatgacttccctgccttttagctaaggttgcatatagaactagcaactggtagaaataagtaaatattagaagccacatgtaggcactggctgaccctcaagcagttgactgacagctgagcagccatgatgactcaatgtctgcaaggcccctcctgcttagacagatgaacaagattagagtgaagaagggaagccaggacagggttgcttagtcttgttgggctgctaggctgctcctactctcaggagatgtagattatgtttcagtattttccatcctctttatcagtgctgcctcgaatccctgtttatggagaacagctagatataaacaaatgttattgttcacagctattagttggaaaattgagttgttttctccagtgtttgccttgcaaattcacggaacatcaatacttaatggaacatgatttaagaaacaccaactttaaaaggggttctttcccattacaatttgttttatcctggttgtcacatctgcaccaccctattatgtgccaggctctgtgccttcatctgatattttatgtaacctttaccatgcctctgtaaggtgtaaggtagtgcttctcagactttaatgtgcataggactcagatgaggatcctgttaacctacagagtaggtcagcgttggtgtgtgagatgttgcatgtccaacggtcctctagtgatgctgatgctattggtccccacgcagaccacagcttaagtagtaaggtctctctagttgcaagataggtaagaaattatatttgagagtgatttgagacaagtgaactgacataagataaaggtattaaggatacagcagtatttctcaagcaataccacgtgaaggtcacctttagtgttaaagttcagatgcccagacccagaccactgtgaaagcaaactttctaactagagttgaatatttgtatagaattgttttattcaagttaaatttacatagagtgaaatacacaaatcagtatataaggcttttgacaaacacatatacctatataatgcacacttccatcattccataaagttcctttctaggcagttcccatccccactccttaagagacaaccaccattctgattttcccctatgtattagttttgcctgatttacaactgatttacagataaatgaactcatataccatagtatttgttttataaatactatgtgtctggcttctttgacttatgttttttaagttcttccatattgttgtagatcaacagtaaattctttttttaaactactcagtaatatttctttgtaatactatactgtaaattactgtccatttttctgttggggctagtatgaagaaaactgttatgataattcttatacaagtttatgtgaatacattttttatttatctttggtaaatgcctaggaatataattgcttggtcatatggataactatgtaagaaaacgccaaacagttttccaaagtggctgtgccattgtacactcctcctgaaaatatatgagtgtttcatttgctccacatcctcgctaatattgatagcattaatctttgtagttatagccattttagtagttgtaaaatggtatctccctacgattttaatttgcatttccctaatgattagtgatatttagcacattttagtatgctactggctatttttgtatcttcttttacgagggtctgtccaactccttcatgagttttaaaaattatattgtttgtctttttattatttgtaggattttatatattatggctaaagccctttttcagatatatgtattataaatattttctgttagtctgttacttacctatttgtttttgtttttcaagcagtgaattttgaaatgcaaaagctttaaatgctgataaagtgtgatttatcaattttttaacttatggtttgtgtttttatattctaagaaatatgtgcttaaaccaagtcacaaagatatattccaatattttttgaagttgtatggtttcaatttttgtctataattgattgcaaactaattttgtgtacaacaggatgaagagattgagactgattggttggtatttattagcccagttgttccagcaacatttgctataaaattttgctttcctcattaagtactcttcgcaagagtctcgtttgccaagtttgccaagactcctcatttcttgatctggtatctctgttttcctatcttattctacttgtttatcatcatgtcaaaaatcactatgttgattactctagcttcacagttaaccttgaattgagtgttccagctttgctctccaatttcaagactgtttagcctactccagaccttttgcattttcatgtatattttacaatcaatttctctaaaaagcctgctgggattttgataggaatgtgttgattctgtacataaatttgtagaaaactaatttcttaaaaatattgagtcctataatccataaacatggtacatcagtccatttatttcagtcttctttaatttatctaatccgtgttttataaatttcagtgtagagaccttgtgtgtctttggtaaattcatttctaagcattttatatttttgatgctattaaaatgaaatttaaaaaattttactacataatgttttctgctaatatataaaaatacaatggatttttatatattgattttgtattctgttaccttgctaaatttactcattaattttaattgttgatttgtagatttttttaggacttttagtaaaaattcttcttgccttttaatatagacagtgttactggttcctttccaatttttacaccatatattgctttttcttgtcttattgttctggctaggaccttcattaccatgttgaatagaagtggtaagagtggacatctttgcctcattggcttgtttagtggtagtattcaatacttcattcatgtgggacactgtaggttttccacagatgccctttgtcagatggtatgttttcatcatgaatagttgttacagtgtatcaaatgcttttcctgcaacaattaagtataatttttattccttattgtgtaatatggtaataacatcaaatttgaatgctaaatcaactttgcatttctcagatgagccctacttggttatgatgtattatccttttcatattttgctggattcctaatattttgttatacatttttgtgtttatattcataaatagtataagtttctaatttacctttttgtaatatctttattaggctttagtaataaagttatgtagctctcaaaaccatcttgaaaatttttcctcttcttttatcttttgaataagtttgtgtatgatcaaaattttttctttcttaaatgttggtaaaaatcaccaataaaataaataataaatttgtttgttggtaaaattcaccgataaaataaaataaccaagtaatggaattttctttgtgggatagtatttttataatgaattcgattcatttaataattatagaattattcttattttctattatgctgcttttattaaattgtatttttcagtaataaaaaattaagattatcttaatagatgcagaaaaagcatttgacaaaattcaacaactatttcaactaagttgtcaaaatagtggcataatatctcattatctttataatgtctgtagaatctttagtgatagtcctatttcacttttgatattggcaatttgtgttttccctctttttttcttgacatgtcctgccaggggcttattgattttattaatatttttacagaattgacttttgatttgttaattttctcttgcttctctgctttatatttagttgctttctgttacctttattatttcctttctcctacttatttcaggtttagtttactcttcttttttgacattcttaagatgaaaattcatatcacttattttaaaccttcattttttctaatgtaatatattctacaacatggctactaaagctataattttatctgaagcactgctttactgccttcttcaaattttgatatggtgtatgcttattaaaatttagtttattaatagatacttcataatttatcttgtgaatattttcatccatggatgggataaaagtatgtttacatttttaaaaatattgtccttagcgttaatattatgcaagcattttacaatagtataattccatttatacccctgccctttgtactttattggtttatattttccatctacatgcttcataagtctcgcactatagtgttagaattttttatttaaacagttatcttttaaagtaattgatgaaaaacaagagtcttcgtatttacttttacacttgaaatttctggtgctcctcattcctcctgtaaatctgagttcttctctagtatcatttctcttcagtctgaagaacttcctttagcacttcttataaagcagatttgttgatgacaaattctggtttttcttttacctgaaaatgatctttattttgcctaaattttgaggatattttaactggaaatagaatttcggtttatagtagtgttaaaaattattattttaacatttttaagttgtaatacattgtctttttgttttccaacatttgattataaaaacttttaaataatcaaaaagttaaaagcattatgcagcgaacattcacatactcataacctaaattacaattaacagttttatttgctttatttcgtctatccatcccaatatccctctatgaatctatcaatccattgtatttttgatgcatttcaaagtcgctttcgggcactagtacactttaccccagtcacctaagtatgcatgtaattaactacaggtcaatatttgtatatagttcccttttacataaaatatatatagggtaaaatgcatgagtctcagatgtacaattcaatgagttcttaaagatctatgcacctatgtaatccaaattcctatcaagagatggaacatgtttataatgtatgtacctctgaaacctaacttcctatgaagagatggaacactgttatccttccagagagttctgttatggcccttccaagttattctcacttttccagaaaaagaaggtgctattctattttttcttttttcttcataggtgaatttaacctcttctagaatttcatataaatggaatcatatgttatatactcttttgagtaaggctttgttttactcagtaaaatgttcttgggatgcatcaatgttgctgcgtttataagcaatttgttctttttttgttactgtcatttcattgaatttagtatatcacagcttgtttaatcattctcttcgattgatgctatgttttggctgttatgaataaagctactatgagtagccttgcacatattcttttatgaaatatattctcatatctctggtgtaaataagaataaaattgctgggttatagtataggtgtaggtttagtgttagacctctttcaatgtgctggtaccattttatacaaccacaaacaatgtacgtgagtttcgtttactccatgcctttgctaacatttggtgttgtcaatttttaaagttttagccattctgttgggcatctagtgctattttattaatttattgatttatatttccattatgactagtaatgttgacctcctttaaagttactcattggtcatttgtatatcttcccttataaaatatctgctctgttaacccattttaaaaattgagttgttatttagtattgagttctaagtgttctttatatattttggatatgtcttttatcagatatatattttgcaaatattttgctccagatacactgtttcttgtctccagtgtctgataataaatcatccatctttcaaactttcatattattgttctcctgtatgtaatgtcttttttctctagttgttttcaatacgttctttttatttttgtttttataacagcttgattatggtatgcttatgctgattttctttttatctatcctgtttgggctcaccaagtttcttctgtctttaaggtgatttttaaataaccaaatctgaaaaacgttaggccattatttgctcaaatatttttctgtgtttctcctgtccatcagagactctaactgcacatatcttagactgggtgatttttttcccattggtcactaaagcgctattcatttttctgaacatttttctctctgtctcttttaccatcgccagtcagcttttaaaattatccagtgaattttttatttttgatataatactgatagaattttcattgggttcttttatataattcccatttgtctgctgagattatttgtatgttcatctttattccattaaattatgtaacaagtatacaatagagatttaaagtgtttgtctgttaagtctaacattttagtcaccttggggtctgtttctctttctagttattgcttttactaatatctatcaataacaatttcctgttccttcacaggtctcataatttttgattatatattagacattgtgttacattgtagtgattatgcgtgttttcattctcctctgaattgtgttaatttttgttagagcagttaaattactgcatgatcatctggaatttgtggaggattttgtggtcttgcccttagttcaaggcaaatctcttagttctggaatatagtctttactgttaagtcatggtccttctgggatttcaatggaatgcccgagtttccccaacccctgtaaatttgcatgactcaaactccaaattcttcctccactgcagtgggcagcaactgatgtatctgttcaggttgctcagccttccaatggctactacctactgaggggcttggagccttctcccatttatgcaaagttcatgagtcagacaaggattgaaggggcacttatatacagactttgggatgaatctcctcttcatctaccatgactttcctttctaggactttctcccttgattttcagccactcgggttaaaactcagccccaaacttgtccttgtggtatgttaagaaaatgcaactgtagatttatacttgagttctctttcttgcattgaagaaattagagcgtgccctcatgcaaaaagctgtataaatgtgaatcttacccaatgaaattttccttcttttaagaaaaagtcctccagtttctgcctgttttagccattttccagcatatttaaagagtttattttcttattttttcaagtttacaactgttatctgtgggaggattaattagattcaagctccttgacaattttgagcaccagaaattctctcaaaggaattcctaaactgaatctaggtagccttcttatgcttatcttctaatacgtacagccattggtatctaaaattaactcttctcaaaagaaaaaaaaagaacaaataaagttaactcttcttatattatttgatccaaggttaaaggaatgctagtggttttcaaaactaacttgtttgacacagaactatgtacaacttactatgtcagggcagttggctaggaacaagagttacaatgagacaaaaagtatatccctttctctcaaggagctaacagtatcttaagtgtagcaaaccacctacataaagacaactcaagccttggccacctataatctcagcactttgggaagccgaggcaggaagatcacttgagcctaggagttcaagtcgagcctgagcaacaaagtgagacccccatctgaaataaagaaagaaagaaagaaagaaagaaagaaagaaagaaagaaagaaagaaagaaagaaaggaaggaaggaaggaaggaaggaaggaaggaaggaaggaaggaaggaaggaaagaaggaaggaaagggagaaaggagaggaggaggaagagaagaaggaggaggaggagaaggaggaggaggaggagaaggaaaaaacaagaagaagaagaggaaaacagaagaaggagggaaggaaaggaaggaaggaagggagaaaggaaagaaagaaagaaagaaagaaagaaagaaagaaagaaagaaagaaagaaagaaagaaagaaagaaaggaagaaaggaaataaatcagtcaaatgtggctcctgcattcagaggaggagcactcagggttgccttcatggagaagagaaagacttcaaatgggctctgtttccatttatcccaataatgttgaggtagtttttacaaaattattacagagttgcttagttccctctttacagcttatttaggtatggagaaggaagaaaaggtataattttaaaattaatcactctcagaaatcccaccatttggattgagaataacaaaagcgaaatagccttctaggaagcttgctttcagtataatcactttttttttctcacatttttgtgacaccacagctaccttgggtacatctcttcatattacagatgtaactaagtaagaataggtaaaagtacatgaaaatctcccagcagatgtaatgaatgctcttgttattgttatctgtgtagtttccacaattagtttattgactattcccatgactatttctttaatgatcttgatatgacattatatgacatttaggctgtggagtctccaacttgatagtttattaaatgaaataaaggccagaaaatgtgatgtaatttcctggccaatagatataaactctttgagagaaagcactaaatcaaatgtgcaagaaatgtaattttattttatataacttggcttaatttttaacttagattctaaccttcaatgagttgatgggagggtaaaatgcacacaaagtaaaacataatctcagtttctctggagtatctttcttttctaccccatctttgtcttacaatgccaaagtgcatgcatgctaggtgaaaggaaaggcatttgatctttggtcattggtccccacaggttactagtcagtatctatttttcctgccccttcaagtccattaggcttctgctgcttgggtgctgagctcgggatacagaaatctcttctaaggctctgtgcagtactagctgtctagtcttgccatctcccaggcatctggctgggaagcagggtaaaataccgtatgtgcttcttatgctttcagaacccacaaacctctctaagttctgctttcctcctccagaaagagagaatgtctttttagattggggtaaggaacactattctcactgcctcactctaaggtactttatctatgtcaactaaagccagagctactcacaagccacttctgttttctgttctgccatgtgactctcctgaggcaatgcactctaaatctctgcttcagtgggggaaaggcaaagggagaaagtgtggaagttattttattattttatttagccatatacacatgtgtatattcttattttgtagacatatttgcattgtgcatttaaggtatgcacttaatgtttatgcccacaactaattttgcagatgtccacaaccaattttgcagttttagttaccaggaaatctatttattaccaaaaaccctatcatgcacctctgtggatttaatgtggcagcatggttttctctaaactataagttatagatattatctaaggtccaaataatgctcattgatatttttactgatttctgcagggctgaatgctaaaggagccattctgtatgcctttgagatgttccgtctcaagtcctgtgtggatttcaagccctatgaaggagagagctcatatatcatatttcaacagtttgatgggttggtatgaaattttacggagtgaaaatcatgcatactttggttcgtaagaagtattctttccccgagtccccaaagtccaatgtatcattcttttgtctttgcgtcctcataacttagctcccacatatgagtgagaacatacaatgtttgttttttccattcctgagttacttcacttagaataatggtctccaactccatccaggttgctgtgaatgccattattttgttcctttttatggctgagtagtaatacatggtgtgtgtgtgtgtatatatatatatattttacatatatttttttttctttatcaccttgttgattgatgggcatttgggctggttccatattttttcagttgcaaattgtgctgctataaacatccatgtgcaagtatctttttcgtataatgacttcttttcctgtgggtagatacctagtagtgggattgctggatcaaatggtagttctacttttagttctttaaggaacctccacactgttttccatagtcactgtactagtttacattcccacccacagtgtaaaagtgttcccttttcactgcatccacaccaatatatataatttttaaaaattttttaattatggccatttctgcaagagtaaggtcgtatcacattatagttttgatttgtgtttccctgataattagtaatgttgaacatgttttcatatgcctgttggccatttctgtatcttcttttgagaattgtctattcacattcttagcccaatttttgatgggattgtttgtttttttcttgctaatttgtttgggttatttgtagattccagatattcgtcctttgttggatgtatacattgtgaaaattttctcccactctgtgggttgtctgttaactctgctgattatttcttttgccatgcagaagcttttgagtttaattaagtcccactgatttatctttgtttttgttgcatttgcttttagcttcttgtcatgaagtctttgcctacgccaatgtctagaagggtttttctgattttaccttctagaatctttatgggttcaggtcttagatttaagtctttgatccatcttgagttgatttctgtatagggtgagagaagaggctctagtttcattcttctacatgtggcttgccaattatcccagcaccgtttattgaataggatgtcatttccccactttatgtttttgtttgttttgttgaagatcagttggctgtaagtatttgagtttatttctgggttctctattctgttccattggtctatgtatctatttttataccagtactttcctgtttttggtgactatggccttacagtatagtttgaagttgggtaacgtgatgactccagatttgttctttttacttagtcttgtgttggctatgtgggttcttttttggttccatgtgaattttaggatggtttttccaggtctgtgaagaatgatggtggtattttgatgggaattgtatagaatttgtagattgcttttggcaattgtgttcactttcacagtatggattctactcatccatgagcaagggatagctttccatttgtttgtgtcatctatgatttctttcagcagtgttttgtagttttccttgcagtggtctttcagtctttggttaggtatattcctaagtattttattttatattttgcagctattgtgaaatgggttgagttcttgatttgattcttagcttggacactgttggtgtttagcagagctactgatttgtgtaaattaattttgtatcctgaaattttgttgattttatttaccagttctaggagctttttggatgagtctttagggtttttttaggtatacaatcatatcatcagcaaacagtgataatttgacttcctgtttactgatttggatgccctttatttctctctcttgtctgattgctttggctaggacttccagtagtatgttgaatagaagtagtaacagagggcatctttgtcttgtaccagttctcaggggaaatgctttcaactttttatcattcactataaagttgactgtggatttgttgtagatggcttttattaccttaaggtatgtcctttctgtgccaattttgctgaggtttttaatcatacagggatggtggactttgccaaatgctttttctccatctattaagatgattatgtgaattttgtttttaattctctttatgtggtgtatcacatttattgattttgtatgtgaaaccatccctgcatccctggtatgaaacccacttgatcatgttgaattatctttttgatatgctgttggattcagttcatcagtacattattgaggatttttgcctgtgtgttcatcagggatattggtctgtagttttctttgtttgttatgtccttccctggtttgggtattaaggagatactggcttcatagaatgatttagggaggattccctctttctctatcttttggaatagtgtcactaggattggtaccaattcttctttgaatgtcttgtataattcatctctgaatccatctggtcctggacttttttttgttggcaatttttgaattgccatttcaatctcactacttgttatttgtctgttaagagattctatatattcctggtttaatctaggagggttgtatatttccaggaatttatccatctcttctaggttttctaatttatgcacataaaggtgttcaaagtagccttgaataatctttcatatttctgtggtatcagttgtaatagctcccattttgtttctaattgagcttattgggatcttctgtcttcttttcttggttaatctcactaataatctatcaattttatttattttttcaaagaaccagatttttgtttcatttgtcttttgtatttttttattccgtttcatttagttgtgctctgatatttgttgtttcttttcttatgctgggtttggatttggattgttcttgtttctccaattctgtgtggtgtaaccttagattgtctatttgtgctctttcagactttttggtgtcatttaattctatgaactttcctcttagcactgcttttgctatatcccagaggttttgataggttgtgtcactattatcattcagtccaaaatttttttttaatttccatcttgatttcattgttgacccagtgatcattcaggggcaggttatttaatttccatgcatttgcatggttttgagggttctttttggagtgatttccaattctgtttgactgtggtctgagagtgtacttgatataattttgattttcttatatttactgagacttgttttgtggtctatcatatggcctaacttggagaatgttccatgtgctggtaactataatgtatattctgcaattgttgggtagaatgttctgtaaatatctgttaagtccatttgttttagggtatagttaaagtccattgtttctttgttgactttctgtcttgatgacctgtctagtgccgtcagtgagtattaaagtcccccactgttattgtgttgccatccacctcatttcttaggtctagtagtaacagttttataaattgagggtctccagaattaggtaaatatatttttagaatatctttccactcctttaccttaagtttatgtgagtccttatgtgttatgtgaggcctcaaaaccatgcaaatacgtggaaattaaataacctgctgctgagtaatcattgggtcaaccatgaaatcaagacggaaatataaaaattatttgaactgaatgataatagtgacacaacctatcaaaacctctgggatacagcaaaaagcaaaagtggtgctaagaggaaagttccacagcattaaatgcctacatcaaaagtctgaaagagtacaaatagacaattctgaagacagcagaaacttggttggtgaattcttattcattctgctattctgtatctttttaagtggagaatttagggcatttacattcactgttattattggggtgtgaggtactattctatacattgtgcaatttgttgcttgaatatcttggttttttttcactgtgttattgttatataggttctgtaagatttatgctttaaggagttctattttggtatattttgaggatttgtttcaagatttagagctccttttagcagttcttgtagtactggcttggtagtggcaaattctctcagcatttatttgtttgaaaaagactgtatctttccttcgtttattaagcttagtttcaccagatactaaattcttgactaataattgttttgtttaaggaggttaaaaataggaccccaatgccttctagcttgtagggtttctgctgagaaatctgctgttaatctgataggttttcctttatgagttacctgatgcttttgcttcacagctcttaagattctttcctttgtcttgatttgagataacctgatgactgtgtgcctaggcgatgatctttttgagatgcatttcccaggtgttctttgagattcttatatttggatgtctagatctctagcaaggctggggaagttttcctcaattattccctcaaatacgttttccaaatatttggatttctccttcttctggtacaccaattattcttaggtttggatgtttaacatagtccaaacttcttcgaagctttgttcatttaaaaaatttttttgtttgtttttgatggatggggttaattcaaaagccttgcctttgagcactaagattctttcttctgcttgttcgattctattgctgagactttccagtgcattttgcatttctctaagtatgtccttgatttccagaagttgtgattgttttttatttatgctatctatttcactgaagatttttcctttcatattctcatcatgtttttgatttctttaagttggactttacctttctctggtgcctccttgattggcttaataattgaccttcaaaattctttttctggcaattcagagattttgtcttcatttggctccattgcggtgcactgacatgatcttttggcagtgttaaagaatcttgttttgacatatcaccagaattgtttttctggtcccttctcatttgggtagactgtgtcagagggaagatctggaattcaagggctgtttttcagatttttttgtcccacagggtgctcccttgatgtggtgttctcccccttcccctaggaatggggcttcttgagagctgaactgtagtgattgtttttgctcttctggatctagccacccagcagagctactgggctctgggctggtactgaggagtacaaagagtctggtgatgtgatttgtcttcaggtcttgcagctatggacaccagcacctgctccagtggaggtagcatgggaatgaagtggactctgtgaaggtccttggttgtgtttttgtttagtgtgctggttttgtgttggcaatcctccagccaggaggtggcactttcaagagtgcatcagctacggtcctatagggaggatgcaaacctgccctagggacacctggttaagtattcaggtttctcagctggtgggcaaggccatagagctctcaagagattctgacctttgtctttggctaccagggcaggtagagaaagatcaccaggttggagcagggataggcatgtctgagctcagcctctccttgggcagggcttgctgtggctgttgtggggaatgggggtgtggtttccagtccagtggagttatactccaggagggattatggctgcctctgctgagtcatacaggttgccaaggaagtggggaaaagcctgcagccacaggcctcaccctgctcccatgcagcccgcagtcctaaaggctgggcttattcccaccttgccccttcaacagcactgagtccatttccagtcgtctggtgaccaaggttgagaacttgtcccggaccacgagcctccttgttgagaaagcaagcagactcacaggttttcagcatctcaggcaacctgcagttgtgatccagttccttcaaagggtctatggattgtcttggctttcctggtatgttcctgcagtagttctcggagcaaaaattcatgatgtgagtctccctacactgctctgtccaggcagctgcaagctaatcctgcctctcatcccccatcttaatcctgagtcctgaccgtggggttttgataatgatggatggatagtatgatgaaaatggtagttagcacatgatttagcctcttaggaaaaaaaatgcaaaaaatagcagttaaataaaagaaaaatactgacaactacttagatacaaattaaatacctaacttacctgagtagttacttttggagcttattcatttatttatttatttattatttttttgagacagagtctctctctgtcagccaggctggagtacagtggcatgatctcggctcactggaacctccatctcccgggctcaagcaattctcctgcctcagcctcttgagtagctgggatcacaggcgtgtgccaccatgcttggctaatttttgtatttttagtagagatgggggtttcaccatgttggccaggctggtcttgaactcctgacctcaggtaatcggcccacctcaacctccgaaagtgctgggattacaggcgtgagccaccattacaggcatgagccaccgcgcccggcctcattcttctatttttaaaaaaattgcacacctactacattccaggaagtgtgctagactgtaggtgcaacaaaatatgcaatacggtcttagccctcagcaggcttacagttaccaggtgggggtggtggagaaatgagtatattgtcttaatacatgacaatgagtgtcctgggttgcagcagggcaagagtggggccactgagaaagtgtgggatgaagcatcagggagagttgagatgagtgttagagagaagaagggaggacaaatcagaggcaggaagagggagagagggaaagggtgaggaggagaaggaggaagaagaaggggaggaggggatcaaagggaagaagagggagagggagagggtgaggagagagcaaacatgaacctgaacctggttacttggagaaccccctaagttcagtgcctggagcttttcatgtcaggagcttttcatggactcagtgctgttgaaggggcacagtgggaataagcccagcctttaggactgcgggctgcatgggaacaggttgaggcctgtgactgtaggcttttccccacttccttggcaacctgtatgactcagcaggggcagccataatcccataatgagcaagagccaggaaggtgagcaggagcctggtgatggagagccatgtgtgagggaacctattgtttggtgcaaggttcattctatgctcagttttccactgtagaaagatgacttgatcaacagtggataaagaattgaaatagagcaagactggtggcaagagatcaattaacagatgctccagttttctaggggaaaaatggaaggtacctacaccaaggaagaggcaggtgatataaagaagagggaatggatttcagaaatctgtgaaaaagtgtatttatcagaacctaaccttatcaaattggttagtgggaggaggggttaggaaaggagaggagtcaaaagtatctgagatttcatatttggatgactggcaagtggtaacttcatttgctgaggctgggaatattgctgaaagaataactttggggatgaggtaggagagtaaactcatcttactgcatgtgttttattgcttgaggtttttgcaggtcatataaatggagataaccaatagtagttagatagtttatttttctgtaaaggggaaacatttaaagtatatctcaggccttgcaaagaccacacattttagggcctctctgcttttgactactgcattttgtcccttggcaatctctgaccttcaaggaagtgctaaaacccttaatttttcattgaaaacgtcagagaaacaattaactttattaacaaatttatttccattcttcagctaccacttttgcatcattcttttttcacaaagaaactccttaaaaataaaacaaaatccacataattactttccaaaattctcactttcacagtgaagttctcccaacttctttttttgttttcaagtgagtcccaactacttgattaaggggtaggtcagctttgagagacattctttgtaaaagcactgaatctgggaaacctaatcacctatggccaggagatgtctctgttacagataatttaagagagggaaaaagagaggaagatattttgggaagggactggcccaaagtgcccctaagcccttcagggcactggtctcctgaagttggaggctaactgggactctttcagaaagacaaggtcaaaagttctcagtgaggtggaatgtatggtatttttgcaacttatgtctttctgttgggggaggaatttaaaaagaaagatgaataataaatgctttctctgagttgtgaatattttgcagagtaaactctgatttggtaataaaatgccactatcagagaggcaagttgatcatggttacatttgcataacactgtaaatttactaaaagtcattgaattgtatacttaaaattaaagaattttatagtatataaattataccttaataaagttattagaaaataaataactaagattcatctttgagtaaaaatcaaatctgttagcctttgaaggtatactgtgtcagtagtcttggggagaacattggcaggtaagacactgtgactgtcaccatgaaacttgcaatccattggttgcatttatgactatcaggaaatctttcttttctgctcagcattgggtaaaatatagatcttcatttgacaatttaaagccaataggagacaatttgtggaaagctttgggtttgctaatagaggtgaaaaattgggtttatgagaagagaaaaaataattggggggagaatgaaagaggaagacattctaccgtaaggaattcagggaatctgacagaggttcccgagcccactgatttcagagggacgctacaggtcctccttgcctgatacccttcagaaataagttaggcagccttctctgtgctgtcataacactgtagatctgctatttccgaagacatggattttattaatttgctttttaatgaggatctttttatgatcataaaatatatgcttgttcattataggaactttgaaaatttattaaagtataaaagggctaggtgcgatggctcacacctgtaatcctagcattttgggaggtcaaggagggcaaatcgtttgagcccaggagtttgagaccaggctgggcaacatggcaaaaccctgtctctacaaaaaaataaaaacattatctgcctgtggttccaagtcccagcctctcaggaggctgaggtgggaagatcacctgagtagaggaggctgaggctgctgtgagctgtgattgtggcactgcacagcaacctgagtgataaagtgagacccccaatctcaaaaaaattaaatcaaccacagctttccctcagacaacaattttttagataaaggcaacagtgttattctttggagtgccctgtgggtttgtggaggtgagaaggaatgccaatgtttattgctttctaccttgacgaattgttataataggattgatttgcttctgagtatgtgccacttttataatgtattatatcttcacttttaaagcctgcacagtattccctctagggaatgctccttctttaagcagtccccatctttggaccattagcatatgagaatgctgttggtaatttctttctaaaatcaagcctaatttcctcctaatttgtgttttggagtactgtgaatgacagccacttaaaaattctctagaagaaatttttcctcttctcctctttaaaggtgctggtctgaggttggtgaccaacatgtgggacagaacatttccattggccaaggatgtgcctataaggccatcatagaacacgagatcctgcatgctttgggattttaccacgagcagtcaaggacggaccgggatgattatgtgaacatctggtgggaccaaattctttcaggtgtgattgggcggagattgctatcacatttatcactggctgagaccaatcctgagatgaccaagccaaatctgtgtggacaggagcttcagcctctctagtgggaagaaagactctgaagaggttatgatttgttggccctttatgtgggctgtgctggtctgaccggaattcatcgcagataagggcctcaaggaatggtgttaactcactgtgggggtcaactgaaagttaaccagaagctttgctttatatcagtgttttcattaaaactctatctaaaactctactttcctgtcttactgaggaaagtgaatccagattttaaagtcatttctctggatgtgaaatctcctgtgcctctagaaggctgtttgaggtttagttgattattccatgactatagggcatactcaagaagtattttttccagttgctttaccaaatcaataaaaaatgtttaaaaacaaaaacaaaaataaatgcttttatctgaaataacaccccaattatgttaattctagctagttatctgggttctgattaatcaaaggtgaatgtttttttcttccttgtttctaagcaccttgcttcttctgcctccacctcatacaatgcaaaagacaacagttttgtcttacgtattattccgttgtattattttaactatttcattgttctttaggttgttttgttttgttttgagacagagttttgctcttgtggcccaggctggagtgcaatggtgcgatctcagctcactgcaacctctgcctcctgagttcaagcgattctcctgcctcagggaggcagatgggattataggtgtgtgtcaccatgcctggctaattctgtattttttaagtagagatgggatttcatcatgttggttaggctggtcttgaactcctgacctcaggtgatcggcctgccttggcctcccaaagtgctgggattacaggcatgagccaccaccgtgtccggcccttactttccttaattgtttgagacaatgaagtagagtgcttttgagtacactaaaacatttattgagcagcttcctgatgtggtagaaaaaaaaaaagtcaatgctgtgtttctgaagatacctagtttttaagaaggaattagtgaagagaatgcaaaaacattgtttttggcagtaagagattaatgaaactttaatatatttaaaatgccttaactgtttccggcatggcttttataaaacaaataatagccttgtgtaggtatctgttttatttagatcccaattttatatgcggattcatatattgcagtgcatctataataattttacttttgggggcttggaagaactgaccaagctttataattaaatatgaatcctcaaaagttttctgccaggactgtagtagttcattttggagtaagatggtcaatgattttcacatgagatgagggtagagagggctaatcaaaatcacctgtgaggtttctcatcctgtgccttctcagtctcttatattctggtaattctatgaatgtggattggtgtagtaaggaagaaaactgtaacttataatagtctaataggtcaccagctttgagcctaaccacatactccgaccatcttaccaccacccactgaaccagaggccagatagcactcttctttgcctcccagtccaatccagaaaagttttggagcatattcacccagagatgaaataataactcagacttcatgtacctatctctcagtagtaattgtgttataactgtgtgtgtgtgtagaaggaagaaggaaatggagtaataggtcaaaggactgaatctctgattgcactactcaggggactattagactttgtctatatttgcctgtaagcctcaatttcttaccttcctgtacatatactgggctttgatgaaaatgttgtaaggaagcagaaaacatttctatttccaagtcttatagaatacaatacttaatgcttttaaaatggttttaggccaaatgaggttccctttatcggagtgagggacatttgccagggtcaagtgcagacttgctcagctctggtttgagcacgggttgctcaacacatatttgctcatctcctatctgtgttttcatcaggtacaattccgtatatctaaattgcctgcaaccacgggagaactgttctcaaaagagacatcaaatccaataagattatcaacataggcagtattttttatcagggtaatttgtgagttttattgatttaactttggtcaataacaagctttctgtttaacttaagaagacactgtactggcaatgtaattctctcccaatgtccatctccatttcttgaatcagaattgtgtttttgaaatttctttccttatgctagggaaaaaactcaacttttgaggtctagcaggggttgacaaactatagtccatgggccatatctacttgcttttgtaaataaagctttatggaaacacaatcataaccatttgtttaagtattgtatatggctgttttcgtgctacaatggcagagttgagtagttacaacagagaacatattttctatctactctagaacaggtttgctgactgatccctggtttacaggatcgcatgccctggattacagccccttttcaagtctcagctgtgagtccctatcctattcactgttgggggcactaccaacctagcacagctcttagtagacactaggcccaacaaaaacatgttgaatacattttcaaatattattcaaaatatatgtttgttaagtattctcataagaatccatgagtaacacagattaaaataatctattctaacctgatgggatttttgtttttgttttgagacagagccttgctctgtcttccaggctggagtgcaacggtgcaatctcagctcactacaacctccacctcctgggttcaagcgattctcatgcctcagcctcctgaatagctgggatgactggcgtccaccaccatgcccagctaatttttgtattttttagtagagatggggtttcaccatgtggaccaggctggtctcgaactcctggcctcaagtgattcacctgcctcagcctcccaaagtgctgggattacaggtgtgaaccaccgtgcccagcctctaatcagatggttttatggaaaattaagtaaagcacatccagtgagttgaaagtgctttgcttcaggtgccactgagagttaccaagagattgtagactcttatgctctttaaaattccattacctcaaatgacatcctaggaccaagtactctggagggattaactttccccttccctgttagagccattgtttcttttagacttgtcccaccttcaaaaatgctttgatccctctcaagtaatccccaatataatccccatgatttgggagaatgaaacatcagtattcagattttacagttaaagcaagatattgctcaaacatggtcttgctccttagcttttccaaaagcattcagagactccctcaggcacctgctggagcatcgcctggccacaccacacttctgcagtcctgcatatagctctgtatgaggcagttacattttcttctctctaattgttcaaagtaactggatgaggccaggcacggtggctcatgcctataatcccagcactttgagaggccgatgcaggcagatcacctgaggtcaggggtttgagaccagcctggccaatgtggtgaaacctcatctctactaaaaattaaacaattagccaggcgtggtgccacgtgcctgtaatcccagctactcaggaggctgaggcaggagaattgtttgaacccaggaggcagaggttgcagtgagctgagatcttgccattgcacaccagcctgggcaacagagcaaaaactccgtctcaaaactaaacaagtaaacaaacaaaaagtgactggacaaggagctagagaaggagaatacgaggatgggaagttatgactggaagagttagctgcatttgcattcagttttcctatcactccacaagaagaaaatcaaaaaaatctgcaaacctttccattaatgcagcccaaacagtaaattcccgatggttattagtcaattcaaagacactctgatcagttattttgttcagctttttacattgcagcacatcttatctcactttcactaatctcagaaaaatatttacctttcctcttttgataggaaaataagttttcttcttcctattttatttttgttctccatgaggctatttctgaaacagaaggatgtgagccttgattggcaggatcccctgtcttgctttcagctgcttacctttccctctgcccctcagatttccttctcctaacccatgaagagtaggccaggtacagctctgggcagactcagtggatgaggtacttggctgttagaacgatgtgtcttgaacataattgattgtgaacattttcctgaattcaaaaattatttttcctgtcatttggaataccttcctcagctttgctattttaccttctctttctgaaagtcttacacacacgtacacacacacccagatacacacgtatttatatatatttataatgtatctttggtgtaaacatgtacatgtatttagtcatttctaatatttatttaaatttacaatatgtattttatagttattacaatattatatatgttattgtatattaatatattaactaatattaataatgattcatagtaattttacattatattgcttataaaatataatttatatttaaataaatctatttaaataaatctatttaaatatatataaattatcatctatttaatatataaattatatattaaatagatgtatttaaatatataaattatatatattaaatagatgtatttaaatatatataaattatatatttaaataaatgtatttaaatttatataatgtatttaaatagatgtatttaaatatatataaaattatgtatttaaatagatgtatttaaatatatataaaattatgtatttaaatagatgtatttaaatatatataaattatgtatttaaatagatgtatttaaatatatataaatgatgtatttaattagatgtatttaaatatatataaattatatatataaattatatatttaaatagatctatttaaatatatataaattatatatataaattatatatttaaatagatctatttaaatatatataaattatatatttaaatagatctatttaaatatatataaattatatatttaaatagatctatttaagtatatataaattatatatttaaatagatctatttaaatatttataaattatgtatttaaataaatctatttaaatatttataaattatgtatttaaataaatctatttaaatatttataaattatgtatttaaataaatctatttaatatatatatttaaatagaactatttcccttttttggagggtctctgggtatctagtcaaagagtagcatggggaaaataacatgactgagaaggacctgtggattctctccctaacaggttaccagcacaactttgacacctatgatgatagcttaatcacagacctcaatacaccctatgattatgagtctttgatgcactaccagcctttctcatttaacaagaatgcaagtgttcccaccatcacagccaagatccctgagtttaactccattatcggacagcgcctggatttcagtgccattgatttagagaggctgaaccgaatgtacaattgcagtgagtatctcagtttctgagaacttggtaaactagcctcagcagagattccatcagccttagagatttcctttacattttcctttactcttctttaatgtactagctaaaagaataagaacaaactgcgtaacttttgttggtctacctctagacccatttgtttaagtattgtctatggctgtttttgcgcttcaatggcagagttgagtagttaaaaacaaaaaacaaacaaaactataacagcaaccttacaggatggttataaaaaccaattatgtagttatgttttataaagtcaaagtactggacaaacgtaaggagatgttattgtctagcttcttttgcttcttttggagggtgcattattacgtaaaggtcaaaataggtgatggacttgaaagcattttgtatcctgtaaaattctttacttacgttagttattcctagagtaatctaatcctctggggcagggtgttttctaaagatgatccccctagcctttagagataaaatgtttgattctgttcaataagtatgtacaaaagacctactaagtacaaagccaaatattataggtatcttgttcttgatctaaaggagtttatggttggtatttacatggcagagaatgattatagttttttttatcttgactctgtgaggtaggtagggctgtgtctatatattagcaagtactaagatctgatgacagtaagatttgcatttgagaaaaagtcaagataacaagcttgtgatcctgtcatatctgaacaatgaggttttagtggcttaagacattagctatttggaatgactatctttcatttttaaccagatgataaaaatataatttgcagccacaactcacactcttttggaccactgtacttttgagaaggcaaacatctgtggaatgattcagggcaccagagatgacactgactgggcccatcaggacagtgctcaggctggagaagtggatcacaccttgttgggacaatgcacaggtcagtgaaagtggaaagcaaacacattgatgtggttcaccaggttcaattaggttatgccagccaccatgttttgcctcagtcagaatgttagttatcaaacttgaaaatctgaacaaggacaaaaaacatttcttatatcttcattattaactcagtaaaaagcatccagtctctgggcacacaaaagaaagatgcatttaagcaaaactgatattagtatatgattgataagataaaacctcataaataaaggcaatgtctctagaaccacaccctcctacagaaatataatgtgagtcacatatgtaatgtagaattttctagtgtccacatgaatctggctctgtggcacaatggataacacatgggacttttaatacctcatgaaaaagtaaaagaaaaccgtgaaattaattgtaataatgtattttttaactcaatatatccaaatagtagcatttcaacatgtaatcaaaataaaagttattatgagatgcttcacatttttcaggctaagtattttaaacttgacacatattttactcctacagtacatctcagtttgcactggccacaattcaagcactcaatagccacataggtttggtagccactgtattggatagcatagcttcagatacttcctatatatggtgtagtgaaaaagacagacctggtttgaaatatagcttcaccacttactaattgtgaccacaggaagttgttgtcatgtgtgtgctttttctaaaagtcttggcttttgcaagcctctgtaaacatcaagatattgatgtctacttcacaatgacaatggaagaagataatgcatacaaagcccccacctgcagaccagcagcttcactccccatttttccatcttccctttctctccagaggttccgtttattttgtttttctattttagccttctagtattctgtgcctgccattgaaatcatcttaaccctatttggaaacaggtgaggttacagattattatagcttttcaaagactagactattgcaaagtcacttagtccgtaactgtctgagagttggtgagattcccttcccagaaggaacacagcctgtcacccagataccaggccaccacagggaatgtcagaggtgataagccactgacacttttcctccatctttggaagagggtaaaagcttctgtcacagatcagattatcaaacatatcatcccaagtgtccaaaggttgatccaagcctgaagtgctctctaaatttctgttgtagcctctaatccaacctagtctgtgggcttgctgttaggctaatgtacaattgccagctaaacacaaaggtgatctttattgtgagcggaatctgctgaaaaaatgttctagtaagagaaaaggaccacagcccagaagaaagatctggaaaagctgtatcaggttaacttgagcagctattatgcttctttcacaagaggtatttaatggaacatgtccctctgctagagagctcttgcatagttacaggtggatgcgtagacacaaagagcttgaaggatccattgggaggatccctcccattcaaaacccacggaaataaacacctagggagagctggggataattcaggcctcctgagttctgggcttgaattatttgactctcaattcatgcttcataatacacctgggcaagaattcctgagtaagaattacctagaaacctttatagccttgtgcgctgttttttttttttttctaacccaggcattcaatatataattataattcagaggtctcaggcaagttcaaatattgagaagaagatacaagggaatataatttgccctgatttaatattaaagtcgtttgatattttaagcttggtgggaagcttatttaaaccatcattgcttgctgctgatatgaaaggcacgtgcctcagtgtgaggcaggatgaagctgggagcatcacggagcaacgctggagtatccagcactatactgtacactcactttatttttatcttgtgaaatgttttgatggaagcattttgatatggagttgagtgttggaacacagtataaagaacctcttcatatgcaagaatttttcattgtgcttgactttgacaagtgtgtggtttaccaaacggtacatttgtttggctgcttgactgtttttaggggaaagagttttgagatatctgagtcaggtaaaccctatctctggcactaatgtagacacttttcaccctcttcagtgtccttccaattccttcctttacattcaggggaaatttccatttagtctctaatgtgtcctgaatagcccttcttataatatattaaagattacttttttgccactgataatacacccagttattaggctagcaacaggggaaattgaacccttatcattgtcaatgtttaaaaccaaatcctaaatctttgaattccagtgtcttatacaacaaccagaccaacccaactcttttccttggaatgaatctctaatttaaagaatgaagtcaatgagaaaaatagaattcatctcacagacacaaaattccatcaaacattgcttgaagcctgtgtttctttaagtcagaggtatatatttcacaatcttggaacaaaggcaatcaaacacaacagtggagagcaagctttagccagtgactaagtccattgagacagagaatatttactgacaaatgtccttctttttattttcctccgaagagttctagtttttgttgcctggacaatggctgtggttcactatttcactttgtttgggtggacagaaccctggggtgtgggaagccagacgtgtgatgtttggctgctctttccataggtgccggctacttcatgcagttcagcaccagctcggggtccgcggaagaggcagccctactggagtctcggattctttacccaaagaggaagcagcagtgcctgcaatttttctataaaatgacgggaagtccttcagacagactcgttgtctgggtcaggagggatgacagcacaggcaatgttcgcaagttggtgaaggtgcagacttttcaaggtacttagaggcattcacacgaggaatggattgggttaaaatccgggatcctgcttcttctcctccttccctctttcctcctactcctccttcttctctctcctcctccttttcctccacccactttcttctcttctcagagcctatcataatatatggcatgttttaattactctatgaatgttttaaccactgagaaattagaagcagtatcttgggcttaggtagggatgaaatatacttttgtaagaagccaatcagaatatacaaatccagttttcactggaaatttagagaaagcaaaggccaagactgagaaaatggatggttcaggagtggagataagaaggtaaaagacctgtgcgaattgatgctgcgggagagagagtagttaaatagttgaccagctcacgcctggaatcccagcactttgggaggccgaggcggccttgtggatcacaaggtcaggagattgagatcatcctggccagcatggtgaaaccccgtctctactaaaaatgcaaaaattagctgggcatggtggcgcgcgcgcatgtagtcccagctacttgagaggttgaggcaggagaattgctggaacccgggaggcggaggttgcagtgagccaagattgcaccactgcactccaggctggtgacagagcaagactccatctaaaaaaaaaaaaaaaaaaaaaaaaattgaccaaagtgttttgcatctgtttcagaaaaacaaatgataccattatttaatatgctgaagtaacttgaagcctacttgtgaagttggtggcaaataagtcattggtatatgttaacttcctataatcactaacatgttcctaagtgtcactttgtatatttatataagaaggtcagcatgtaaatgattatagatggagaaatttttgttgaaaagtaagaaagcctgtctcccttttcctagttatgaatgaaccaccaccataacaaaagaaagcaaatactttgtttataaccctggatcttgatttatggccagattatcctagcatccaactgcctaccttagcatttaatttatcaattgaaatgagtccagggaaaggaattattttttatatatctgctgctcttgaagaagaaaccttccttagaggtcacttgtaagaacaggtgcccaaatcgcctatatccaagccactctgtgggctgcctgggaactctacaaatcacagttttgaggggttcacttttctggttgaaatttattatagtttatatgataaaaggatgacagctagatactctttaagagttgaggatgtgttatgttaccaaggattgtaaatatttaatgagaaaatgagttagagtttcaataatattgatgggacctattatcactcactttcatctaaagctaaaagcgttacttctaagcataaaatcaatcaagcaaacatcctatgcttaatttagtttcttacactgctgtgctttgtgtttcattgaattcagagtatgcctgtgtacgttccctgggaacactgtatgaaaggtttttttaagtagtctgttctgatactggtttgtcaatgaaacttttcaaaaaggttagttgaatatcacttagtgttgtttatgtgatattcaacttaagacagtcgcaaccaatttgaatagcttttaagttttgcaaaatgtatattttgaccaaaacacttacacacaaaatgtctccatatgcatatctgtatataatatatgttacatacataatgcttatatacaaacttacatgaaaaatgttggcatacaactatgtgtatgtacacacacatgcacacacacacgtttttactgaggccaggacttccttatagaagacaattctgaactaacagggattaaatttgtctcaaacaatcgtagtagcattattgcctgactgatttagggcagccctgtggaagcatgtaaacgaaaccatcttaataatttcatagatgaatttctgcctatgtggtatagcctcttgggtctccttcccagtgccagattcccccatctcaacctcattttgacatcctatattaagaaaaaacaaagcaggtactaatcagcaagaacagaatcctattctcttgacagaattcccatgatctataacctgctggataaatagttcaaatcctatatctctgttcctattcctagactttctggcacctattacccttcaagtccatgtgtcttccactaggctgccatgctctccgcaggagagggcagctgcctagatttgtatgttacagaggtggtcgtgtgccttctctacctctctcctgtgttcccatgtaacctacctctctcctgtgttcccatgtaacctaaccacacaggccataatcagctccaccctaagaaacagaacattgttagacctgtcccttgaagttgtacttagagagaatggcctgaaaacacaagggagattaaaggtcttttccttttcagggaaagtatagttctataagtagatatctggttaaaagacacagaagaaggaaaaaagacactcatctgtaggaactcagtttagccaacatgacttccacttggaagcatttttcctctcctcttcaagcccaactctagggaataccctgtgcaaaaatatcagtgtaggcacatctctttgcggaattgagttgctttgctttcgcagtttcctctctccagtacccccaagctcctgtctggcttcttatactgttcaacccaggatcctatgttctagaacggccttctcaccatctttcctcagctcttaattcgaaagtcccacttctagttcatgctcagagaaaaagcaagtagacctaatctttattagaacgtgcatttccagacaatagtactctatttggcttactttgctcccctacatggtggactttcagataatataaggaagagaaaaaagtctagatgttggagagggagtcagttttaggtagggaagatccagtcagtcctacaggttattatctgctcttcagcattccttatagctctctggcaacaagtgacaggtcggaccatatggagttactattttttttacttttggcttagaaaatggctattttatatgattcagcctaacacttgggttttctttgctaaccttaggggttacagttgaaccagccaactcaggaggaaatccagaacctggattcttatagtggaaaacaaattcacggttaagatttgaatgtgaattttaaaataaatcatagtattttaaaaaacaatttttccttattaggtatgtaactttggaaaagttacttaaccagtttataacagtacctattttatagggctgttgtgaggatttaatgagataatttatggaaagcacatggcactgtgccaaactcataataagtactcattaagtgttggtcacagttctcaccagccttgttctctgtcctcaggagatgatgaccacaattggaaaattgcccatgtggtgctcaaagaggaacagaagtttcgctaccttttccagggcacaaaaggcgaccctcagaactcaactgggggaatttacctagatgacatcactctgacagaaaccccctgccccacaggggtctggacagtccggaatttctcccaagtccttgagaacaccagcaaaggggacaagcttcagagccctcgattctacaattcggagggatatggttttggggtaactttatacccaaatagcagagaaagctctggttacttgagacttgcttttcatgtgtgcagtggggagaacgatgctatcctggagtggccggtagaaaacagacaggtgataattaccatccttgaccaggagcctgatgtccggaacaggatgtcctcaagcatggtgttcactacctcgaagtcgcacacatctccaggtgggtggtgtcagcgcaaataagaactgccccttgaaccagagaggcccacagatgtgattctgtggtgcaagaaagagtaacgttctcctcacattgtctgtttgggaataccaataacatagtcttgttggagtttcaagtcaagattttcaatgccatcacatcctccttccctttcctaaattcactcatcaaacatctattgagggcttaccatgtgccaaagtcggtgctaggtacttagaatacaagtgaatcaggtgatccctgcctcactgagctcgttgtgattgaggaaatagatactgctaatcatttatcaaatacttggaacttgctgggctctgtgcagagctaatgtacttactcctaaaatagtactcaatgttactatgttcatgaagtaaacttacatcagtaaagaaatgggcaaactattttttttttttttttgagatggagtctccctctgtcgcccaggctgcaatgtaatggcgcattctcggctcactgcaacctccacctcccaggttcaaacaattcttctgtctcagactcccgagtagagatggggtttcaccgtgttgcccaggctggtcttgaactcctgagctcaggcaatccacccgctttggcctcccaaagtgctaggattacaggcgtgagccaccacgcctggcactaatttttttttttttcaaaagagaagacttaagccttagaagaaagaagccgtagctgtccctctcttttcattaagaaagtcgctcagtagcagacaactgatcactcagagctgtgattctctgcctctcccatctttcaattctgaattgcaattctcctggaaatagtaaatagcctaatttttttccaacactttttttatttttatatttatttatttatttatttatttatttatttatttatttatttatttctgattcacaaagccctgtatcctcattaaagacaaactggaaagtgaagtctaaagaggtaatgtgattttatgttacctacaactttgcagcgataaatgacactgtcatctgggacaggccgtccagggtgggaacctatcatacggactgtaattgttttagaagcatcgacttgggctggagtggtttcatttcccaccaaatgctgaaaaggaggagtttcctgaaaaatgatgacctcatcatatttgtggactttgaaggtacttttgttggtcttcctgagtaaataatcctatgctcttggcactctactgattttatcctgatttttaaagcacacacggagggtggggatgaggttaaaacaatgtgttgtaggagaatcacattttattcaattggtcaaggactcacatctttattttaattgtccttgaaagaaactgaaattttagtgtcatctttttgataattttatcagaggtaaccgttcactgatttcaatttagtttccatcagcctatccatgctaattttatgcttcattttgcaaattcaataaataaaaatgtgactggattactttaaaataaaagtagctaatactgtgggaatcagctggattcaaagccacttttccatgtcactaggggtgatgggagatagaagcaggctggggaactttcaccagaagtgggagttaattgtagtcagttactaatcctggatcttcctcatgactctctatttcctgaagatatcacccacctcagccagactgaagttcccactaaaggcaaaagactgagcccccaaggcctcattctccaaggccaggagcagcaggtctccgaagaaggttcgggaaaggccatgttagaggaagccctacctgtcagcctgagccaggggcagcccagccgacagaagcggtcggtggagaacacaggccccctggaggaccataactggccacagtacttcagagacccatgtgacccaaacccttgccaaaatgacggcatctgtgtgaacgtgaaggggatggcgagctgcaggtaggctctgtggctggggagacaggcaggccagcagacctgggccgtgtgcatgcttgctcctggtaaaggctgctgtttgcagagtagggcgaagactacctcagatggtcaactgaatgcggttttctttgactctacaaaggtgtgccctggattcatgggcttatgctgccaggacagaggcttcccaggtcaccttgtctcttgactttcaccccttttcccctcttctggggtattgtcaacagcatcttggatgttgttggaatttctaactctaacaacacccaagatggcttctagcctagggactttctactccatgagggtgggtctcaagaccaagcttaaatctttgctgactacagatgttattagttcctaattattattagttctatagtctgtcatttacactgtactattattacagttatattttcaataatagtagtaagaacacctgatatttctgaccccttgttatgcatcatgtagtctcctgagcatcttacacgcatgatctaaattcattctcactgccacctgtgacataagggctctccttatccccgtttagtgtgtcaagaagttgaagcttagaaagattaagtaatttatctaaaatgtacccagatggaaaatgctgaagctgggacttgcatctaggtctgtctggcagcacagtttgctatattttatagttctttttataatgtttgcttgcataaaaccctaaaaactgtttcacaaaaggaggtatgtgatgacagaagcaacagttccatttgaacagtagcagatgtagaagctattctgcctgcctcaaaaatttacatttcttctgagttctttttagtctccttttttttctctttttgtagcttttattttgaaataattttagacttacagatacaatgcaaaaatactacagaggttttctctataccattcacccagctttccctaatgttagcatattacacaaaccatagtacaattagcatagccaagaaatgaacattggtacaatgctagtaaataaattacaggccttattcagctcttcccagttttcccactaatgttctttttctatttcaggatccaattctggatctcacattacatttagcttttatgtctcctgtctcctaatcccctccaatttgggacaattcctcagttctttcttgtccttcattaccttgacactttcgaagattactggtcagggattttttttttttttttggttcatcttgttcttacatgattagattgaagtttcacatttgtggcaagattagtaaagatgtgctatgccttctcgctgcagcgtgtgaacaggtacatgatgcctatacatgtcattactggtgatgtcaaccttcattatctggccaacagcatgtccaccaggcctctccactgaagagttaccatttctccctctgtaattaatacgtatattgggagagatattccaagaccatggagacattctgcttttcctcaaatcctcacacactaatttcagcatctgttgacacatcctgctgcaatactcaccactgagatcttctaatgttgatttcctatatccttcacattcattaattataatctcctgtaaagaagaatggcaccttcaccccgttaatttgtttatgtgattgtttattcacatcacgaaggaatcataaacattaattttattcagtgggctctgttgcaataatttcatgatttattttgttgcttctattgtcccagctttggcctttgggagctcttccaggttggctcctgtgctctttcaacatcagattttatgaacacaatgttactttctggcaccataacatgctctaggctcatctttaatttttcctgccccacccatagaatcaatcactcttccaagaagccctctggttccttttactggggaaggcccatctgtttctgggctccaaagccataggtctgcatatctttgcctgacaggcccttagatgccagattccattatgtgtccccaacaggcttcatccttcccaggctaagggaggccagggctgccacttgtatgtcagcctccactcagccaaactattgctctcctagaaacctgcagctgagagttggcagaataagtttttctaaggtaacactaggggatatcactaagttgtgtttggagaggactgggtcagaaaaaaatgaaataaacttgctattactcactgatttctaagaagtcaattctcaggatagagatgaggccttggaaggtaaaatcattcaggattagtaaaagaaaatgctgacttcttattttttttttttttgagacagtttttgctcttgtcacccaggctggagtgcaatggcacgatttcagctcactgcaacttccaccccccgggttcaagcaattctactgcctcagcctcccgagtagctgggattacaggtgcccaccaccatgtctggctattttttttttttttttggtatttttagtagagatgagaccatcttggccaggctgatctcaaactcctgacctcaggtgatccacccggcctcccaaagtgctggtattacaggcgtatgccaccatgcccaaccagaaaatgctgacttctaattgtttcactctgctctgtagaattctgctgagtagaccttctagtaggaatgtttgaaacaaaggctggaattgttacaaaggtatggatgagacactacaagttatatgccttggttatgagattagttgatctttataccagataacattaagaaacaaaactaagggctggccattatgtgcttactctgtgttaaataccttgataagtacagtgtcctcattatctcatgtgaacttcagggcaacctcgtgagatagtgacagtacacactaaccttatagtaacattttatttgatattatttagaagtttttaagttaccactgatgctctaagtcggtctatatctggggaatttcctttgtagcttatattctcagccagtgtcaggcaatgtattcctttaagtgtctcaggccttcctcctgagtccttggtggctgagagtcctggatctggaggcatacctcttgagattagatttcaagtgtgaaacacttactaacaatgtgaccttgagcaaattatttaaccttcctgtaagatgaagatgatgagaatggccaagtaatagcctccacctcaaagggttgttgcagggttaaattagttggtccatatacagctcttgaaatgggaccaggcaccacgtggacctgctcagtgagcgtttgccatttttattgctgtggagatgagtgttgctaggaggcacctgaggcctgggtagttcccacactcccttcatgtccttttccctcaggtgcatctctggacatgctttcttctacacgggggagcgctgtcaggccgtgcaggtgcacggcagtgtcctgggcatggtgatcggaggcacggctggcgtgatcttcttgaccttctccatcatcgccatcctttcccaaaggccaaggaagtgacctgcctgctggcattggccagaccacagcagcacctcctccatgcaggccttaactttcccatggtcaatgcagtttttatcagccttgctttggataggacctccaaggactaaggcctccagccccatgtgtgacccttgtcatctctctgccccacataattctgttactttgctatgtgctcctaatgtatctagtgtgtcctgtgacaacactcatcacacttcattgtaaatcacttgttttattgactgtctttcctatagactgtaagctccatgagggcaggcacatgttgttctcattgaccgtgctggccccagtgcctagatgcatggctggcacattgttggcactcaacaatggttgaatgaataaaacaataaatgaatgaataactaagatatagaaactctcatttatattgcagattgaatatatatgatgaaattcttatgttgaatatgttagaatcaaatactcatttttcattagatacagtagtgtcattactcttttaagatcttgttaaagatttcaaataaaggtacttctaggcagcccggcttcacagcatttgctttcctctgagattctaagagaagccctttaataaatttaataaatattgagttagcaccttctttgtatctggtattgtatgtacgtgtgggtgtgcatgtgtgtgttgaaggttgggggtgttcaaaagctctttcccagatcttttaagtttaatagcatattttatagctatttatgtacaacattatcatattaacaaactgaaggtatcagagaactttaaagaagtatttttagatatgctttctttccatagttcctaaggagataaactctagctggggcaaggaagttccaagatagagcaagtgaaaaaaaaaaaaaagctaaagtttctatacccaatcagcaataagtcagctcaggaagtttaataaatgaaaagattttaaggattctgagtggtcctttaagtcataaggtttcctaagtagagactttatgacaattttgtagagttaaaatgcactggaaacaaaatgagagattaacaagagtttctttaatgcaaagttatgggaacaatttgtagcgagtgaaaacagcacccctgagggcaataactctcaaacttcaggtgcatctgtatcccagggaggactgattaaaacagattacaaggccctacacccagagtttctgggtcagtagatctagggtgggatctaagaatgtgcattcttaaatgtgccagaatctaacaagatataagaatgtgccagaatctagtaggtttccaggccatgctgctactgctactgactcccccacaacctccacctcacagacaccttgagaaccactgctctagtggatagaaaacaggtctggaagccaagcatcctggctgcaggcttggattgcccatccagctagctgggtaaattttagtaagaaatcatttaagctcttgatcttagtttactaacttgtcaaatggaaataatagctgactatctccttccacatgactttaccacttacagagtagcagagtaatacaatgggataatgaatatgaacctatcttagagtttaatatgtatgaaaatattactattcaatgttcagactagataggaagctatcctgtcaccagcccagttgtattatctccaaagaccagattggaaatggatttcagctttgtttctcgctgtgcttcacagtcctgcaaaccctccactaacctcagagttaggcctaaagaaagccatgcccttaacactctgctcaatatctgacctcagaagtgaactctaggctttgttgctgctgctgctgttattgtccttttgttttattaaaaggagcatgctgtggtctgtcacacatggaaaggccccaagcccaaaccaatgacaacatttcttaaatacatgagtttctctctggaggaagcagaagctaaaatttcaaagataacctagtattttcatctagtactccaaattaaaactgctaggtcaaaataatgataagtaggtaccagaatgagggtaaagcattttgatatttatttctctctagattctcaaccagcaccatgcctactatctatgtttatcacttttgatgattaatggaaacctctgttgattgattaatggtctggctcactgtaaatctgacatgttattcagcttttctttgagcccaaaccctcaataattccaggaggactagcagatactttattcttttaagatgttgggatggtgatggcagagggcatgtagggtggggagtaggtagaaattaagcatttcataatctctaggcagtgtggaattcaggatttagaggagcaacacgaaaaatgtgggaaatcctccctgaatctgagtgtctgacttctttaatcttacatagtgggaataagtcatagtggcttgaaaatttgagaatgtctcatgcttcccccaccatatcctcgatacatccccatctgcatcctttccttctgtgaactgacctgagccaatctggccattcacaaacgtcaggttctttcagtaatatctggagcctctgataattagaagtggatg

SEQ ID NO: 17601 - DNA, 57839 bp, Human
aagttattttctttttcttttttttttttatgtttgtttctaccgctttatttttatttatttatttacttagagacactaaaaagggtatacagattttatgtgtacagctcaacgatctgtgacaaagcaaacacactccagtaaccagcatccagatcaagttacggagcgttgccaacaccctagaactcacccctcatgccctcctctaatcactgtaccttctctccactctccaaagcagtgtaacacagagattagctctgttttcaaacaagcagttggaatgatacaatgtgtacattttgtgcctgacttcctttactcaacattacgtttgtaagatttatccatgttactatgtggagctgtattagttcattttcattgttgtataatgcattatatgaccaaatgacaattatttatcctttctgccaacaaacgtgtgctgtttccaccttgggaatgttttaaatagttttgctataagcgttgttgcataccttctggtgcacatatatacacatttccattaggcatgtgtgtatatactaggagtaggatttctgggtcatagcgtatacattttcaacttctgtaaagagtaccaaccagctttcaaagtgtatgttgcaatttatgcctttatcagaaatgtatgagaattccagttgcttctcatactcaccaagacttaattttatcagatagtctttttaactttagccattctggagtatatagtactatttcaatatggttttaatatgcatttccttaattaataatgaagttttacgtttttgtcctttattggctatttgaatattcacttttataaaatgcctgctcaagtttttcacccatttttatcttgtgttgattttctaggagtcctttacatattctgtccacaacccctttgtcagttataagagtagcatacatgacttgagccacaaaatatgtgtataaatttgaaatgtaaatttcaactgatttcttacaggtttagttaccatttcagttttatagtatagaactaagctaaacaaagtattttacaaatctgtgataaataattcttaaatagaaagagtacattttttattaaaatacatcttctaaagacaagaacagggcaagttttttttttaattagctcccttatccttaaatgaataaaatacccaatgttaaaaagtcagcaagttattttcctgttgcatttggattttgactagtatacaatttttcttttctttttttttttttttttttttttttttgagaaagagtttcactcttgtcacccaggctggagtgcaatggtttgatcttggctcattgcaacctccacctcctgggttcaagcgattatcatgcctcagtctcctgagtagctgggattacaggcatgcaccaccaagcctagttaatttcttatttttcgtagagatggggttttaccatgtcagccaggctggtctcgaacacctgacctcaggtgatctgcgtgccttagcctctaaaaatgcaggtgtgcaaaaattacagatgtgatgtaaggcaaattttgcaaattgcaaattttgcaaatgcaaaaattacaggtgtgagccagtgcgcccagccatatataacattttaaatctcagctacaaagtgttttcacatacatattctcaactgatttttataatcaatttgagatgcattgtcagtttcattttacaaatggaaaaaaaggaagctgaggcaaaggtcaggcagtgaaaccaaagcatcacagccagtagatcaagctgtagggtgggatccaagtcttcgtttctctcgttctactgtgttgcagcatgctgtcaagaggatgcagtcctggtcggatctttaacaggaatgatgatggtggtgctggaattgttggccctttttctgctctgctcctatgtaacatcttcttggtttttgttcctttccctccccttctgtttctttcagcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggtaacttaacctcatgaattatttatttgaggaaggctttgagcccagtggaggtaccaagagtgggcttataccaaagatgttttctccatttcgtgtattccaaagtcaccccttggagagaggccttcatatggtggctaattaaatctggcttttttggacttaatagaaacatgtagactcagaatttttctgttaggggagatcagatatctaaaaactaggtcacatcaagctataaaatatgaaccaagagaaacaaggacagcgtgtgaccttatgtaagttacttaacctcttcaggcctcagtttcaaacttgtcaaacaaatgaataatttagatgtttaaggttccttccagatcaaaagttttccaacatggagtcagtcccaggtagacatagccaggagcagagaagagggagaaaggaagaaaataccattacatccggaagcgagagatgaattttgaatccaggtggggcaaagaatgggtaggaaagttagaagctcaggaaataagcaaatttgtatcagattgaaggtaactagcactcatgtctggaaaataataactttattttttccaaatgattttaactttactccttatatcaattattcaagttttccatcagaacctcaagcagaatataaaatttatcctttattttcaaatcctttttgatttaatgtaattttcatgagatgatgaccaacttgagttgttcctcctagtgtcctctcatgcatgattacatttagccttcatgataagcctgtgaagacagccatcttacaattgccagttgaaatgaagaaacagcctccaagagctcagatggccactctagctttgcttaggccaagtcctgtctcttgggactcaaaattcccatctctcatacttcttaatgaaaattacttatggaggcttctctgagagaagtctgctaagctgccagcccaaatcttgtttaatcttttgataacagatgctcttatttgctgacctgtcctaccaagtctttcaccagtcaaatttgcatttgaattcttttttttatcttagtcatattctcagttttaccactgcatcataaaatagtcaaaaggtgggagaaggaggatggacaaaataattaaatttgaactggttctctgaaaactcaaaataagaattgattagatctctgcacatatatgtgcctgctcaatatgtgaagtacaggagaagctgctgtcaagctcagctgttggatccttaaggttgcccttggttttggtgtaagaatgtgagtttagtggttcagttccatttttgccttccacatgaaggtgccattagggtctttatgaaaatgtgcaacacaatttattcttaagccccaagggtcatcttatctttgattatctggcctagcttggagatgaccagggaaaggagggaatgtatagatccccaaatatggaaaagctcttcccccctccttactcttttttctaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtgagccttctctcttctctccttgctcacagatctctctaccactttttccctagtccctgttttctgaaggaatgggaatgcgtagtttgtggaatctcctttgtagaccaaacactacttgatctagtcgtgttatagaaaaagagattgaccgtctcattagaagtaatgcattcagagagaataatctctcttcctccttttcccctggtacctttaaaacagaagaatgttgtggaatcagagacctgattgactcctagggactttgtttgaccttgtcatttaacaaatgagaaatttgagtttagagaggtttggcaacattgatccaaacaagaggctagttgtttttgaggacagatgggacgagactcctgactgttggagcacttgcttttgctatacgattaggctgtgaagcaaatgaaggggacaaaacccaacttgtcataagtttgccattttcagtcagaaccttgcttttagattcctaacaatttcgtcacatatatattttccccacttaaattttaggatcccatgtctatcaggagggtaggatggtcttttggattgtagaccccagaagcataatatgtcggtcatcatctgagcctcagcattacatctctttcctggtagtcagcatgtgttgaatacaggctggaatattttggcctttcctcttttgagggcaaaaaatagcttatagaacttgtcccagagctaagtttgatctgaagactgcagttttcagactgtgcagtaacttctctttctttaaatcctaaatgaaacttcagcccagttttgataaccccattcaggtgtgtcctctcccctcaaagagaaaggggtatatctatttttctaaaaagcagtttggctttttggggtcttacaaatatttataccatttggcgtggcaattccattcttgtgaatatatcataaaggtataatcagaaacactgaaacaaagatataagcacaaagatcttaaacttttaacccaacatcatgtctcatagaaattgaaaataacagaaggacagttttagggaaaaactaagtaaattatggtatattcatagaatggaatattatgttgacattcaagattttatgaagtttttgattttagccaggaaagtgtttatactaggttaaaggaaaaaaacaaacaccaaactacatactttgtagaatataatcccaactctcattaaacttgagaataagactgaatggaaatatgccaaagtgacaattttttttccccagtgtggtgggatttatgtgtgggtttcttttttctttattagttttctgtactttccccaagttgtctgtactaagtacatgccacttctataacgaaacgtttagaaaaagttaaaaaagtcttgcaactcattttgcttccccttattgatttgtgtaaatcaagtttgtccatcccatgacccaggacagctttggctttgaatgcagcccgacacaaattcataaactttctgagggttttttttttttattttttttttgagacagaatttagctcttgttgctcaggctggagtgcaatggtgtgatctcagctcaccacaacttcacctcccaggttcaagcgattctcctgcctcagcctcctgagtagctgggattacaggcatgtaccaccatgcccagctaattttgtatttttactagagatggggtttctccatgttggtcaggctggtcttgaactcccaacctcaggtgatccgcccgcctcggcctcccaaagtgctgggattacaggtgtgagccaccttgcccagcgttttttgtttgtttttttagcttatcagctattattggtgtattttatgtggcccaagacgattcttcttccagtgtggctcagggaagccaaaagattggacacctatgatgtagatggtcaaaagtcaagtgaaagtcgggcagaggcaaacatcctatttgggtcttatcagactaagcctgcataaacttgaataagacaactatttactggaagcctgtctggggaaagcttcaattcccccttctttttaattaaaaaaaaaaaaatctttttatttgtacataattccaaacttttgaaaagttgcagcaacagtacaaagaatacctacatacctgtgcccacatttatctattattaacatattgctcttttgctttgtcatttgctctctctacgtaaaaaatacacctattggcccaggcgtggtggctcatgcctgtaatcccagcactttgggaggccgaggcatgcagatcaactgaggtcaggagtttgagacccgcctggccaacatggcgaaacctcgtatctactaaaaatacagtaattagccaggtatggtggcacacgcctatagtcccagtttttcgggaggctagggcaggagaatcacttgaacctgggaggcggaggttgcagtgagccaggatcgtgccgctgcactccggcctgggccacagagtgagacttcatctcaaaaaaaaaaaaaatcacatatagattttatattgtaaaatatgtattatagaatagcttattatatattatataacatgtaatatataatatataattatgtgcatatatacacatacatacatggaaaaaataatttttcttaattattttatggccttttatcccctgatactttagcatgtatttcctgacaataagactgttctcttcagaaaacatactacagttttcaaccttaataaatttagcagggttacaatcctttgcctttcatttgccaatattgtatgttgacccaataaggcccttggtagataatatacttttttttctctagtgtaggatccagtctaggatcagaattgcattaaactgccctgtaagtgcctagtcaggatatttgttctgttgcagatttacccaattagtagaaaaccatgtgaacatcctgatagataattaaatatctggaactgtcctctcattattcactttattacaaaagcaactccattcctttagtagttgcatttatagattatggtcagctacatttttaaactctcttttgcagtctggtttttaaaattcttgagaacacagcaagttgtagagtaaaaactggtccagcagcagaaagcaatttaatataatgaccttagacgttcttatgaccatggtaaccttataaactactatgcctgtgtccttaaaacaatatcctattttgtaaaaataatggaagtgccaaatcaaacaaagcctgatcctactcgtctgtgaaagcagtaccacagcaatatgcttttcaaactaaattacagtagtttcattgaggcataactatctcttccaatagtttaggcttgttcctcagatttttgcattgggatatttatatttaaggtgtttttctaaggaaagtcttttctttccaaattgctagtctcaaacatgcaaccgggtaaaatcctattacaaagagaggttctgtttagtaaagctattccaggtgctcagagaggcctctagaaacagggctttgttggtctgattgcattgagttctggccagcagataatcccgtataataagatcttttcctggtccttgtctatttcacactgaattgttcatgaggataaggtgggagggaaatggcttagccttgggttgttttctatcagaggtcttctaaaacctcacttatccctgcctaccctcagtagaacaagccatgctcctggatgccatatacatcctccaaactttgaagctaggccattggtttctgtctttcttgcgaacaaaaacctcttttattattcagctctactcatccatctttgtctaccatggacttatagtttttaaagctgaactccagaaagctacaatcctactttcatggagtcctagtattggaaacataagaggaggcctcgcatggctaggagatggaagaataaaggtgctgtggtattttgtactctttcttcctttctgaagtcagagcaattttatgtttggtaaatgttggtatatgtttggggactggactgtgatttcacgtaatgtatctatttcagcaacaggaattggaagtatcttcagaatgtttacatataaaaatatagttaagaggttgaagtgtcagccagataagaatattgttaatactcaatttgtcatgcttttatcgttttctgaaaatgtatttctttttgttgtataacctcaatgtaatggggtaagtggagggggagggtccaaaaatttcaatttaattaaaaattaaggatttatgtggattcacattaattgagaggttacgtggaaaacatttttttatttgatctgttttgtcacaaaagaacaaaagtaaagatagtagaatttaatccctatacaattggccatacattgcactgagaaaagtcaccaatgatctgcaaacagccactttgttcatttccttagagctatggaggctacaaaactgtattccagtcccaattgaaaaacagggtagctgagaacagaaaccaattgctgtttgctcattgcagtttctaatttgtgccgttactatttcccttttccttctttcttcctctccttcctcccttccctactttcctattatccttctctcccccattcttcctccctctttaactatttgcaaaaagtaggaagtcttgttctcagcaactagtgggcctagaaatttagaggggaagtttgaaaagcaggtgaggagtaggaattgccctgaaagtacttatggatgaagaagctctgcaaagtgacaataggaacaaaacatcggcagtttctggcttggatcatatttcctttttccttcagactgtgaagaaaagtgagggaaaaaaggtgagagacaaaggaattgggtatacctcgtttaaacctgctcagtttctctgctctgccttgaggagacactgtagtaagcatttgatagagacagtgatcccacttcacgtagttacctgaggcacatgccatagataggcagcatctcctttaaatcaactgcaacagggattacgaaatcagttggggcaggcattatttctcaagcagattgttttgtatcctctacagcaaaagggcaaaggtcttattctgtagaactggattctaagatgcaatttcttcattcctttagctctcgccatctgtcactgtttaactctttgtggctatgtggtttgtctccccacatagcttctaagttcttagagagaagacattgggtcttactgtatgtcccctgtgcctggaatagggcttgaggaggggtggtccagagctgagctagcacatatggtaaccactagcctcatgagctatttaatttaaaactaagattaactgaagttaaaaattcagttcctcagttgcaccagccacatcttaagtactcagtagccgcacatagcttgtggttaccatattggataggacagataaaggacattgccatcatcatacaaagttctcttggatagcactggtgtaaagcatccataaactaagtaatctacatatgcttttaaaggccagattgttttaaagacattggattggtttttttcttgttgatttatactgatgttggtgttagggatttaaacatagagaccttcaggtgggttctttatactaaattgccatagatggtaagaattatttttcagagctaaaggaagcttccataatagcactgctttaaaatatgcaaaaactgactaggaaaagattgctgacatccctcatctgatttgcttatttcaaagtgaaacacatcagcccatggacactggagagcagggtgatgccaagagagagaaccctgctaattcaaaggccaaggcagcttcgtaaatgcttaggtgctcgtgtttaactagtgtggaaatggattaaccttgtgcgtggcgttagcagacaagcatgagatgcttgtaggagtaatgtggttgggctgaagtgggagtgagggaggcacaggagatgaagcttttgggtaagaaagaagcatcatagactagaaattcataaacctgggttctaaaattctggatttgccatttcctagtcatggactctcagttaaaaccttttacttctctgggcctctgtttataatgttagaaaattttaaaaaatgcattagaatatgcagttaggaacaaagactctggagtctggtttccctttgcttaccagctgcgtgagccagggcaagttacttaaccactctgtgctttagtttcttcatgtgtaatacagggatactaatagtacacaggctgtagtgaggattacatacatgagtgtgtgcccagtgcttgggacattgctggccacatggtccacagttcacaagtgatagcagtgatgaggacgagggtgcaaacgctggagatgatgcagaggatggatcatcatcatcctcaccactgacatcatcacctccttcctctctggcagtctcagtttgtttcccgattaagtcacagaaatgaccactagcaagaaagaaacattctcctttaaaatactatacttaggggttgggcgcagtggctcacgcctgtaatcccagcactttggaggccgaggcaggccgatcatttgaggtcagtagttcaagaccagcctggccaacttggcgaaactctgtctctactaaaaatataaaattaaccaggcgtggtggcgggcgcctgtaatcccaggtactcaggaggctgaggctggggaatcactggaactcaggaggcagaggttgcagtgagccaagatcgtgccactgtacttcagcctgggcaacaagagaaaaactccatctcaaaaaaacaaaacaaaacaaaacaaaaccaaaaaaactgtacttaggtaggagcaacactgccaccttaaaggagcttattaggaagatgggtttccctccataccagatatgattattagcttaattaatttacacatgtaggcagtgctctctcaaatgggcagagcctctgagatcatcaagcaagactcttcagtggctttagacttggatataaatctatgctgtccaaaacaatattttccctaagctatctataccatgggtcagcaagttaggagatattttaagagaatctaggagatattttaggattataggctgcaactactccactctgtttgaaagtgtagtagtgtgaaagtggccagagacaccatgtaaattatgggtgtggctgtgttccaacaaagctttatttgcaagaacaggtggtttgtcctgcaggttgtcgcctaccagcatctggtctatgccatagacttgtcatctcttagcagcttcttctctttcaccttctgctggcttgcacagcttggataaacagtttgattcttggaggctttctcgaatttcaacagttcgagctcagtttttcctctagcagtaactatttctaagtctgctgaaggggtaagtaacaaaggagaaccatcagctatgagtgggagcaaaaaaggtggcagctgtccttgtattttctcttaaaaattgttctatgcttcctccatctcctaacagatgtcggctttcaccaggagactccatcttatgtatgggtccacctcacaggtgtacctgccatgtacctgctacaactcatctctttgccaaactggagccatagagaagagaggagggggtctgggagagctcaggttcaaatccattcagctactaaaaggctggatgatctcaggcaaggcactttctctctttggatctcatctttctttgtaaaatcaggagacttgaacccatcacagaagggccaccagattttgatcagtgtgacaatttatctgtgccttacctgagtgtgcctactgtcttcctggtgtctatcaggaaaaacactggcctgaggggtcctgcaatgtgctgtagggtggagaacactgcgctgccagtcagagggaagaggccaggctcaatgccaacctcatgccactgaaggattgtgtgctcactgcaacatgaaagagctttcccccaggcttttgaacgtgtgagggcaggttagtgaaaatttctatttaaattaggtcacagggttgggggaaaaccaagagaatgtgtaataactctgtgtgcttttagggagaatgtgagacatttttttttctttttttaaaattacactttaagcactagggtacatgtgcacaacatgcagatttgatacataggtatacatgtgccatgttggtttgctgcacctatcaactcatcatttacattaggtatttctgctaatgctatccttccccgagtccgccaccccccaacaggccccggtgggtgatgttccccaccctgtgtccaagtaatctcgttgttcagttcccacctatgagtgagaacatgcggtgtttggttttctgtccttgtgatagtttgctgagaatgatggtttccaacttcatccatgtccctgtaaaggacatgaactcatcttttttatggctgcatagtattccatggtgtatatgtgccacatttttttaatccagtctatcattgatggacatttgggttttttccaggtctttgctattgtgaatagtgctgcaataaacatatgtgtgcatgtatctttatagtagcatgatttataatcctttgggtgtataaccagtaatgggattgctgggtcaaatgataattctagttctagatccttgaggaatcgccacactgtcttccacaatggttgaactaatttacactcccacattaggagtgggaatataggaacataaaagcattcctatttctccacatcctctccagtatctgttgtttcctgactttttaatgattgccattctaactggagtaagatggtatctcattgtggttttgatttgcatttctctgatgaccagtgatgatgagcattttttcatgtgtctgttggctgcatagatgtcttcttttgagaagtgtctgttcatatcctttgcccactttttgatggggttgtttgtttttttcttgtaaatttgtttcagttctttgtagattctggttattagccctttgtctgatgggtagactgcaaaaattttctcccattccgtaggctgcctgttcactctgatgatagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagagtttttatggttttaggtctaacattaaatctttaatccatgttgaattaatttttgtataaggtgtaaggaagggatccagtttcagctttctacatgtggctagccagttttcccaacaccatttattaaatagggaatcctttccccatttcttgtttttgtcaggtttgtcaaagatcaggtggttatagatgtgtgtggtgttatttctgaggcctgtgttctgttccattggtctatatatctgttttggtaccagtaccatgctattttggttactatagccttgtagtatagtttgaagtcaggtagcgtgatgcctccagctttgttctttttgcttaggattgtcttggcaatgcaggccctttttttggtcccatatgaactttaaagtagttttttccaattccgtgaagaaaatcattggtagcttgatggggatggcattgaatctataaattactttgggcagtatggccattttcacaatattcattcttcctatccatgagcatggaatattcttccagttatttgtgtcctcttatttcgttgagcagtgtttgtagttctccttgaagaggtccctcacatcccttgtaagttggattcctaggtattttattttctttatagcaattgtgaatggaagttcactcatgatttggctctcatttgtctgttaatggtgtataggaatgcttgtgatttttgcacattgattttatatcctcagcttaaggagatttggggctgagatgatgggattttctaaatatatggtcatgtcatctgcaaacagggacaatttgacttcctcatttcgtaattgaataccctttatttctttctcttgcctgattgccctggccagaacttccaactttatggtgaataggagtggtgagagagggcatccttgtcttgtgccagttttcaaagggaaagtttccagtttttgcccattcagtatgatgttggctgtgggtttgtcatcaatagcacttattattttgagatacattccatcaatacctagtttattgagattttttagcatgaagcgctgttgaattttgtcgaaggccttttctgcatctattgagataatgttgtttttgtcgttggttctgtttatgtgatggattacatttattgatttgcatatgttgaaccagccttgcatcccaggggatgaagctgacttgatcatggtgaataagctttttgatgtactgctggatttggtttgcaagtattttattgaggattttcccattgatgttcatcagggatattggtctaaaattctctttttttgttgtgtctctgccaggccttggtatcaagatgatgctggcctcataaaatgagttagggaggattccctttttttctgttgattggaatagtttcagaaggaatggtaccagctcctctttgtacttctggtagaatttggctgtgaatccatctggtcctggacattttttggtgggtaggctattaattattgcctcaatttcagagcctgttattggtctattcagagattcaacttcctcctggtttaatcttaggagggtgtatgtgtccaggaatctatccatttcttctagattttctaatttatttgcatagaggtgtttatagtattctctgatggtagtttgtatttctgtgggatcggtggtgatatcccttttatcattttttattgcatcaatttgattcttctctcttcttctttattagtcttgctaatggtctaccaattttattgatcttctcaaaaaaccagctcctggattcattgattttttgaagggttctttgtgtctttatctctttcagttctgctctgattttgcttttttcttgccttctgctagcttttgaatgtgtttgctcttgcttctctagttcttttaattgtgatgttagggtgttgattttagatctttcctgctttctcatgtgggtgtttagtgctataaatttccctctacacactgctttaaatgtgtcccagagattctggtacgttgtgtctttgttctcattggtttcaaagaacatctttatttctgccttcattttgttatttacccagtagtcattcaggggcaggttattcagtttccatgtagttgtgtggttttgagtgagtttcttaatcctgagttctaatttaattgcactgtggtctgagagacagtttgttgtgatttctgttcttttatatttgctgaggagtgctttacttccaattatatggtcaattttagaaaaagtgtgatgtggtgctgagaagaatgtatattctgttgatttggggtgcagagttctgtagatgtctattaggtctgcttgttgtagagctgagttcaagtctggatatccttgttacccttctgtttcgttgatctgtctaatactgacaatggggtgttaaagtctcccattattattgtgtgggagtctaagtctgtttgtatgtctctaaggacttgctttatgaatctgggtgctcctgtatttggtgcatatatattaaggatagttagcttttcttgtcaaattgatccctttaccattatgtaatggccttctttgtctcttttgatctttgttggtttaaagtctgttttatcagagactaggattgcaacccctactttttttttgctttccatttgcttgatagatcttcctccatccccttattttgagcctatgtgtgtgtgtgcgtgtgagatgggtctcctgaatacagcacaacaatgggtcttgactctttatccaatttgccagtctgtgtcttttaattggggcatttagcccaattacatttaaggttaatattgttatgtgtgagtttgatcttgtcattatgatgtttgctggttattttgcccgttaattgatgcagtttcttcatagcatcgacagtcttcacagtttggcatgtttttgcagtggctgatactggttgtttctctgcatgttttgtgcttccttcaggagctcttgtaaggcaggcctggtggtgacaaaatctctcagcatttgcttgtctgtaaaggattttatttctccttcacttatgaagcttagtttggctggatatgatattctggattgaaaattattttctttaagaatgttaaatattgtcccccactctcttctggcttatagggtttctgccaaaagatccactgttagtctgatgggcttccctttgtgggtaacctgacctttctctctggctccccttaacactttttcctttatttcaaccttggtgaatctgacaattatgtgtcttgaggttgctcttctcgaggagtatctttgtggtctctgtatttcctgaatttgaatgttggcctgccttggtaggttggggaagttctcctggataatattctgaagagtgttttccaacttggttccattctccccatcactttcaggtacactaatcaaatgtagatttggtcttttcacatagtcccatatttcttggaggctctgtttgtttctttttactcttttttctctaaccttgtcatctcgctttatttcattaatttgatcttcaatcactgataccctattttccacttgatcaaatcagctattgaagcttgtgcatgtgtctcgaagttctcgtgccatggttttcagctccatcaggtcatttaaggtcttctctacactgtttattctagttagccattagtctaacttttttttcaaggtttttagcttccttgcgataggttcaaacatgctcctttagctcggagaagtttgttattactgatcttctgaagcctacttctgtcaactcctcaaagtcattctcctttcagctttgttccattgctggcaaagagctgtgatcctttggaggagaagatgcgctctgatttttagaattttcagcttttctgctctgatttctccccatctttgtggttttatctacctttggtctttgatgttggtgacctacagatggggttttggtgtagatgacctttttgtttatgttgatgctattcatttctgtttgttagttttccttctaacagtcaggtccctcagctgcaggtctgttggattttgctggaggtccactccagaccttgttcgcctgggtatcaccagtggatgttgcagaacggcaaatattgcagaacagcaaatattgctgcttgatccttcctctggaagcttcatccgggaggggcagctgcctttatgaggtgtctgttggcccctgttgggaggtgagtcccagttaggctatacgggggtcagggacccacttgaggaggcagtctgtcccttctcagagctcatacgccatgctgggagaaccactgctctctttagagctgtcagacagggacataactctccccagtaaaaactttcttaagttatgtgtttaccacagatcagtgcatctttgtaatttgttgggactatgtgcttaagttttacaagataatctaaaagtgatacttgtgaatggagaaaactgtcgctcatatacgggtagaggctggggttatagaaataatttatttcacttctagaaaggcaatgtccaagtctggtttcacatgcaggttataggctaagtgctctgctgggaagaaggtggctttccaggggcccaggcagcgctcttgtccacagggtatatctttagccatgacaaccacaaatttcttcctttaaaaatgcttatgagagatattaaattagagaggcattattctctgtcttagatgatatttctccctctttgttctgctgtttggtacattatctcttggttgagagttattgttatccatatgttgcattatttgcctaaagagaagctaaatggtcagtctgcccaattctgaattagttggaatttggctaaagcagggaaatacattatatgaagtaaacatgctatcctattctgaaatgagggaagtttgggataagtttgtaaccaggttcacccttaaggaatctcaaggcaaaggaaaaactagaaaataatctttacaaagacttgttattcagctgcttaacttgtgatgtttttatttaattatatatatttgaacaccatgttcaaggcactgttccaggactagggcttactaggctttagtaatatagtgtttgttttcattttattttttggaaaatttacaaattggagagcaataaagatcatgggcaatgtgtgtatgtgtgtgtgtgtgtgtttgtgtgtgtgtgtttgtgtctgtgtgtgtctgtgtgtgtgtgtttgtgtgtaagtcacggttagaggagattcacttagtccagtcctctcattatacagaagatgaagctgaggcacaggaaggaagggtgacttgcccaaagtcacatggccagtagggttagagggaagccaaggcctggctctctaattctcgagacagtgctctttatatttgacatgttgctttcctggtcaaaggactgcagggttcttctgctcagtacagaggacattctggtttgtaaacaattactcaagtttcttgaatgagaaaacacacaggcgattgcaaaaacctagaagataaataaggatattggagactgaggtttggggaagcaaaggaatgaaggaacatagccctttggcccttatcaggggcatagggtagatgaggtggggatggaaggcatgtctcagagcctgacctgctgtctctccctggatagcctggatgacaccggtaatggttcctagatgataatcaagacagaaggggaagcggtatgtgtctacctttttatgagtatcttttacttggatgatttcaggctgggggaggtgaaagaactggctgtgagataaattaggagatcttggctccaggtgaaagcaacttaaagaaatcttaaaatctttcaacacaaatgaaaccttcccacctttgccttgaagagacaaaggtgttcttctttatgcctcctttccttgaaccctcttagagacttgagcacctttctagctgcttttgacattctctgactttaactcagttttacttgaaaatgttcttgtccaggataaatctatatgaaagctcctctaggagagccttattattggtgagggaagggagagaagtaatacttcctgtttactgaatgcttatgatgttccaggcactgttctatggaatttatgtatattttcttgttgaattctcagaataaccttatgatgtcaggatcgtgccaattttacacattaggagcagtggcacagaaagataaagtaatttgactaaggccacaccacgagtcagtggggagcctggactggctctcaggcatgtggccttggatcctgagctgggaactagtgcatacactgcatctcactcttacccttccatcctttggagaaggaggagtggaggtgtggacagatgcttgaaacctagaccatcacaaatatactgttgcaacatatttctcctcaatttctacttgtttccctttctaggaccccatgatgaggagtgggggttgatggagagacatattcaagatatttatattcaaagaagcaatcaagattcagaaagatggggttgataatttttacttcaccctgggaggcagcatagtgcagtgaaaggtgagggctcatgcgtcagatatacctgggttttgaatatcagtcctgtctatgccatggtgccaggcctgtgtctcacctgtaatgtggatatgactcctatctcatgggatgtctatgcagattgaatgatataatatgtaacattgataaaattaccagcttggttgcccctttttctttcccacaaggccagggagatgagccatactggagcattcatggagagctggagtgaggcggagggacattatatctgattttcaactcaagtagaaatccgtctagggtcaaaatgtatgagtcacataggccagaagaagtggttgcagaggcaacaactgcactaggaactttgactataaaatgccttaaagattgaccagtacaagaagagtagaaaagaaaatcagagtgtgaggccaggtgcggtgactcacgcctataatctcagcactttgggaggctgaggcgggctgatcacttgaggtcaggagttcgagaccagcctggccaacatggtgaaaccccgtctctactaaaaaatacaaaaattagctgggcgtagtggtgcgtgcctgtagtcccagctactcaggaggctgaggcaggagaatcactggaacctgggaggcagaggttacagtgagccgagatctcaccactgcactccagcctgggtgacagagtgagactctgtctcaaaaacaaaaacaaaaaaaaaaaagaaaaaagaaaatcagactgtggcatgggtagtctgactctaacaatattagaggctggaaggaaggaaatttactcacacaggtctgctcttgtagggtggggagcacctgctaagttgatagggtgaagccttgggaggtgaaagaagggaatattctgtgtacaagtgaaaaagcaaacctgcttattgggagatgtgtggagtgaggcaactttggctcgggagggaagctgtgcagagggaaggaccctgtgggcctgattttactccccgtaatgataaaggtcttggattcaaatatttataatgtctcttttcatcttaaaatcctttccttcggagatgcaaaaactgaaacttgcagttgaaaacaacctacaaccaaccccttctgtattttaggattgaaattcaaatactaagttaaagtacagaccagctggcttggtggtcgaacctcttattagcataactttgatgtcccagtttgaatgtaaagactgttctttggggaaataacgctgcttaacaaacaagacataatttgcttagcatatttatttatatattgaactaagttatattttaggacttgagtttctggtgataacattttttatttcttccattctatcccttatccacaatgtactactcaagcaaagcaaatcataacatcatccttctttccctagcaagccagcaaaaatggttttactcaacaacagcccagttcagagttctaagttcttatgaatcccaacaacaggcttagaaaaaaaatgtttccttccttccccaagtgtgattcctcttttaggattggtcaaatgtgggagaatttgtctttattgggggtcgtgaacaaaacccatctcccagactctcaaccctgcagacttctccctctttctagggtaagcagtaagggccagtccaatagtgggagtcgatttgcaatgcagtgcaatcataggagtggaattgcatgtttcttatacaaagatttcctagaggtttcagtggtcaggtgacagaagttgatcaactggaagctatgctgtggatatatttgaacaatattaataaactcttcaatcaggtatcaggaataccttaagaaaactttcatctgaattattaaaaccaccatatgcagtgtttggaaatgaacaaatcaagtgtgttaggagtgatatgttacattagcactttgacactttggttttgcttaaaatgaatttatggggtgtttgctactaccggcataggcaagatcaggaggtgatttgggatgcaaagatgacataaaatgtgattactacagtatacatttttaacctttataggaaaggcttcttctgctacattgttttcacattctacttttccttaacaaagattgatatgcttcctgagtgccatgtcctgttctaagtttttataagtatcaacttcattttcataaccctatacagaaggccactattatccctattttagagatggggaaactgaggtttgaagagtaacttccccaagttcacatagctaggaagtagcagtgccaggttttaaagtcaggcactgatctgatgctagacactgtcccttaatgatcagaatctggattttcctataaattactcggtgctagaaaggtctaaccttttgtggttgatttaaaaaaacaaaacaaaacaaaacaaaacaaaaaaactgtgctcagtcaagaaaaaaattattaccttagcaaagcccagcttgttctggaataaaacgcctacaaaattgtcatcaacagtaaattttcctctgtagaaatcactcagatatcctacttgttcataaattgcttgaaatagaaaaattctaaagccagacacccaatggctgaaggctctacaaggctgttttaagaaatagaggctgtttcaagtaagtcagaggtgatggagtccttctaatctgaactcccttctgtttaacttggtgtttttctcatcaccagacagcagtggcaacagcagcagcagttgctgcaaccaaagctttccctcctttgccagatagactttttgacttaaaattccagacagtcatcctgtctgtcagcccagatttcctatgggaagtagacttgaagtgtaaacaccaggaagccaggctgaagggagcaggttattccctttaagaggctgctgtgtcctagtgttccagctatgggctgacagccgcagtcattttccagcagcggggttggactgttctcacccccgcccccatcccactgccttttccacctctgagtccaggaatgccatttccactagacaacacctttctctttaacctcttagggtgtttgaggattataaagcacccaaaactgttggcaggagaaaagcctcttatgcttgtagcctaaaaagcattatctcatgcacaaggtggccagaggcatggccttcgaccttgggagtcagagactgtgattctcctcagacccaccctctagtgactgttctctagcctttagggtgaagctattaattaattaatttattatttttgagatggagtcttgctctgtcgcccaggctggagtgcagtggcgcgatctcagctcactgcaacctctgcctcccaggttcaagcgattctcttgcctcagcttcttgagtagctgggaccaccatgcctggctaatttttgtatttttagtagagacagggtttcgccatgtcggccaagctggtctcaaactcctgacctcaaatgatccgcctgccttggcctcccaaagtgctgggattacaggtgtgagccaccgcacccggcctaaggtatttatttttaaaatgtatatttcactccatgttttaactaacagcttttaaatttaagctgtttgggatattgaaaagcaaatcagcatttctcccacataggactcaaatacaaataggaaaaaaaaatctaaaaatgtatgtccttgagtcaacctggtcaggtattatgtaagcagattttgcagaagaagaggaatttctggaattctgctgatgttcttcatgagtaactggtggctaacatggcaatgtatgtatagaattggacatattaggcttattgatgttgtgtcaaattttaacaaataggtaaattcaaatttataagtataaaaaacctcttaactatatttcaccaaatctgacacacaattaattgtgagacataccactcttttatataccactaagtagagaaaggaaataatgcaaccaaactatgaaaagacattgattaaaatatacattcaggtgtcttagaattagtaaatatggtgatctttcagctgcagtctcaccttttttccatagagtgtgacaacatgattctaatgccactgttcagttctcagttttcctctgcttggcctattggcagcaatcgacactgttgcctcccttttccttgaaacactttcttccctttgcctccaaaataccacattgtcctggttttcctcctccatcttgggctgtttcttctctgtttccatggcgggttcctcctcattttcctgacctctaaacagtggagagctccaggattcagtgcttgcacctcttttcaatgtacacactctctctcccttggtgacccacgactttaaataccatctatctgctggtaattcccaagtgcatattccagcctggaccttttacctgcactcacgatagaaatatgctcctgcctgcttggcagacccagatgtttaacaggcacctcatgcttaagatgtctaacaccaaattacaaaccatacctccacatcaattgcccatcacagaaagtggtcccctgtcttccacttgctcaggatgaaaccttagcatccttgattcctttattacattctcaccccttatttggctcattagtaaatcctgtctgtcagctctaccttcaaaatacatggagaagtccaccacctcccatcacctccatggccaccactttggcccagacccctatcacctccttgctggattactgctgtggcctctaactggttgctccatttttatctgtgctcccttcagtttattcttggcacaacagctggaatgatactgtttaaatgtaaagtcagattgtgtcatttctctccccaaggtctcccgtgactttttattgaatgcatagtagcagcttaaaggccggatgtgatctgcactctcctgactccaattttttctctctctgcgactcctcttggtccctctccctggcccacttgctccagccatgccagccttcctgctcctccttgtccatgccaatacccttcctgccattgcacctgctgctccctttgcccagaaccctctttccacagataatctgcacagctttctccattaggggcttgatgctacctctgtgaggcttctcttagatgtggcagcctcatcacctcctaccctatcctctttacctgctttatttttctccttagctctcctccctatctaacacagtttatgttttattacttccccccaatggaatgtaaccttcacaaagaaagggattttgtttcacttggcatttgttcactgccatatctcctgtacctagaaaagtgtctggcacaaagtagacgctcagtaaatttttgttgaatgaataagttaacagcttcagacatttgagatagcttcaaaaacagactaagataagcaggaaggagggatgtttttgttttgttttttgcccagtggaatgaaataaaagattatccattttcctcacagtatcagtgatatttcttccatttggaaaattgtctactgttttgatagtttatcgttggaaaacatgttgtccatttacttcaagagatctttgcacggtgttttttgttttttttctttctctttcttagtagtccccaaggttcatctgagcttacggttattgtctattaaaccttcaactagatagtgataaattctgcttcagaaataattttttgcagctaaagtaaaatctaaacagatcttctaacttttacacctcagttagggaaggactatttttaacctggggcatacaaagttcctagcactaataaagcagtttcctgtgtagtggatgcactggaagttactgctgttggtatacaaatttttaaccatgctatcgtatactggttactatgaaacacaggtacatgtgggtatgttgcttttaggagcacttactctgttattaggctggagagaccacagcttggacagctgatcccagcagaaggattttgctgcagtgggagaatctgggagaactttcctgcttatgagctctggccactaaagtggacgtagtggatcactctaaatgggaagagggcactggcagagggagaggcccttgtacaagaacagggtccctgggagcccaggtttcacccagtggtgagcataggacaccatagaactgttgtcctttcttctcattattatagaggctagagatctggcagggccacaaggctagggtgtgtgtgggcctggggccactcaggttctcagtggcttaggttacagaagctaatgagatgacgaatggtgaggagggtcagtcaagagggcagggatgacaaaaaaagactctcattcatttatccaaagatatttgtggtattcctctgacaggtgctggggatgctgctagtcaaagcagtgtggtcttgggcttggcctcaaaggcatcttggaggacaagaccattgtatgtggaacatcaattccagtaatgctaaagccaggcttttattccaatttctgactttgacatatgttgctttgtatagttgctgtatgtgctgtggccatctctgtccctgtatctgcagcttgtaaggttatggacacagtgcgtgcctgttaggagcatgtcttttagggaggtttgggggggtgttagaagggaggctgtcttgagttcatgtctcccgtcttccatgtgtacatctcaggagactgctgtgtgttgagaaactggcacagggataactgtggagttgtctgtcctgggaggaggttgtgtattaattgcctccctgggaattttctcattatttgtccctttacactctctttctagaagaataatgagaactgacattacatgtaacaagatgtgttgggggtgattgaatctttttatatgatgagtttgataccatcaaaaagtttataaacctgtctcttagatgcacccattctgcacgaagcctgattgtgcagcatgaaactgagtgctatgttgtatagttccaggcagcctttgcttcctccagctttgtcttcactgtcctttatacctcatccaaggagggctttgatatgggttctcattgatgacattcattccagatatttatctccaaaaggaaaacagccttcacattttctctaattataaaggtcaatttgggtttttattaaaagagaaggaacccatttttgcatcctgaagctgatattcagcttttaaaaaatgagcttcaaattaggattgtcccccagataatatgtaattcaaggttttatgatgcactggaaattgccatttcttccataataacccagtttatcagctcatacctcagttcttgagctctcctgctggggatcaagtcagtaccagctcacttggaagaacccattgagtactgctgtgatgccctgcatgtggcagaggcggtagcagcagcatttttccttccacataaaccctcctgtggatgacttcagccatctcctaacatgtacgtgtgaggttccaagaaacacaggaagccgggagtctggtgcttggcttcattgttcagcaccaataatcccagtgctaaaacctgtgtttgtacagaactcttcccatcttttaggttcattggcccaatgacacttgtccaagcagaaatggaggggcaggggaagcagagccgaattgtactgatatgccaccctaggagtctttaatacttgatcgcataaatctccttaaccactctaccagataagagggggtgtttctattttacttaagtgaaaagtgaaatctgagaggttgccacttgctcagggtcatgcaactaacaagtcacaaatctggagtttgaaaccatatcttgtgactactaccaatgatcttcccactacctgatccttcccatcctcatgcttttctccaggggccagggccaccttctcagatagttcctaactagtacagcctcggatgtatagggcttgactcctttgatgacctcctcagaaacttcatccattctccagagctccaggatctggcaccacgggaaaaggcaatgttggcagggcacagtggctcacacccgtaatcccagcattttgggaagcctaggaaggtggatcacttgaggccaggagttcaagaccagtctggccaacatgatgaaaccccttctctactaaaaatacaaaaattagctgggcctggtggtgcacacatgtagttctagctactcgggagcctgaggccggagaatctcttgaacccaggaggtggaggttgcagtgagccaagattgcaccactgcactccagtccagcctgggtgactgagtgagactccgtctcaaaaaaaaaaaaaggcaatgtgatgttctgtgcccctgtctatcagcccttcagtgggttgagggttgtgttacttttcaatgtaaggaaaaagacacttggcatcacatccagttaaacaatttagatcaattcaacacatagctactgtcaccaatcttgacaaaaaccctgggaactccgatggggcagatgactgggcatcctgccaagcagagaggtggtctccatgtcacttactgtcatttcacattgaggttaataattggggtgggaactttcattgtcttctgagtgtggtttcttttcttttaatgaaatgcttttctaaatctttatgctatttgacagtcctacccaaggtctctttaaattgctgtaattgcaggggctggtgaactacagcccgtgggccatatccagcctactttttttgtaagtcgagttttattagaacacagccacattcatttgtggtgttggtggctgctttcatgctccaacagagctgaggagtcatgacagagactgtatggttttcaaagcctcaaatatttactgctgtccttacaggaaaagtttgctgacttctttcattctctctctttttctctttcttttagggtatcatagatttaaagaaaggaaataaaggatgcagtggctcactcctatagtcccagcactttgggaagctgaggtgggcagatcacttgaggtcaggagtttgagatcagcctggccaacatggcaaaaccccgtctctactaaaaatacaaaaattagccgggcatggtgaacacctgtagtcccaggtactagggaggctgagttgggagaatctcttgaacctaggaggcagaggctgcagtgagctgagatcacaagaaaagaaataaagtccctggggaaactgttccagtgtctattaggtggtgcaaaagttactgtggtctttgccattttggtgaccaaaaaaaaaaaaaaaaccacaattacttttatttttttcttttttttgagacagttttactctgttgcttaggctggggtgcggtggtacaatcctggctcactgcaacctctgtctctcaggttcaagtgattctcctgcctcagcctcctgagtagctgggattacaggtgtgcaccaccacgcctcgctaattttttgtatttttagtagagacagggtttcgctatgttggccaggctggttatgaactcctgggtcaagggatccactcacctcagcctcccaaagaattacaggcataagccacccgtccagcccatgattacttttgcaccaacatatgcttggtcagtaataacagaccaggaggcagcacacacactgtggccagccttgagtgcgttcatcctaggctggatggccatgcctgaggagaataattccagcaaataataatgttcctccactgcatcacattccctattaaccacaattgaggcatcactaactgggtgggtgaccttgcactagtcaccaaccccaacatgcgatttccttgccaacaaaattgaacacttaaccatgtgtatttatgaagtatttataaacacatcttatatatgtgtatgttatatagatagtttaaaaaggaatagtaaaataaatctcaaataaaagtaataacatgaaaagaaaacccatttctccactgtccagcctaggaaacagaactttatgaatacctttgaaatcccttctgtgctccttccccctccccaaagaggtaactatctcaatttggcaaatcgtcctcctgcttttctctgtagttgattgttttcttttgactaacactttttcctacacaaggaaggcattcaaagccccagtctggtctcctcactggggttttgtgataatgtgctagactaaaaggttggtatcccctgagggagtcattgatttatctttgatttatcaactccacggtgggagaggacagcagtgaagaacattggcgaccccagccagttcatggagttgactccatgttttcatagtagagaatctagctgagagagagaacaagatgaaacctgatttgtaggccttaaatttagcttccagtccattttagtttagggaaatttcattgtatctattctttgtgggtttttttttctttttttctttattttgtggcttaaaaaaaggataaatacagtactgggttttggaaggaggggttgttaaacttaaaccttttaaactctgtaattacttcgtaaaggccgtgtatttgcatctgaaatgcattgagccttaagtttagtcctctgtgtatggagctttcataatgatgggaacacttccaaaaataaagtaactctatagaaaatgttaatcagcttatccgcagtgaccctagtgagtttctccattgtacacatgaggaaatggacatgacagttagaggtttgcccaaagccactgtcatcggcattatgaagatttaagcaatggtcctacttaccagaaaacatggtcatgttttcatgtaagacactgtggaccttagtcaaattgatctaaattaagattcagggactaacaagacttttggtgtttggaagagtctaccacatcaatcacaaagagctggcttattccttaaagttacctgcagggtttaaaatcagttatgggttttctgaggagtctatttgcttgaaatcaaaagctctgtatctgactaaacattgctcggaaaactgaaaaggacttggttcaagtaacttcacactgccagggaaaactgtgtgagaagtacagtaatgactcaatttgtggcatcctttttaaattttttgtggcattctactttttttgagatagagtctccctctctcacccaggctggagtgcagttgtgtaatcttggctcactgcaacctcccctctggggctcaagcaatcctcccacctcagtctcccaagtagctgggaatataggcctatgccaccacacccagctaatttttgtattttttgtagaaatgggttttcaccatgttgcccaggctggtctcaaactcctggactcaagcgatccacctgcctcaacctcccaaagtgctgcattacaggtgtgagccaccctgcccatccattctacttttatagttgacaggaaaacagccttctactaggaactgatttttgaaaaccattttcagtggattggtgcagaatgtgtatacagtcttccacatcatctgcctcaataggattgcctggcaaagtaagaatgcgtgttgaggagccacagcgtccttcgtttttacagaaacttttataattattattgtttttattagcaataattgatagctcattttataaatattttcctgaacaactgatgggtgcaaaaaatatttttattttttttctaggaaacctttgattgagaaatcagaacagtaaacccctctttattcttctcttttcctttctctcctaagcctcacttgggaatgtgaccctatttttttttattgagtagtaaatattttttaagatattgttaactataacagctatgttatcagggcaggtgagcgtgacctcattcaaagacatgatattggccaggcatggtggctcacgcctgtaatcccagcactttgggaggccaaggcaggcagatcacctgaggtcaggagtttgagaccagcctggccaacactgatgaaacctcatctctactaaaaatacaaaaattagctgggtgtggtggtgggtgtctgtaatcccagctacttgggagggtgaggcaggagaatcccttgaactcgagaggttaaggttgcagtgagccgagatggcaccattgcactccagcctagctgacaagagcaaaacttcatctcaaaaaaacaaaaaaaaaaaccaaagacatgacattgattcagaggactcactcacccgttgtagtaaaataccagggcccttactataagggtgatatatgcatcccacatgtaaatcctggcaaagccaatgtgtaattgcagagagaagacgccataaacagagagacaccaaagtgagctactcagggagagcctcccctcacgaacggttggtgccaggtgcttatcctgagtttttggatcttgagatttgatttttgcatttcaccaatttcatcatcaccatttcatctgttcatcagatctggggaccacagatgcacactcactgggttttcaagtgactgctgagccaggatgataatatattgaatcattggggacagctgtctgtcagactaaccagccatagtcattataagccaaggcatttccttcatcttggaaggtaccatcgatactgtcacatttcatagtggttacacatacaggatttgaattacaaaactggtgagttgggttcaataaccaactcacctacctttgtgatactgggccagtagcctaacttttctaagtgtattttttttcttacctgtgtaattggaatattaatgccttataaagatgttcagtgagctaatgccttaacataatacctggaagataatagctattgttattatacagtcattttggctgctgtcttcattataactatgcaagccaagttggaagactgaataatgaattagaaaattgcttgttgaacatgaatttgagcacaacttaggtgttcttcaggaatgcttctattggcctggaacagctgggcacactgttagttgatataaaggacaccattcccagaatttgaaaaccttttacctagacagttctgggtaaagtccattacagttttaatttgcagcttccctttttctaaatgtcatgaagtcaccatgtttttagatgggagcctctaacttacttggttactattgtatttagtacagtagtcctcccttatccacagtttagctttccaaggtttcagttgcctgtggtccactgtggtccgaaaatactaaatgggaaattccagaaataaacaattcataagttttagattatgcactattctgagtaatgcgatcaaatctcacattcccgtaccatcctgctctgtcctgctggggaagggaatcatccctttgtccaccatatccatgctggagacctcacctgcctgtgagtcacttagtagccgtctaggttatcagattgactgtctcagtactggtaccacagtgcctgtgttcaagtcacccttattttacttaatattggcccaaagctcgagaggagtgatgctgataatttggatatgccagcggccataaagtgcttcctttaagtgaaaacatgaaagttccccacttaataagaaaagtcaattgtatgctgaggttgctaagatctacaagaagaaggaatcttctatccatacattgtgaagaaggaaaaagaaattcatgcgtagtatgtatagggctctgtaccatccatggcttcaaggcatccactggggatcttggaacttatccacccctctccttcaacaagggtgtattactatagtaacagaggaatcaccgtgaataccttatttgggtttggctttcgaaacatctttttgggtctgatttattataattccatgatcattccttcttctggttccacactcaggaagtgaaatttgtatgagggtaccagctagtccacaagatgagctgcttgtgccaagtgcttaagggaggcaatgcattcctttgacatacagcgataggaaagcgtgcctcttctagttcattcattaaagcagagctgccttatgtaagaagcttcccttacaagccctcatttgttttttattttttctctggtgtaggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccaggtaatggagcccttgttgtgtgtcattaccaccgacctattgcccctatgcttcaaattttatcagttgtatgggaacaaagaaaaataacatattcggtggataggcacacacacacacacacgcatacgcctgcacacacacacacacaccctaccttctaggacgggggttctcagtggccgtctattagaatcatctagaaaactttaaaaaaaaatactgatgctcagaccctacctgcagaccagtcacatcagaatctccagggggcagagcgtgaatcggtatttgtaaaagctctctttgttactccatttacaatccattttgcatgacacactttgaacaaaaccaagaaaaaatactttttactacaccgcctctcctccagagggtgtttttgtgatgtggcttatgaaggcagcattcttgcctcctgaggatgcaggtggtgctagcggcagttgatgacagaactgattctcctccttgggttgttccgtggagcacatcagatgggaactgaggggacccaggagtgtgatttctttatagctaataagccctggctttggagccagacagcgctggatttgaatcctggctctggtacatattagcttaggtgatgaagggtaagttacttcaactttccttgcctctgttattcacattttcaagtctgctatataagattaagatgagaaataaagcatataaaatgcctgactcattgaaagtgttctacaagtggtagttacgaccatgatgtaactcattttacttagcctttctttaattgtatgtacttccctgaaaggccatgaataaagttcagatttggatattgaatcatattttccacagacttcaattcaggtttcagaacatattcccaaagtaaagaaaatgctgccactaagactagataaaacccacttaagatttaaagggccggtctgtgttattattccagtggtccaaatttgttacctaaaagagctaggtagagattttttatgacatcaattcagtttactatcattctatatcacattttgtgtatcaaagtatttcattttgcatactttatacttacgtttaagtatactttatgtacttaagaagtccaaatgcttttatctttttatactgatagcgcagtaattcttgacaattgatgtaatcatttatcaggtgaatcttttatccaagtaactggataataacaatttataggtgctaattgactttgaaggtggtcttttaaagctctggcatatttttaacttctttgaagtgtggaatttcagaaaaaaatacttattaatagacccaagtgataaacattcagaggcatacaccagtgtcttatgactttctaagaaataatttaggtgtgaaatattattcacaagtaaaactaggctttaagtagctggatttgggggaaagtgagggagatgttaaccctccaattaagtaaaatggcggcagtttgaatacagggagtttagaggcaaagcattgccacgcattcttagagactggctttaaggagagagctggaagacaagcctaaggctcaaagaaggatttagatacgtgagaataagtcgcctaatgtccttgatgatgcctaaaagaaagataacatatgactgatgcaaggttaggatttggttaacccaaacctgtggtgggcccatggaaaaataagaaggtgagagtgcatgtcaaaaagagtgattcataataaaatcattaggtcaacgaatgagagaacaaagcagcttcttcctaagtgccaaactcttgtacaccttaattatttccttccccttatctcttctataataccaaaagattctaatagtagctattttttgttgtttattttttgagaacagtaatgtcaaagcactctacaactttctcgttggttctgctatagcctttgagttatgatggaggctgagaaggcaatattaaatttttgatttcacatttcaacaatatacatcaatgtctagcagcgttttggatccagctctaactctaattttaatagccaatgaacatggatttttggctgccagttcttattacaggttgagtatcctttatctgatatgcttgggactggaagtgttttagattttggattttttcagactttggaatatttgcatatacataataagatagtttggggataggtcccaaatctaaacatgaaattcatttatgtttcacatataccttacatacatagcctgaaggtaattttatacaaaattagaaaaagtgtatgcatgaagcaaagtttgtgttaagtactcatgtgtggaattttccacttgtggcattatgttggtgctcaaaaagttttggattttgaatttttggattagggatgctcaagtggtaattgcacagtatgttactctctgtccattgtttatttctgaaatttgtcccatctaacaagtgaatcagaaggcagggggcttaattgagactccttattctcatcctgtgatgggcttgtactccctgtgtatggtggtactgctggggatttggggctttgccccaggagttattggactcttaatgggtaaaaatgactattttttttcaatggtcaatgttttttctcttcataagcctgaaagtgcctatgttatgttccactaaaaggattagccctggtgtggctttttgttgcctctgtcaagaacagccggttcattattaaccatggtggcctattagccatttttaaattaaacccattcagagtctgactctttctttatctgaggtatgagctgtatttttcagcactctcttctttcaagttcaatatctaaactgaacccagccttccagaatcatagctattcttcccttctgggacatgagcatttggaataagcagcaaaacagtgggataatagttgtaagttattgcaattttaccaaagctattaaaaaacaaaacactgccctaatacagcattccagtttgtatgttatctcttttcccatccttttactttgatttttttctctgtctttatttaaaaaatgtctcttataagaagcatatatttcagatttttttcttaaatctagtctgatagcttttgataattagagaatttcagtgtgtttacatttttatgtaattatataattgctttttaaatgtaatttttaaaatgtaattactcaaatatttgggtttaaatctaccacatctttgttttcaatttgtcctctcgtctttttttatttttttctctctccatcttttcttgctttctcttggaataatcaagtatttttttcttattccatttttcctcatctgttagcttgttaatttcacattttttacttcacttttaagggatacccaagggattacaacacacatgcttaattatgagatataggcaataaatgtgtactttttaccattttacagatactacaaccttagaagactttaatcctatttatcctcctcttatacttcgcttttgttttcatgaattttaatgttacacttttaatactgctaaaaggcagagttattacagttttacacagtcaggagtcacacagatttatctgcatattgatcttttccattcttaacattcttaataccttcctcctggagcttcaacttctacctgagaaaatttttcttttgcctaaagaatacttctatgtgtaggtttccagcagtaaactctgtttttcttggtctgaaaagtgcctatttataaataaataaattgcattatttcaccttagtttttgaaggatagctggaaataaaattctagcttgccagttattttcctttagtcctttaatgcctggatttaagtttcccctgctaaccagcaaacgagaggatgtgattttatttttaaatctatatgacataacacattttgtgcacagtattataacaggcactttgggcaatgcaaagatgagtaagacaaagtcaatgccatcaaggaagcttacagttggatggaaggaagaagtttacacatacttatataatctgaaggagtaaatccaagaggttgggaggaggaatgtgctggatcgccatctaaccagccagtaaggctccgattagaacatcagtatggagacgtgtgccgggttaaatccctgtcctggcaacatagtcattttagggaccctgagtaaattacttggcctctctgcctcagtttcttcatgagacaataggaacaacatgcgtgcctgtcctatgggttactctgagaatgaggtgagtgtgacccactgtaagcatttgtcagatgttgactattaatagttgcaattatttccaggctctggaggcaagagagatggaagaatgttcctaactagctaaaactcatacacataatgggtcttttagatgctgaatactgagggtcacttagtgttgggtggggatgttcacccaattccaggactgctgaaagcaggtggccgagcaggaagtgctatctgggttcagtgccccagagctggaaatcccagctaactgtagctatgtgttgcttactgcctgagcacatgttcctaggctggctggaatgttttctctagcaagggagataatggtctgcttcctcaatagctgtcagagaaacaaaattgagcaagtgaatttctggttttccttatgatttggttttctatgtttttttttcactccccccttttattttagagcctttgtatgtgcagagagacttaaccagtgcactctttccctgcgccttggctagggtgggaggaaaggagtctgtttcttctccttaggaaaccctgggcaaacaatttctctaactctgagatttttccatttaaaatgggaattacagaacctgcccttcacactctgagtggttatcaaaattaattttgataatcaaattactgggggccatactagagtgagatattaaagtgatgctttgcagctaggttcagaagtattatatctgtggttagagtttcagcatcccttcattgcttcatgagagaaaggggtggaaaaagaaattttatagatacttaaaaaatgatggtattaaaaacaaccacaacaatttaaaataatataaattgttactttagctgtctgctttgatcagagattcacaaatgtaaaggactgatgttaaccaggaagcggagtggagaatcaatgctctacttcttatctctccttccataagattaagcagattaaaactacactataatttcacaaccagtggacccaccgccaatgttttgtggtggttgttgttgatttctatataatagaattaattattctttgttaggatattttagtcctttccagaaccacataggggacctatgtctcaggaacagagcatttgtgcacttaggcactctctctctctctactatagtagactctgtgttggatcctggatggctttgctctgtgtaatcaactcagagaatcccaacagctagagaagtactgggccttctattttggtgagagcagcactcctgcctctgctgcagagggaactacagttactgattttttgcttaccagctgcaggatgcagctgtccttatctacgggtctgactgagaccagctattttcagaaatttaatacagtgaggacgagttgaagcaaataccagctgtacattaactgttgactttttggctattcaaattagtctttgtcattaattttccaatttgtcatctcttagaaattagggatcttgtcctaagacctgaggacctaaggtaacagctaaacttgcatgtatctagcagctgccctctgctgtgttactgcagcatggagggttatttaaggtcaagttacttaattcatggggtgtgactgcaggctctggggaacttctggggtggtgaggagaagaggacattataaagggattgctgacacacatagaaccaggaacatttagtgatgcttgtgtttaaagttgtcattgcgcacaaaggagcaatgtttataaataggctttagatttttaatgacatttcaggctgttctatttattatcatagtccaaagtttcattcagttagttgacaaccttttgtcaaacaccagctgtgagcctggtactggataaagaagaaaagtggtcaatgcctttcaataactcacttgtggtgatggagacacgtgtgcaaataattataattcagtgggataagcaaatgttataatagaagtgtgcatgaggaattataagcatcagggtgaagaagtactcaacctgccaaaaaaatacatagaaagctagagcagatatatatttgtccatttgaaagtcacttaaaaaaatcagactagttttttttcaagactatattttggtcttctttcctgaaactttcacatttggtttctgcctaggaagccccacctgctttttcatattaagggcttctcaaatctttgactctgcaaagaacgtctgttttacttacatccttgttttgctcagtagcaagctttttagaaacccttaactgttctgtaatatttaaggtatagaaataaggttttaatatcccagttcatgtcacgtgctagatattgaactttgaatctccaggaactactagaaggaactgacaaattcaagaatttgactttgtctctctgaattgggtttgaattttgcttttgccactcactatgtgaccttgggcaagtcctatacagtctccaagctttgtaagtgctttgtaaagatcttgctgagaaatagaggtgagtgtaaatgcccagtcctgcacttgacatagagcagggggctcagtaaatcttagcaactattttctgtgttggaatttgaattctacattgtcctttttttgacttgacagcaaatgcattatgttttcagtaaatgcacattaagttgaaatcagcatttgctaaatatctgttgtgtcccaaacactgtctgggtgctctatagctggtttatttagcaagcttcatggtcctgagaagtataggtgggtatattctcattaagatagtgatatggtttgggtctgtgtccctgcccaaacctcatgttgaattgtaattcccaatgttggaggtggggcctggtgggaggtgactggatcatgtgggcagatttcctgctttggcactgttcttgcaatagagttctcacgagatctgattgtgtgaaagcatgtggcacctccccctatcaccactgctctgaccatgtaagacatgcctgcttcccctttgccttctgccatgattataagtttcctgaagcctccccagtcatgcttcctatacagcttgcagaaccgtgagcatatgaaacctcatttctttataaattatccaacttcaggtatttctttatagcagtatgaaaactgactaatacagatatattactatatttcattgaatcccatgtcaattgtaagatataccattgtcattatgtattactgagaaagaaaatactgttaattataattgtaagagacacctctatttcagagatgttaaaatgtgaaaaaaatatgcatcatagaattttaataaatatagtagttgagcttgctgtatgcagatcgtaaggagaaaagtctaggaaacagattcttggggtctttatattaatatacactccctgcccaacacacacacacacacacacaaacacacacacacacacacacacacacacacttcttcttagtattgcctttaaggttgagataattcaacacagacaatttatttaatagattatcagagcacccattatgtattgagccctgtaccaggcactgagatactaaatgaaacaaaacaaaacacaaagcagaatcatcccttaggatgctgacagttttataggagggatagatatgtgagccagacttgagaatatattctgtgaagctgctatacagagggatggaagtgggctttaatttttttctgagacagagtgtctcaccattcagaaaaggctgggtctgttagtggatgacatttcccacccctttaatctacacccttcctggctttctcaaaaagtgcattgggaggaaatcagaatcaatactgtgaaaagaagcttattttctccatcaattaccagtgcaggagagcacattttcactttttctttttaaaggcaaaacaccgatttggataaagttgaatagcttccagctttggcctagcttctccactctgtgtttgtgaaagtgtcccttattctgttataacccaagtgtcaataacaggtacacttgctgatgaggaattgcatcatggtcagcagtaggttttattttatatcagttaatttcgaggttttcatcacttatttttcaccatttccttgggagagactaatgtcattcctggttttttaataaacaattgccacagaggaaactttgatcgatctacagttggactttcacaggacaggctgaaattaaatgcccaacaactaaaatgacttatcaccaaaaaagtactagaaaaaaaacttgggggaaatgttttgtttttataatcacaacagtagagaataacataaagcacagaagccgtacaagaacaatgcaactacttaacaataaatacacaagccagaaaacaccgtatacaaatcaaaagacaaaataatcacaggttgaaattgtttgaaacatagggttcagtttcttgaaaaataaggagtttttacaaattaagaaaaaaaatgtgcagtcttgtgaacaagacagttcacagagaaggaaatactgaagccttttttttttttttttttttgagacggagtcttgctgtgtcgcccaggctggcgtgcagtggcgccatctcgggtcactgcaagctccccctcccgggttcacgccattctcctgcctctgcctcccgagtagctgggaatacaggtccccgccaccacgcctggctaattttttttgtattttttagtagagatggggtttcaccgtgttagccaggatggtctctatctcctgaccttgtgatccgcccgcctcggcctcccgaagtgctgggattacaggtgtgagccaccgcgcccagcctgaagactttttaaacatgcagatttttaacctctcaggctggcatggagacctataattccacatctaggaagatatcttacacatgttcacatgcattcagaatgatgcaagtacacatatattcattgtagtgtcatgtgtaatagcaaaagagtgaggagatctacaaatgcccttcactagaggactggttatctaagttattgaacatctgtacaatggaacagcatgcacttgtcagaagaagtgagtcagctcttcatgtgctaacctcaagaagggttaaacgaaaaaaggccaggtgaagaatagtatgtaggatggggcacagtggctcacacctataatctcagcactttgggaggccaaggtgggcagatcacttgaagttaggagtttgagaacagcctggccaacatggtgaaaccccatctctactaaaactacaaaaatcatctgggcctggtggtgcatgcctgtaatcccagctagtcaggaggctaaggcacgaaaatcaattgaatacaggatatggaggctgcagtgagccgagattgcaccactgcactccagcctgggagacacgaaaaaaacaaaaccaaaaaaacaacagtatgtacattgtgccaccatattgcaaaaatatatacatatatatacacacacacacagtatatacatagatgttaaaaattgttttaaaaaataaggggggtggagaacatatatacttatttattggtataagtatagactgtctctatctctggaagagtatattgtgacttggtaacagtagttaccaccacggagggaaactgagttgccgagacttggaagtcagaggttaaggtcaaaggttaacttagacttgtagaccatatgcattgtaattctaatggcatgaatctaattaatggacttattatgcaatgctaatttaatcagatttgatgagttcaaaaagcccgagtcataaagatgaacttaagccttcttacttcaaggtcttgagtttcctacgaaattactttccatcctccacagtgtcttatggcaagctttaaaaaggtttgcgaaactttttctcatggatagaattatcgaaaggcttttttgtgggaaagattttccaatagaagtttagggaaacctaaggaatttccaatggagcatgatctcctcatgttccgatggtgctgagctcttaaaagtcttggcaatattttcaaacgtgagtgggctccagctctgaaccaagagaacccacttattcactgtcctcacttcctctttttgagaaagctaatcagtgagtcagctcagggctgcaacaccactaccgttgatgtcagcagcctggacagcctgcagacacccgtgccggtagcggggcggggctgcccccccttttccctccctccggagccagctggttcttaccagctttggcagctttgtgcagcactatttgttgtggcttttctcctgtacatacaggaaaggcacagctctcttgcttagggcaaggattggctattgacactttgacttaaatgggggtggatttatagactttggggctcaattttgaaattaactcttagaaatgatgagaattctaagacgaggtatatacagaaaattatagccaactaccttgatttgagtttggggtatttaagcgagaaacccaccgtgaccagctaacctagtctaacttcataggccttaagtaaggttgcagttgaaacaaaaccttttcattattctgtgcttgaacagatctggggtgagtgggagtgttttttaaaataattccccagtggttttggcatttttttggccaggttaatcctgagattcccctgatggtgggtgagtttgttctgcaggctctgcattggctcccagcttaaggttcactcacctatgccatctctgtggtctggcttgggggttcccaaggaagctgagcagaacatcttggtgttgtgctcctgttctttcttccatcccatgacatccagtgatcccagggagctctagacagcagatggccctcgctgtccacttggcaattgacaatttagatttaagtgttggtgctgttccctacttatgcaatggaagcacctccttgcttcatgtactaaagtctgggctgtgcaggagaagaagaaagaaggaaagaaaacaagaggttttaactcaacaattagaagcccaggaaaagtttggggaatttttctcttaaagttacttgactcttggcccttctctttaattttttaaaataatgttttaagagaagacttacgaagcaaagaaaatttggaagcacattacaacaaataataaatctaccatctagattcaattgttattcacattttggcatatttgctttatctatgtatgtatacgtttccagtccatattcccatttcgaagactttctctaaatttcttataactgataatccttctttcaagcatttagaaatcagcatttttccatttgcctcttaagatttttgtttgcaaaaaaaaaattgggtacatttgggttctgcttgccaagaccccttactctggattgaattgaacaagaattcacactcagaagaataattttaaaatcattgtctctcatcatctgaaactttttttttagggtgatgtatttgtttttattttttaagggagaaatcattatatacaagtattttacagtgtccgaacttaggaattgaatagattcagataaattgttttgtgatgaggctggtaacctcattatatgaacccttatttatatctgaaatcctggaaccacatagatttgaataagaaagcatttcttattatctgaattcctcttctctaaagaccacatagattcagatatcaagaaatacttttctggcaaagaaaatatgcctttttttcctcccagagcccatcttatatgcctgtataggcctatagaaggtcttgaaatctaatttgattttgattatgtgggcagctgggagagcaggggaaacaggcttgagataatatcataattcttaaatagttgtaattttatatttattcgcgactagaattcctttgagataaacctttagtagaaattgaatttgtttgtttgtttttttaaccagccacttgtctgttgggatctgaaatattttcaatagaaaacaaagttattggctacagttgaggtatctggtattcacagaatctctcatatttatcttagcgcagtcatccagctggagtgtaagtctgccattgagtcccaggtacttgcagatctcaacctctacccacttcactctagcggaggggctcgggcaatgccctgtggtcatgtgatcgcttgtaatcagtttacagggtttgtcaattttctctaaatgctgtggggtccagacagggaagtgacatggcagcaaagagggtaactttgaaactagacagacctggtcttgaatcctggttctatggcttggggcaagttattacctcttagagcctcagtttcctcatctgtaaaatggggctgatacaacttccttagcagcaaacgaatcacagatattttctgctgaatcacctagcacagtattggcaatggcttatttcttcaggtctctttttgttacctcatatggaaaagcagtaagtttcagttagatttagcaaatgggcttttaaaaaccattattaaagtgagagattttcacaaatgtaacatagaactcttccttctttctaagtgttgaatgaggtctggagggaaaattaaatcaaaacagcgactttactgtaaggagctttctgctggggactatcaggcatatctagttatattagggaaaaggggcctggtggtattgaactgggtagtgtcaggagccaaggggttaaatggaaccattttagcaggctggcaaagagcatccaggctgggcaattaatgcttcatttcagggggtcgctgatgcatcaaagtcattaattagttttatgaaaacagattgtgcaaccacagggagattgtaattgggtagtaattgaaaataactttgtggtaaactttcgttgagcaggtagttcaggtgggggtaacttggaaggggaaagagaattggagtgggggattagggcatgaggagaatgaaatagcaacagtaagacaagcaataaataagacataatttgaatgaaaggaacacagaagtgacctggtctaacctatttaggttagaagtgagaccacaggtctgatgagggaagtggttttcctagtgccacacagctagttagtgttatgtcttctctcttttcttgcaatgctttttccaggattttcatgactttgatttttaggagctgactatggggaacatgaagtacatgccacacagatggcagttgaggctggagttctcgcctattcctgctctcagagtctacccaagaatgctgccagatcttgctgcctcgaaatcttatttcatttatctaccacccttgtcatgaataaaatttggaaggattttcctttaccatccatggctctgccatccccggggctaggggaatactgcaacctccaccagtgtgtcatctcaggaaaggtcagtcaacagggaagtgatttttcagtttgatattagaagtggagaattatttttgggcttcagtttcctttttttttttttttttttttttttgagatggagtcttgctctgttgcccaggctggagtgcaggggcgtgatctcgcctcactgcaacctccgcctccccagttcaagcaatcctcctgcctcagcctcctgagcagctgggattacaggcatgtgccaccatgcccggctaatttttgtagttttagtagagacagggtttcgctatgttgaccaggctggtcttgaactcctgacctacagtgatctgcccatttggcctcccaaagtgttgggattacaggtgtaagccactgcgcccagcctcagtttcccattttgatttggttaagcatccagagtgggtacttcagttttttagaagtctgcttggtgcaggaatgtagggttggcaaggacacagctggaaatggggaaaggcaatgatgacagtcatggttcattgtggtacaatccagatacaagttaaatcattattctcataaacactgctaccaaactcagtagcccagagatgttcagattcccaaagcagtagtctgtttacctaatccatttggatggttccttgtactcagtggtagaggtgctcggaaaggaaaattgtcagcagcagagctttaggtgtgactcagccttgagtgagttgaaccatttatctttcttcccttatcagtttggactaataagtatctggaaggactaagtgtgtttgcatggaaactaatcagaaggacatttggaacttgtttggctgaaagaaatgccatgctcttgaagttcacaaaatagaattgttctcttttgggctgctttgggagccccctaccattttggtctatttactgtccccacctcatttctcacatgagtcttccaagttaggattatgtcatggcagtaggcaaaaagaactgtagttttcaagtttctccaaaggagcttcaaataagtgacagatacattgcctttacaggccacgttttcttaatatctgccttattgaaataagctggggcatgtatgaatgccgtgtccacaaacatttcacaaaagtatagagaggagctcagccacattgataatcttcctgttaccctgtttcttggctacctatataaataagagctgctacagccacaacattttcaaggtagcagaaggaaaatatacttatcggtagtgactgcttttaaaaacaacatttattgattttctagctgtcaaagttaatatatctttttttctttctttttttttgagacagagtctcactccgtcgtccaggctggagggcagtggcacgatcttggctcactgcaacctccacctccctggttcaagcgattctcctgcctcagactcccaagtagttgggattacaggcgcctgccaccacgcctggctcatttttgtatttttagtggagacagggtttcaccatgttgcccaggcttgtcttgaactcctgacctcaagtgacccacccaccttggcctcccaaagtgctagtattataggtcaactggttatggtcaactgaaatgggaggatgtatgtataaaatattaaatggaacaaaaaaaaataggtgtgagtcaccgtgcccagcctaatatatctttacagagaatttggaaaactcaaagaaccttaggaaataaattattttattttataagtatcttggtaagtttatgctcaaagtttttataagaggatcctcttctctggaaatatggctttcttgtttagagtatttgttttctctttagtatctaaatcttattgtaggtgttcttcattggctataaactcagaatactgaaccataaactttcagaattaataaaacaaggaattaatttatttcacatattccgatgactcactgttctgattagaaagcagaagtaacacaatgcctagtacggtagcagtactgcaaaccggctttgatggatattgtatatattatggtaaagcacggaaagaaatttctatgagcatttttttttcttttgggaaaaagtgaaaacaactttagatgaagtcaaaatgcaaccagctacggttgcacaaagtgagagatacttatagttagtaactgagtagattttctggaaagatgatttttaaatggtctctggctttagtgatgcttgttagctctgctgtgatgctaatagcatttgtaggggcattttcatattcacctgactcattgttaattacaggagagcatcagttcagcattctgtctttccaattatgtcggaaatcatgtgcttaagttttactaataggaccttttggtgaaatcggggggggaaattaaacatttcaagttttcaaatgaatttaggaaacaggtgagtggactttttgctcattggcatgtgatttgtgggtggaaatttccttttaagcaagaacagtgtactatattgactgaccatgtcttccaaggtattgtccctgagaaccaggatgtagacaagtgttcttagtctaactgagtgaattaaaaaagtgtgttggcgtgaatggccatgtgcattttcaaggaggaggggcatgcgccagggcctatggaattaacattttacaagcatatacgtaacatttgtctgtaggtcagaaagggactgctaggtgtgcatgtttcccaagtctgaaacttgccctggaagcagcagcagggtgtgggtggtggttcagaggaaaaacgctgttggaacattagacatgtgcagtaatcagttatcttcacaatctgcaatcagttgcaagaatttctcaggccttaaaatttgtaaaagaagcagttgtgtttgctttgtgccttatataactatcccacgtaatactttgaaatatcaatgtcttcgttgaaaagcttgaaaacattttacttgaagtgtgtgagtgaagggatgaggattctaaggagtggtgattaacagcttggggagagtgcccatcattccctgaaccctgctctgtgtgatctggccagctggctcccaggtttttttatccatgccggaagagccaataaaaagataaagtcaattactaggagaggccacaagtgcctgccagagttctgatgtattttctcaaatgaaagggccaaatagagatgtcaagcaggcctgagttgagcactggctttctgccagtagctgtgtgccctctttgggccgcagtcactttactggtaaaatgaagtcacatcacctatcacttccccttctctccactgcacacccccagtacaagccatagtcatactgtatgtagccactgtaggagcgtcctaactgctctccctactttgaatcttgcctccctaaaatccattctctacccaccagccagagtggtggtgaagctcaccatctttatctgaaaccatcttgtgtgtttgttattgtctctctgacctccccactccagaatgcaatcttcacagtctctgttctatccttttggtcattactctcctcctagccactgacacctctcattttctcctgttctcattcttaattttagcagtttttttcctgagctagtttgaaatgggagtcagaaaacctggggtctagttttagttctgtgacttccttgttggcccttagttaagaaagtcacttcacttctccaggccccagtttccttccctgtgaagctgagtgtaagagtcagcaagcactgcagtaacaaaggaccgcagactgcatggcttaaacaacagaaattggtcttctcacaattctggagcctcagaaggccaagaccaaggtgtcttctgaggtctctctcttggcttgcagatggctgccttatcaccatgtcttcactgtgtcttccctctgtgtgcgtctgtgtcctcatcgcttctttttattaaagacaccagttatatcggagtgtagccaaccctaaagacctcattttactgtaattacctctttaaaggccctctctcacagtagtcgcattctgaagtactgggggtcagggcttcaacatggaggtggcataattcattcagctcataatactaaattatatctaagactcctttcagctctacaaaattatattttaaatcggggatctttctccttacacccatgttcccttctactcccctgagataatagcttggttcatatgcctccccgtttttagtactcatgcatatcctcactgtatttttgaagggtttaaaagtctgtgtatgtgtctagcaatcatataaataagttaaggtcaactgaagtgggaggatgtatatataaaatgttaaatggaacaaaaaaaatagcctctgaggagggattttaattttactgtttttttttctatatataataaaaaaaaattttccctcctacagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctaccgcgctgagcaggaacggttcctttattaccaaaggtacgggcatcgcagcagacctcacacacgcacttaaaccccccaaagagcccctgggattcgtccctccccgtccacagtccagttgtagctgagagttgagtcatctgaattacctgcccaggaagaccagtccaaaacttcaagatacgctggcccgagagtaacctcgccattggctggcgaagacacgcctccaaaatctttgcagctcgcactgcccggtggagagctatcggccaccctttatcctcatgatgctatcaaatgtgtgtttcggggaaggcctgataaaatgtagtctggcaagatttttgaaaattatttaccaagcttgctgtatccaaagatttaaagttgaacttatcttgagagtcagaagtacaggttttaggccgtgcgcagcagctcacgcctgtaatccgagcactttggaaggccgaggtgggcggatcacttgaagccaggagttagagatgagcctggccaacatggtgaaaccccatctctactaaaaaaaaagaaaaattagcccgctgtagttccagctactcagaggctgaggcaaaagaatcacttgaacctgagacgcggaggctgcagtgagctgagattgtgccactgtactccagactgggtgacaagagcaaaactttgtcccaaaaaaaagaaaactacaggttttagtgacttaaaaataccctaaaattcactttgttaaactacattgcaaataccaatattttaaacattatggattggtagttttggcaaagaatttgcaacttttaatttttaatatcggggtagggaattagcatacactatttatgacagtttttaaagaaattttctagttttgggtaattccagttatattttagtgaaagggttatatttgatattttacgtatttataaaatgttatatttacatatttataatttgtgtactttatatatttatattaatctattttacatttacataaaatatttatattttagtttatattttatgttatataatatattttagaaaaagtgctttataatagtaataaaagttatagttcctcatcccaatgtaaggtatgacctgagaagaaatcatattttcttatttatgtgcttttactctctcagcagtttagttctaaaatattacaatgtaatcagaaagtcacataagtagactacattgtcttggaatttttgatcatttggaaaggggtgggcctatgtatatcttagtttagtaaacacatttcagatagggaaagcagtaaaggttttttagttttttgtttttgtttctttggtttctttaagtatctcaccattcaccttctgaattctaaaataatttagaagttacttaagtctaggcaaatgtcacattaatgataactcagcaagccattcaagcaagaccttgtctgatctctaccaggcaaatcttgtttgctatcttacacgtgcaacacaagtaaaaactcttgtgttgtttcgaatgtgccagaggatcactcactctctcactgtaatggaggatggagaataataggctgggggggacatagatgtctctctctctaggaccctgctctccttcctccaggccttgccagtacagtcaccttacagctgtctttgcttccctctcttctctgcagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttacttaagtagtccgagtatatttaatcgttgaatttcttgctttgtacatgtcctctagttgtgactctttgattagtcttttgcaaaagtatgtgtgctctaaaaacctcagctattctaatctgtaaatcgtggaaattagcaaagatttcaggcagggcatccacttccattttctcactgaaagaggaacttaaaattgctaaggtctggttgttggaattctgtagagccacagttcccaagcaaagggagacatgcaatgaatatgatatgatatatgatatgctataatgtattctacaattctatagatttgtgtttggaaaggtacctggaggttcgtagggaaggactttagtgaaaactaccaagcacttcctagtcttttggattaagtctgagaattcagtttttgagattgtccttattataggaaatgggtagatacctcattgttcctgaataagttcagagggctctcatggtcttgaggcagggtgagatctcatgttgatagaatatattgtagcatatcatatatcatatcatattcattgcatgtttccctttgcttgggaaccgtggctctacagaattccaacaaccagaaccttagcaattttaagttcctctttcagtgagaaactggaagtggatgccctgcccgaacatttggacacccacgtcagcgacattaaagggtttttctggtttcatccacttccacatggttggtttctagagaactatcctggtatttaatta

SEQ ID NO: 17602 - DNA, 26335 bp, Human
gagttttgctcttgttgcccaggctggagtacagtgacgcaatctcggctcactgcaacctttgcctcccaggttcaagtgattctcctgcctcagcctcccgagtagctgggattaaaggcgtctgccaccacgtccggctaatattttgtatttttagtggagacgaggtttcatcatgttggtgaggctggtctcgaactcttgacctcaggtgatcctcccgcctcggcctcccaaagtgcagggattacaggcgtgagccaccgcgactggacggaagaaacggtgaaacttttaaggtggtagaattataggatctgatgactgattagatgaagcatggagagggcaacagtgtgcacagtgatgccttttcttcacaggcattataggagggacaggttggtaggaggaggcaacgggtttagttttggatttactgaccggggatgagtgttagctctctaggtagaggtgttccgcaggcaactggtgttgcgggacaaatcatagacgggagagaccgagcagagttcaggagagcctttattattaaggtgatcaccggctcagtcggactagggtccagaaagtctgagccccgaacaaagggatcaatcaccttttaagcagtttgtgttgggagttacgtgttgcatgaagtgtacttgcagaagcaagaacaaaggcagtaaattactcttacatttgttacaccatatgtcttacgtccttgggaatacatgcttttgtaacacttgctaatcagttttgtgactttacagcagcgctagggagggaagcaagaactcgctgtgcctcaaggaatgtgaaacgatggaacacagataagcctctccacgcataggggagaaataagcagttaatatactcttaacccaggccttgggtaggggaggtgctatattacattctacctcaaaggaaaagaatatacttcttgattagtatacttataaaattcattaatttccctttcactggatattcctactaattcccccagggccttgcagttttgtctcattcgctgctctatcccctagcttagcacaaaacctagttcttaacattgattaaataaatgaatccggtcaggtgctcccgtgggtgatctggaaggagttaaatttggtagtcatgggagacgcttctgtgaagccataggagcgaagattgattgtggcggcaggactgaactcagcttctgaatctttctagccgctaaacctacagactaagtggcgtccttggggaatgctgcctcaaacggctcgcgacgtcctaaaacatgtacatttattttggaaaatctgttttcgtaaaacctagcatacttaatcaccaacatttgttaacttcatggtggcatattaatacctgtcaggttgattttagttggagtgggacggggctgacctcaccgtcctacccttcggtatgaggccggcgtcttcacgacctcgcttttcacaaccccagtccccgagggcttatttggggctgtcggagtccccaagacgtggccccggagaagggtgaggtgccacagttcgaggtgccccagtaccctgcgtccggacagggggcggtgctcacgcccaaggccccgctgacgcgatgtaggccgagatcacctcaggcgctcgcggtgcaatcacagagcgcgccgtcgccgctcgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcaagaagaccacggcttcacagagtgttatttaaggggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtggtacgtacattctttagggtctgagtggggcgcgcgccgcagctgaggcggccgaagggctggcgtgggcggctccgtggccccgaccggctcagtggatggcaagggcgggggcgactgcggccatgcttggcgtggctttggtggcaggcgcgctgggggctggagtagtggctgcggcggcggcactgctgctggtggcgctggctgtagcacccgccattgccttgtgttggggggcggtgctggcctccccggctgtgtatctgatcctagacggggtcgtggttgcggcatttgtggttgtagcggtctgtactgaccgcagcagtggtgcccctagtggcggtggctggattggcggctgtgggtttgaacgacccggtggtcgttggggcccttggtgggggtcctgacggagatgctgttggcagctggcccgtcatcctggaggctgccctgtgtggttcagtgttctgtgggctgtagcagtgcccctaatggtggtttatacccatattaaggaggatgtgtagagtgtggtaatggtagtgactggagtgtggtaagggccttcctctgatgctaataatgtaacagtttctcggccgggagcagtggctcacgcctgtaatcccagcacttcgggaggccgaagcgggcggatcacctgaggtcaggagttccagaccagcctgaacaacatggagaaaccccatctctactaaaatacaacaaaacaaaacaaaaattagctggatgtggtggcacacgcctgtagtcccagctgcttgggaagctgaggcccgagaatcacttgaacctaggaggcggaggttgcagtaaaccgagattgcgccactggactccagtctgggcgacagaatgagactccgtctcaaaaaaaaaaaaaatcattttcttcaatttaacagccttattaacctagctttcaatctcccaaatgttatttgattgtgccttttacagtcagcaataagtagcttttgaaaactacccttttactgacaatgcaatgtacaaacttttgaccaagtagcttttaaaataatttttgtttgaaccataccaggcataagaaagagttatttatttatttatttttttcctacacatgggatctttaaggaaatgatatttgtctctgggaagacaaagttacttttagtgtttaaagatagttctattagctgaggtgtactgtgaggttgtggtgctcctttctatttgagaccaccagagaattgaggagtattaccctttttcattattttgtttgattttcaggatacttaatgttgtaatctgcaggtctcattttgtggcatctaaagaaacttttatgaagaatgctagagttcttgctagagctgatctactctcttaaaaactctaaaatcagtggctctagttcacttgcagtgagagaagcatgagattgattgtttactgagaagtaaatatagcttcttaaacatttcccttctttctatactacaagttactgcttgtctttttctataccttctttaagcaagtatctgggactaaaattgtgagtagtagtagtagtaagtagtgaagaaacaatatagtgggccctctggggacacgaattccacatttgggaattcagccaagtgtagatctaaaatacccaggggaaaaaaacccaatacaaaataacacaacaataaaaaataatacaaataaaaaaacacagtttaataacagtttatatagcctttacattgtattgggtattgtaagtaatatagaaatggtttaaggtatatgagaggatgtgcataggttatacgcaaatactttgccattttatataagggacttgaggatccctggatacaaatctgtgagggggtcctgggaccagttctccacaaatgccaagggacaagtgtagtttgacctttttggttttttgctactaatggttagaaaagttgcctggagacaccaataataattggacatattctggacagtgtccatcatttaaatttacagtgccttagtgtttatctggtcgtttatcttataccgtgttttgagtttctgttcttttctacaatagctactctcttgaggtatttgcaatttggctgttctcaagttacttctgatgcttccttttttttggtaacttttttttgaagtcttaatagctattttgtttaattgtttggtcatgaaacgaaactgggtttctctcttgaaatgaaacacgaattgaatttactatttttttctcttgtagaaaagtcctccatacattttctccccaattccattccttgggcatgccatagcatttgggaaaagtccaattgaatttctagaaaatgcatatgagaaggtaagtcttccaaataattagaggaaaaaaaaaaaaaacaactagagaagtgctttttaaacttttttaaaaaagtggcagaacatttaaaaacattgtaatcatatacatatcctcagtataggaaacaaaatggaaactgctctggtttaagagatggtgtcttatagatacctatccttttagcttttcccatgtcctggggtcgtctttgagacaccattgaggaaacctgtagttctggcaactatggtttaaaagccactgttctgagttttctattcacttattgtcattaaaattgatattaattaaccctcatttttctttaccatgcatctgtggggttttctaacctgctctatacatcttctgtgatttcactgtccacttgaatgacccacatgacaccatagctactcaattatttgcccgtcttctctctaatgagcttccctgtgccagttaagccatttacttcacagtctcgctttggacttgtcactcttaactgtttcacttccacaatattaatttagatatcctattcgtagaccataccgtctcctggtttgcttgtgcaactccttaaattataactattctttgacctcattggatcttgcattccatttactttctcctgatccatcagccttcattcttcactttcctctttccgctttgggtccatggcatgtcgtttctgttacactcttggcaatactgtactttaaatttcctcgaccccgcatcttttcattgtgttcagctggcagaagtcacccttggaggcagccagttattgtctccttctgcaccagattagtttcttcctgattttatgattgcctaccttaatgatatttgaacactgctccacagtcctattatgttcttgtgattgggcctacttttccactcattacagtgactaattcaaaccttcacttttctaaacttctgaatctttctacctctccatcaaagcagatgattttttctcctgtttaggagacaatgattaaaaacgttgatttaggagacaattattaaaacattcaaagaaaacttcctcattttctcaatttcaaatatgcaaacctacttgtatttatatagtaatcctattctctttcttcctatcacagtaataattatcaaacacttactttatgccagtacttagtgctttacaaagatcatctcactgaagctccacaaaaaccctttcaggtatatttgttttatagatgacaaaactgagaagcagagaggatatataatttcttcttggactcactgctagacagtggccaagccaggatttacacatggtctgatttctgagcctatacttttattaatgataacaataatggaaaacaagtcattaagatgctaagtaagccaaggtactcttctctgccctgtatataaaatttggcagcagctctgtgaagaactgctattattattattaccattttataggtgagagaaacgaaacacagagagactaagttctctgactataggaccaaagtcatacagcaagtaggtggaggagctgggatttgaacacggacagtctggctcactgcgttctaccactttgattttattacaactatattttgcctcttatcggaggctgaactctccatccctcttttgtctcaggaactttttacttttatttgttttctcagtgtattgttgacttctttttcaatggcatctttcctttttctctgaaaaattcttgtcacccgtttaaaaacttcctcaaaatggcttatgaggctctgtatggtctagcactgcctaatgctcaactctcatctcctcctttctctttctcttacttttagggcctttgtgtatgtttagctaccaaaccagctcctcattcttctggtctcaacctagttgtcttttcctctattaggtctcccttttttagattctctcatcacagagttgctttcctttctgtaatacttgtcacatttgcagttttatgtttgttaatgtgattatttgattaatttgtattttttccaatagactaagcttggtgagttgggacagtattttttttcatgattatacccccagagtctagtcttcaatcataaccagaaaactgcaagggaaagtatttaacatctaaccaaattaatataaaataaaaaatgaagtcatttagtgtaggtgagatagtgctaaaatagataaataaacttgtagtgtcttcacatagcaggtactatagaaaaggtcaaattctttggctagtcttgtaaaatttgtttttaaccaaagggggaagaagtctatattttcagaggtgttcatcacagaattagctgtaataactaaagaaaaccctgacatatcacccatatgtccaataatgaaagagtagtcagtaaattaacattgtgatgtttatatagacaatagaaaacattgtcaatataaactgaaaaaagcataataaacagttatatttatactacatttgcaactaaatgaacataattataaatttggacaaaggaaggaggagtatggcaagatgaaaagaattgctttaaggtttatatatgtttttatttttttaataatgcattattttgtgattttaaaaagttactgtcgtagtgttgcatattttttgtaacatcactatatgtacttttctctttttagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagtaggtgacactgttaccataaataaagacaaatctatacctcagtagttatagctaatagtgagacattatacatttaaaatgtagaaacagccaggcatggtggctcattcctgtaatcccagcactttgggaggccaaggtgggtggatcactcaaagtcaggagttcaagaccagcctggccaacatggtgaaaccctgtctctactaaaaatacaaaaattagctgggtggggctggtggtgcacacctgtaaattccagctacttgggaggctgaggcatgagaatcgcttgaacccaggaggcggaggttgcagtgagccgagatcacaacactgcactttagccttggcaacagagtgagaccctgtctcaaaaacagaaacaaaaaaccaaacacacacacacacacgcacacacacacacacacacacacacacacacacagaaaccaaccaaacaaaaatgtaataaaatgtagaaccagtttattccttggttcaaaagtctgaagaatcatgagaagaaaggccatggataactgataagtaatgggtatttagttttatatttgctgtcatggctaaacaatattaaagggcttcctgtacaaataatggaatcaatgataacttagcatactgggatttaatttgaaagggttattagacaatgctgttacttcatcaaaaggacttcctgcctacccattcctgcctgaaattctaacataagcgctgtttagagattgctgacttcagaagtcctcttttaatgcaacaacttcacgtgtggggtacatctatgtgtatgttttaccctcaaaagccaaatacgaaattgttttaagttgatatagaacacaaatcagacaattggccccaatgcttggtatgggctctggctgtgaatgtaacacacattagccagtaccctagtatagcagttaagagttaacattaaatcttgtttctagtgatggggaatgagggaatgaatgcctctccttaaggccaaaaaacagggccctggaaaatccctctgttcagatatatatattcatttagactctattcatttagagtcagatagatctattcatttagactcttaaaatgtaaatgcccaaagggttaaaaccattacttgtgttagtgttacataattataataacctaaatggattttatgataaaacaaaaatgtgttttaatgccgtatccccgttttgaatttttttgaaggttttcttggagcagaagaaaatgttaaaaagtggccttaacatagcccactttaaacagcatgtttctataattgaaaaagaaacaaaggaatactttgagagttggggagaaagtggagaaaaaagtaagcaaaatgttttatgtttgtcctaacatttctacttctctgtgaatagaaaagtagagtatatatgtgtgtagtatataaaaaacaaattacagtgtatgtaaaactaccttagatttatgggagggttatgtaatgattaccatgaagttgtaactgagaatccagtttttatactgggctgcaagttaagtattgccttcagaagcaattgctgtgcccatagtaggaagcaacatctgcccacagggcagcaggacccagggcagcaggtcactatattctgggtctggcctttggcctctgtaagagttccagaatctttgtttttggtatacttaagttgatattgatatattttctaaccatacaagaaactgatgtataaattagaatgccaatgtaataatgcatgtgagacatataattacagcaccaagaaatccagaatatttactgatattctttttattgacaaatataattggaaagccagatgatcattggaagttcatttagtgaatgtggaattaacaggaaattaattggataatttttattagttgtcatcaaattatgcttgcctggtgcatttgtctccagtgttgggatatactaattggtgattatagttttcttttacatatcgccagtaattccattttggccctgatcttcctacttttaacctgggaaataatctgatctttggctactattccttgggaagtaccttattattgtcatatgcactataaataaccttttttctgcttttgttattgtgacctggaaatcaaataaccacatttattcttttcatgatgaagtgctcatgagtggggttttgagatgtgtttctgggatctgttttggctgtttagagggacagggtgcttcacattgtttggtttattgcccctctttgttgttgtacatagtcacatgtctgtctacagactttttttgatgatatgaataggatcttgtttcttcttgagttctgtttttaattctcaattttctttcactttttggaaatagtaatgagaataatcttttttttctccctagatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcaggtatggataaagaatatattacactaggttatttaactttgtataattattgtagtgttggtatgctttgccttaacaaagataaaaattaaacaagtaaaacatacaaaatgggtaagattatgaatcccctttcttctataagaattcaagacaaattttctttatataatgagctcatttaaagtaagtttcagtttattaaaaaggtgatttgttgtctgtctagtctaatattttatttatgtttttgtttttgagatggagtcttgctctgttgccccagctgtagtgcagtggtgtgatctcggctcactgcagtctctgcctcctgtgttcaagcaattctcctgcctcatcctcctgagagctgggactacaggcacgtgccaccatgcccaactaatttttctatttttagtagagacagggtttcatcatgttggccaggctggtttcaaactcctgacctcaggtgatccacctgcctcagcctcccaaagtgttaggattacaggcgtgagccactgagcccagcctagtttaaaagcctgcttacctcacgtattccttatcctcaggaaagtctctgaactatacctaaaagtgatacagctcttctctagcacttgtttgaaatctttggtggctttttattgtattgtgaagtttctttgttttaaatatttgtgcctttatttaattttctgtttcttaaggacagggactgcctctgatataaagaaatattgctcttaggacttgatctatagcttagtgcttagtgttttgcatattagtaggctttctgtacttttgttgatttattggtgtttaggtgacagatggggaggagatagattgctagtcccttttcttctatttctgccccctctatctagttacagattggaagaggggtgggagtaaaaggaagagccaggagagattccctaaagttctctggaactcatcataccttatatttgcaaggagctttgcagtttcaaaatgttttcatatatcttatattagaacacccagcacagccctggactcatagtgggttctccataaatgtgcatttcttttttttttttttttttttggtgatggagtcttgctctctcgcccaggctggagtgcagtggcatgagctcggctcactgcaagctctgcttcccaggttcacgccattctcctgcctcagcctcccgagtagctgggactacaggcacccgccaccaagcctggctaattgttttgtacttttagtagagatggggtttcaccgtgttagccaggatggtcttgatctcccgaccttgtgatccgcccgcctcggcctcccatagtgctgggattacaggcgtgagccactgcacctggcccataaatgtacatttctacctgcctgtttctacctgctctgtctcttggatgaagtcagagcttgctatgttaggcccttcacattctggcccagtctttctttcttctactcataccaactaatttaaccagattattcaattcactttcttaaacaggcctatgttttcctggttcgactgtattcatacagttaagccccaacatcttctcttctgtacacatggtttcagttgatcctcaataacagattaacagtcttgtaaatgaaacagagtaggagttttttttagaaggcttgatttaagagggggcttgggagtcagactgcctagttttaaattccagctccaatgtttgctttctgtgtgatcttatgcagctagctataacttgaggttaatagtatgtacctcacaggaagataaaagtgagtaattcatgtaaaacacttaacatggtacctgctacatagtgaacatactatttaaaggtaaagtttaggagttgaagcttgttttctgaatctgctagtattttcaccccctacaaaaaactattgtattagaaagtgaaaagtagaaccagattccatggaagaaccagagtgactcttctgctttaagacttgatttggtattaaaattggaattttatgttaatttaaaagagtatcctactttctgttgaactggaaaatacttctaaaggaatttcttgcttgttttaggcctttagtttgaacacaggcaatgtgttaagaatctgggatatatatgttaaataaagcacagttcttgcccttagggactatggacatttttaacaatgtaagattttcatgacttccagtatgttcctggttctgatttttttgtcaattattttagagtcattaaagttggttaaataagatgctttatgctcggtcctggttctcaaaatgaatttgatcctagaaggttatttctttatttaagaaaatcatctttatcttttaattacagacgcagggacagagctcatcgggaaatcaaggatattttctataaggcaatccagaaacgcagacagtctcaagaaaaaattgatgacattctccaaactttactagatgctacatacaagtaagagctattcagataacatattaagctgaagcaggaaattacacattaaaacacagttaaatagtatttccagttaaaaaacagtgatgctggcaaaataagttggtagctgtgatctttggactctttaaattgttgagacataaactattggcatcctgtgtcttactgtaatcccagtgactgggtatggtaaaagtttgctaatgaactgtaatggagtcttttgtaatcaaaatcgttttgtgctggtctgtctcttccctaagagaaaaaaaactcttgacttgtgatagtcaaatataagagaccactatacctgaaaaatgtattcattatgacactttatttaaaggttgaggcatgaaatgtatctgccaaaatgttaaatttgtgtctttggttcattccttagggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccaggtttgttggatttttcagtttcattgctgccttatgactttgaggatctgtggctaatttttaaaagggacaatttgagattttctatatactatagcttaaattgatcagcttctctatttttagcaaattccctataaccttacctaaaatatcttaatgttattgcttcttgccattaagctttatcagatatgttttgggttgatggcttagagatccttggggatgtttctttggtacttacttcctctgcttcaaagtctggcttctgtacatagaggatattatgtgcatgttgtgtgtcttatgaagtgtagaagcctctgaattacttagaattctgtatgtccagagtggcctgggcatgagcagagacttctaaaagtagtagtagtagtagtaatgaggacaagacatttacaaatactacatgcaacttgctgggtggaaaggaagagaggacaactcactgcacaacctgacattccatcttggaagcaaaccttggtgatgtcatcttcctgttatcttttgtgcttttggtcctatattaatatggcacattacactgattttcagatgttaattgtattcctgggataaatcctactttgtcatggtgcatagttctttctatatgttactacatataaacttgctggtgttttgttgaggatttttgcatctatattcataaaggatattgatctctagtttcactgtgatgtctttgactggttttgatatcaggatcatactcatctcatagaatgtatttggaagtattctttttttcttctaatttttggaagagtttgtggatgattggtgttaatccttttttacatatttgcaaaaattcagcagtgaaatcatctagatctgtgcttttctttctgagaagactttacttactaattcaatttatttgttacaggtttattcagatattccatttcttcttatgtcagtttcagtagtttatatctctctaggaatttgtccatttcatctaggttacctaatttgttggcatacaattgttcatagtattctcataatcctttttatttctgtaagctcagtagtgatgtctcaacactcattcttgtttttagtaacttaaaataacagcttaactgatatatttacatagcataaatccatccatttaaaatgtacactttgtggtttttagcatattaagagttgggaaaccatcatcataatttaattttagaacatttacatcactcccaaaagagagctggtacccattagcagtcatgcttcattctccctgactgctgcccctggcaaccattaatctccttttgcctctgtgagtttgcctattctggatatttcatgtaaatgggatcatacaatttgtagtcttttgtgactaccttgtttcacttagcatgttatcagggttcttccatgttgtagcatgtatcagtacttcagtctttgttattaccaataatattccattatatggatagaccacattttgtttatttgttcatcagttgatggacatttgagttgtttccaccttttaaactattatgaataatgccgctctaaacgtttgtgtactgattttatgtggacatgtgttttcaattttggggggtcatacctaggagtagaattgctgggttataaggtaactttgaagaactgccagactgttttaaaaagtggctgcaccactttcaaatctcactaaacagtatatgttggtcctgacttcaccccctcaccaaacttgttacttgatttttttattataataggtgtgaagtgatacttttttttttttttttgagacagagtcttggtgtgatgcccaggctctagtgcaatggcgcgaccttggcttactgcaacctcggcttcccaggttcaagctattctccttcctcagcctcccaagtagctgggtacacaccaccacgcctggctaatttttgtatttttggtagagacaaggttgtaccatattggccaggctggtcttgaactcctgacctcaagtcatctgcccgccttggcctcccaaagtgctgggattacaggtgtgagccaccatgcccagttggtattttgttttgattttgcatttccctggtgactagtgatgttgagtgtcttatgatgtgttctttggctttggtatacttctttggagaaatgtctgctcacatcctgttcccatatttaaaatgagttgtctttttattattgagttgtaagagttcatctatttttttttaatgtgcttttggtgtcagagaaactaatgcctaatcaaagtgtatgaagatttatttctgtgtattcttcttagtgttttgtagtttcatatcttacatttaggtctttgatccattatgaattaatttatgtatatgatgtgaggtcatcattcttttgcatgtgtttatccagttgtcccacactgtttgttgaaaagactattttttccacgttgaattgtctttgtaaaaaaatctattatagccaggcgcagtggcacgtgcctgtattctcagctactgagaagctgagatgggaaggtcgcttgagctcaggacttggggtccagcctgggcaacatagcgaaaccctgtctctgaaaaaataaatacattttaaaaagcctcttgaccataaatttaaggctttatttctggactcagttctattccattgatatgtttagtctgatgccattacgtagttttgtaataagttttgaattcgggagtgtgagtcctctgactttgtccttttcaaggctgtttatctactcctagtccctttagtttccatatgaattttggggtcagtgtgtcagtttctgcaaagaagctagctgagatttttgacaatgattgcattgtatcgccatattaatttgggagcacaattttagtctttaaatctgtgaacatgagatgtctttctcttattttagttctttaatttctttcaacaatgttttatagtttttggtgcacaatgtttaaacttctcttgttaaatgtattcttaagtattttattattgttatttttttgatgttattctttcttctgccagtccaaatctgctgttgatcccctcgggtgaatttttcatttcagttctcatacttctcagttcttgaatttctatttggttctctaaaaaaataatatattgatattctccattttactagagatatctaggcatattttgctatagttctttgaacctgtttataatagctgatttaaattcattatctagtaagtccaatgtctgggcttcttcatggatagtttctattaaactgcttgctttttctatgtactggccatactttcctgttttggtgtgttttttgtaatttttttgttgaaaactgtacatttaaaataatgtggcaactgtggaaatcagatgccctcctccctgggtttattgttgctggctctttgttgttgttgttgttgctgctgctgtttgtttactgcgtttcctggattaattatgtcattccttgttcagtgaggtcactgaaatctctgcttgcttactttagtgggcatctaatatttggacagagatttactgaagtgctttgaacagccagtctcctagcttttgctgaaaggctctgtatgtgtgtgttaggggatgttattaacactccaacaggcagttacaagtctgccttcactacctgtgtgtacaggtcagccagaggtaaaagattacagcctcttagatcttacctgggcatatgcatggtcttatacatatgtgtggccttcaagattctcttatgttggaacttttcaaagtctcctgtggacatcttactccccagttttcccttttaaacttcttgttctgtctcttagcaccaactgatatcaccatctcaggcgccttcagtgttaaacaatttttgctaaatatttttggaaaatttgctctggctcctctaatagttgttaggcttctggctttcacagctgctatagttgtcatgctgttggtttccggggctaccatggatttggggagaggaggatgaaagaaatacaacttacactaccacaaagcttactcttcttaccaagattcagatttctttttcttgaattaactctccttagattgttgcaagcctttggttaatcttccagaattttgaaaaagttgacattaagattgttgctactgttttcattttttggaggagtgaatttttgtaggttcttacttcattcttcagggcaatcgcttctgttaccttgccctcctttttcaccatggacagtggtagagcatgataaccccagccaccctgaaccagttacctctgtacttttagctggaatgcaagctgtcttgtactaactaagaagttaaactaattttttgtactgttgaagtatgttatttataacaatcaggaaatgctttctcattttagctcaaggatctaaatttacttgatcgctgtataaaagaaacattaagacttagacctcctataatgatcatgatgagaatggccagaactcctcaggtgagtatcttggctacatcttcccctctatacccccagtttttatcaaaaagaagaaataggtgggtgtggtggttcacacctgtaatctcaacactttgggaggctgaggtgggaggatcacttgaggccagaatttgagaccagcctgggcaacatagtgagactgacctcatctctacaaaattttttctaaaaattagctggccataatggcacatgcctgtggtcccagctgcttgggaggctgatgtgggtagattgcttgagcctgggaggttgaaactgcagtaatccatgatcacgccactgcattgctgcctgggcaacagagcaagaccctgtctcaaaaaaaataaaaataaaaaagaaagaaaaagaaaagaggaagtagagtagcataaaagagatttttttaaattaaaaaagtagaataatcacttctacctaatcttcagttttatatactctaaaaacatatttttacctaattgtagatagtatacgtgctaatctgttttttttttttttgagacggcatttcactcttgttgcccaggctggagtgcagtggtgcgatctcagctcactgcaacctccgcctcccgggttcaagcaattcttctgcctcagcctcccaagtagctgggattacaggggcatgccaccatgcctggctaattttttgtattttagtagagatggggtttatctatgttggtcaggctgatctcgaactcccgacctcaggtgatccacccgccttggcctcccaaagtgctgggattacaggtgtaatcccgcgcccggcctacatgctaatctttaatgctaatcatgttctgcatttttctttaacaattggggttttaaaaatcaaagtacatatttttcttggttttaaaaataacattttgttgtaaaaaattgttaatatgaagtgtacaaattgatagtgaaagcctctctgaaattccaaccctacctccaaggcattatgggtttgatttgtgtactgtgtacttccaacccaacgctggctcactggaaatcatcttgagttaaaataatttttagtttgcctattatctagccagtttttaaatatatgtacagatggttcttgatttatgtgattcaacttataattttttgactttatgatggatttatcaggatgtaaacctatcataagtcaaggagcatctgagtatcccatgtatattcatgctttattacacaatgatctgattatttgtcagcacatttttaaattctctaatgaaatgtgtggcttttgtttatagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctggtaagatgattatattttagattggaaatgtttgttctgataacatatttgtctctgtcaaaatattccgaattgtgtttacaaattatctctccctttcctcatagggacatttttgcaaacttttttaggagaagaatctttataagttggagaaaaatatttcctttgtaccaaatggaattgttccataaatccttatataatgcttcactacttcctaacctgtctggttttattaggtctaatttttatagaacatccttgttttcccttacaatggtatttaaagctctttgtggattctcttttaaagaaccattggagtcagcacaccattcagggaataacagattactagcatttcacaaaaaagcaaaggcagtcttttaaaattaaagctcttctcgatcgttagtcaacatttttgctctctgaatatccgtatgagaaaatggtctttaaatttgggcaggttgtgtgtaggcttgcaaatttcatttccagtaagatcctaaaataatttagctatacccttgtttctccagtaatttctctgtccattggttctctgtactgattaaactatattctatgctttagtctttccaaagggatcatttaaatgacagatgacttgtcattggtcacactttttccacatataaaggaaaatataaagtcctttgggaacttcagatcttaactttatgtaataaatttaatactgtggtgtataacacaatatataaaagaatcatagttttttttttgagagagtcttgctctgtcacccagtctggagtgcagtggcacaatctctcagctcactgcaacctccacctctgggttcaagtaattctcgtgccttagcctcctgagtagctgggattacaggtgtgtaccaccacgctcagctaatttttgagcttttagtagagactgggttttgccatgttggccaggctggtctcgaattccaggcttgaagcaatctgcccaccttggcctcccacagtgctgggattacaggcgtgagccatgccacctggccaaagaatcagattgttaacagatgggaagagcattagttctgtagcccaaattctgccccaaagaggaatcgtttctaaactagtaattatctggtttccacttgaactttactagaaatgggttgtgggttgttcagttaccttttatgatggctcattctatgtttggacagctgtcatttttagagccttatgttaaagctgaaatctgtttctttttaacatctcatttatagttggtcctaaccatagtctctgaacttatattgtatgaggtatttgagtacagatataatgtctcctccatctttttttcaatctttgtgttagtttcctagggcttctgtaactaattacaatatgggtggcttaaaacaatagaaatatattctatcacagttttggaggctggaagtgtgaaatcaaggtattggcaggaccgtgctcctccttaaggttctacaggagaatccttccttgcatcttcctagcttctggtggctcttggcaacccttggcttgtaactacattgttccaattactacccctgtcttcaacaggctttcttcttgttcatgtctctgtatcttaacatggcattcttataaggacaccagtcattggatctaagtcctaccctaagtcagggtcatctcatcttaaataattgtgtatataaagatcctatttcccaattaagatcacattctaaggttctggatggacttgaatttatggggggatatatgatcttacgttaatcttgttaaatatcacattacatgtctctaatttctttactcattcttttacctcgtaattgtgctgtttatttatgttggtgcatatagttcattcattttcataatattacattttgtgaatcatcagaatttatctactcttatgttgattcaattaggatacttcttgcttgttgcgattaaatccttggactattcttcctgtaagccaagcttctctttagttgttatatttgaaatatggaccaatttgtaaatgctcatcttaaatgtcactcctagaaataagtacagttatgggccaagcaagcactgtgctaagcactatcagtttaggttttttcttttgatgaaaaatcttgcaatgaaatgcccaaatcttaagtcaacattcattgagttttgacaaatgaataacctttagtttagtccaatgtatcaatcttttaaatggttattgctttctggccctgtcttaaaatttttgcttagcccctgagtcatgaagatattctcctgttcttctctactgaaatttatgctgttagcatcatggtttgtgacccttcttgaattagtatttgattatggtgtgacataggagttgaatttcatttttcccccatgtaatatctagttattcctggaccttatgttgaaaagacttgcttttcctcattggcttgctttggtgtctgtactgataatcaaataaccataaaaatattctgttctgggctctctgctctgttccattgatctatttgttgatccttacctagtaccactctgttttatctttagtcttgaagtcagatttgaaatcagttttatgtcctccaactcagttctttttccaagattgctttggatatcctaggtcctttgcatttttatatgcattttagaatcagcttgtcagtttctacatgggtgtgactttttagtatattattttgggttcattaaatctcattttcttccatacatttataatgacatttgaggtttgattggaaggttttcatattgacttttaactagggctttcttgggacaaacagaatattctactatattcccaaactagattaccatcttatgattcaaactttccatatatttaacccagatatatattttcagaaaaagtaattggaaaagttatgtgatcagtcaagtactgttttcctaaaatgtggtattgaaaatctcctggaatttttaataattcatgttgttttatgtgaaaagaatgtcatctttttattatattatctgtacatttgctgttcatctaaaatgtagataatatcaccccaggctaaaaaggatgagaaagaatttaaactgattcttataactttttcttttttttagggcgtcaccgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttcaggggggatctaggtaattggcagattctaaataatataatttccagatagtaattttaagagtactcatcgctcttgccaaataagttcagggtattcaaatcttggactagtcctgcaaggtacaaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaatacagtctgtattcatgaattgtaaaatatgtgcttcagtgagcagagttagggaatccaggaacttgggtggggaaaaattacatctttatttgcactaataatttctaactgcaatttagtatttatttcaattatgaatttgggcagcattttattagcagtatccatgattttgtcaatagaaatctcagatattttcatattacagatgttacagatttcttgaagtatctagttacgaccccgagataaggctagtctaatgtttagtgaatagttttagacttcttaacagatttcatttttaatcacagactaattaattattgagatgcataaacaagtgtgattgcagaggcctactatcataaggaggcgtggtggtcaaacaatggcactgaactcagcttgatcagatcatttgtccatctgtttttttctccactgtctcttagagcagaatagccttgaatggcaagccatgctagctgaaaaaggtttttacccacaacctgccccttcaactaactgctttagagtacgtttgctatttttagaattcctcttattggaacccagcttctaatgtggaaaatttaagtatagttggctccttttatttgtgggttctgtatcctctgattcaaccaactgcaggttcaaaatactaaaaataaaaccccacaataaaaaaatacagtattagcaactatttacataatgttcacattgtattaggtatcaaataatctggagatgatttgaagtacacaggaggatgtatgtagactatctgcaaatagcacattgttttataagagacttaagcattcgcggactgtaatatccaagggggatcctggaactaatcccccacacatgccgagggatgactgaaattagaaatgttcaagcatgtacaactttctaccatgcctgtttgtgttggtataaatcatggaacatcaaataataagacaaaatcctccaggtgtaagcatcaaatactagtcctcttgctgttttagtgagttgccatgttattgaggaggactccagatgagaaataacattgcgatctgtattatctctgtgagagcctcccagtctgaatttggcttggacaacagggatactgtttaattcggctgcaatgtgattaagatcttttgagttaatgatttcttcatctttttagtgggccatggatttgtgagaacacatctttggaaacaagtaacactaactgtaatatagtaaatactgattaatcatgaaataccaatatagcttttaaaaaacactatgtagatgtaaagttgatacaaagacacatggaaaactttcaacagtattaactctaagattaggacaactttctctgaatctctcactcctacatatttgacataagtaatgagatgctatgtaccaagaactatggctcagttaaaaatgaagaaggttcaaatacagtgtggtgaaaatggtgaagtcatttttatttcagtacttgacaaaataccccataaaattcaaaacttctaccattatacaaaaataggtctctacaagtgatattatctgtcttcatcaccagtagaatatattaggcaaaacatgtaacttcagtagccttataagaaaagtgcaggacacctcgagctacacattcagcagtattgtaatgcgtaaaagtttaatcttttcacccatttgataaatacacaaggtttataatttaatgttttaaattagcattccacaaatatacaggtaattcaataattattgtgcatgaatacatacacaatgcttatatatacaaattccagtttgttttcatgtgctggcaagggatttgtatacaatcataagctgtgttcatattggtcccattgaatattcacaatacaaaagcacaaaagaaccattgatttacaaaaggaaatctatttaaaatcacttcaattaatgatgtttcaaaggattatcttc

SEQ ID NO: 17603 - DNA, 39176 bp, Human
gggaaatatgttacttaaagatgttttgatttcaaaataatatacaggcttcttggctcaacagtaatgtttttgttttagtttttaaaaggatgaagaaatgaggagggaaggcataattgaaatttaaagtgctcaggttacaataaaggatttttctaaagatatgccatagataaaataaaaattgatccttaagtattctggaaaattaacagattatgatcagaacctatcttgtatttgggacaagaatcaataatagttctaatatactctgcctaatagtaatatttttaagaaggaaatctaatgtgaaaatgttttattcctttggcaccctggcataataaacacattgagtttcagtacagaccttgcagcctataattttgtgaccttgggcaaatctcctctttaatctttagctctttatttgtaaaatagggacaatattgctatctactcccacttgtttcatggtgctggaaaaattcaatgaggtattagatacgaaatcaccttggaaactatagagtactagcatcatgtaagatagtagtaacactgatgatatactatattaatcacccaccatggacatcccatcagcctgctgctacacagtgctgacatgtattttattagccagctgtagcattccagatatatttttccaggcatacttaggttaaaaagttcagtatcttaagtagcattggaaatcttattaatgagttttacagcattgttgaggaagataaagatgaaacagtttctgcagtcctccaaaattctaaatgttgcatttacctgagtggacaaggtcacagagctagtcatcacttgaatccaggccttctaattccaaatctagaacaatttattttatacttaacaagttttcattttctaacatgtatttttagatgaaaacatgcagatgtaaaccttttatatggtagcataattcttcatttttctttttcagataatactaaatacacatataccccaggatgcccaattttttactgcttacaagatattatgcgagtctgtagtgaatccagtactcattttgctacacttacagcaaggatgttaatagccttggataagtaagaaatgccgttagaagtatcttttaattaatcaaatacatgtttatagtagaaattagttgtcatagatacagacactttgagaagaaaataatgaaaataatatatgtattaaaaaatggtaagtttttcaattctaatataaaaatgaaaaacccgaagataaggttgtcctggcctgggtacagcatgttaattttatttttcagaaatggtaaacactgccctggcttaagaattaagatttacctgttatgaaactatacatttaatattgagttactcttatcagtgaagaagtcattcaacctcttatgcctttgtctttctgtaagaacagggctaatgtcacctacatctcagtagtttgaattttaacagtacttttatgttttttgaaaggagtttttattactataatggcacatacatttaaaaaatttatttgctgtatccattaacaaaacttttattaataaatgaagtatttgtatactgacttgatctttatagatcatatgaacatattatcacatgtgcccctaaagtatgtacagtattatgcatgtttttttgttaaaaaaatcaatttgcaatataaataaattttaaaaataataaagtacttaactaacactaaattaaaattataaaaatctgaaggtaatattcacaagtgtcatatatcagagttagatagtaatctatctttttcatcttcactttcgaatggctacttctacctgtttttttattttgccaggtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtaagagttgaatgaattttagctctgatttaaaagacgttttatctcaagtgtaattttttttcctgagatatatacatctattactaattataaacatgaaggcctggtacagtggctcacgcctgtaatcccagcactttgggaggccaaggagggcagattgcctgaggtcaggagttcgagaccagcctggccaacatggtgaaatctcgtctctactaaaaatacaaaaattagctggatgtggtggcgtacccctgtagtcttagctaccccggagactgaggcaggagaatcgcttgaacctgggaggcggaggttgcagtgtgctgagatcgcagcactgaactccagcctgggcaacagagcaagactcattctcaataaataaataagtaaaaatttaaaatataaacatgtaaacattaagatgacaaagctcttaatgggtttttgttattgttttccctttctaggtagataaagtggtaataaatccatactttggtctaggagctccagactactcaaaaatccaaatacctaaacaggaaaaatggcagagaagcatgagcagtgtcacagaagacaagtactgtttcggttttactccacattgcttttataaaaacttacattctaatttaaagtattgtttaaaattatatatgcaatttgtatgcattgtagtcactattgagtttacagcttcttagtgatacagagctttcatagatgtgtcacatttcttttgaaacaatttttacagtcctgttgtatttttcaaaatttctttttaatgattagggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtaaatggaatatttattcttttctttttagaaagaatacattttttattataaatgttagtgcttcttttcaagactgttctcattccaaatactttttctctacctgtttgccttaggagttttctgttttgatcttagatgattgtatatgtgccaatgttcagaattgtaaggtctgccctatggggaacgtactgttagtgtccttaggcattgccaggtcatatagtaggatacttaatgactagtaaatgtcactgtagagtacaaggtcacttattcacccttgcagtttctcttgttttgcagtttctcttgttttgtattgggattatgttatgcttatctttactggaagtttgcatgtgttaactacttacgatttgaccttgcgtcttgctataaaagtatccttttagtgctttgagaaactggttatcaagaagccctcaaaagccttcattagaaccacagctttccattatgttagatactagtgttgggacaggattggggttagctctttccactagttgcccagtgtagctcttggtctcctctcacataattatttttcccctcagttgggctgagttgttagtgtttagagtagtagttaactgtttactataagtcatcttctagaaaggatataataaagttttttacattatttctgtgggaaagttgctcttcacctattgtttaaagtaagcttccttggctaatttaagaggtaccggccaggtgcagtggctcacacctgtaatcccagcactttgggaggccgaggcaggtggatcacgaggtcaggagatcaagaccatcctggctaacatggtgaaaccccgtctccactaaaaatacaaaaattagccgggcgtggtggtgcacgcctgtaatcccagctacttgggaggctgaggcaggagaatagcttgaaccagggaggcagagattacagtgagctgagattgcaccaccgcactccagcctggtgacagagtgagattccatttcaaaaaaaaaaaaaaaagtaccacattatttattgccttgttaaatgtccacagtgtcttagttgtattagattgagcaaggtaattcactttacctctctgcatctcagcttatttatccatatataaaatgcagtagatcatttctagagtttcttccaactcgaaattcttttgatttatctgattttaatatttgtaatcaagcagttaactatagttgctttatatgtgtgtgtgtgtgtgtgtgtgtgtgtgtgtgtataaaaagatcttttttctgtttccttaaaaatatgctcttatatttcttattacatggaatttttgtattaagagttactctaattgtctttaactgagttaatagttgtttctttagattaccagaaaatactggcggcaaaaacaatactaaaagaaatcacatgcagccgggtgcagtggctcacacctgtaatcccagcactttgggaggccaaggtgggcggatcacgaggtcaggaggttgagaccatcctggctaacaccatgaaatcccgtctctattaaatatacaaaaaattagccgggtgtggtggcgggtgcctgtagtcccagctacttgggaggctgaggcaggagaatggtgtgaacccgcgaggcggagcttgcagtgagctgagatcacgccactgcactccagcctgggcaacacagtgagactccatctcaaaaaaaaggaaaaaaagaaatcacatgctttaccaggagctaaataaaaagaggtagagaatatagttcagattccaaaaaagtatactatagatttggaaaaggcaaaggcagtgaattttagttgaggaatcccaagtttatatttgactgtatagttgctcctttttgtggcaggggtgtttttttttttttccccctctaatgaaagaatggtaatattttcaactattacataaaaacaaaagcatggcattgtatttaatatgctttggaatgtacctatgtttcagtaccatttttagttcctaaaatattacctttggtaagttactttatgtctctaagggtctgtttctttatctatacgagatgggcttaaaaatggtaccttccctaatagtaaaagaaaaattacaagtaacgtgctttgagagcacataatgagcactcaataaatcttggcttttaagaataagtgttggccgggtgtagtggcccacacctgtaatcccagcactttggaaggccaagaagggcagatgactggaagtcaggagtttgagaccagcctgccctggtgaaactctgtctctactgaaaatacaaaaattagctgggcgtggtggcaggcacctgtaatcccagctgctcgggaggctgaggcaggagaatcgcttgagcccaggaggtggaggttgcagtgtactgagatcccaccaccgcactccagcctgggcgactgagtgagactacatctcaaaaaataaaataaaaaaataaatattgtaaaaatgtaaagattttgatgtctgaatctaaaatttattaatctgtaatattttcatttgcaaatttttgttacttgagtatgccaaggaaaagagttttatacttggataaattaattttctgtcagcttgataatcaagtttaatgtaacaggagtagtatgggtcaccttgcaatactattagttggatgcctcatttaattgacgtgaattcaaataatgatttaactattcagtaaagaacttaaatttatcttggaagtatactcttattcactaattggtacaaagaccgaggaggggacactgggctcttgactgtgatacagtgaagagactagggtttagtcctatttttgtaagacaagatattttacctcacttggtctcatttctcacctttaaaatgagggttttaattagattagtggttctcaaacttttgggtctcaggatacttttttactcttaacagttacaggattcccaagagtttttgtttatgtggattaaatccagtgttaagatattagaaatagaaactgaaaaatattccatgtgtattaaaaataacaatacctatatatgttaacataacacaatttaatgaaaaaaataagagtttaaaattcaagattggtagccagacatgtaaaaaccattctttactttctagaatcatcattttcccaaaatatttaaaatggctttaaccccatgtagagaacttaacagccactcagtaaatgtctcactgacatttcatattctctcacttctttattcttcccgtacccctatgccagaccctctattttgaatcaaatcagtgtcttctttctctgatagtactttcagacttcagatcattgttagtgtttttcaaactgtgatgatttggcttcctacaaattatttcatccaatttcacttggagcttcactgtatattagctatctgtactctttgtttcattcagccttttagtcctccccttccaagctattctaaacgtttctactcctaagtacttaaactttcactactttctttttctactttcataatccctatactcctttttgccccctattttcaaagaaaatttaaggcgtcagaaatgttcttctctatccctaatgatcactttttgtccccatctctctcctgtatcatagggtatacacataaaaattcttcttattccccttaaattcacttttctttttccacacctactttcttctttccctcaaacatgcatgattctcttccttcttgaaagttgctttcacctgaacctacttcttttagctaccatcctgtttctttccttcctttcacagccagatttcaaaggtgagtgggagacacactctgctttctctttttcactcttcataaaccttaactttttctgagtttttgatctgtttccctgctctgcagcatttaattcttgactacttttcattttaagaacaaataggagttgaaagagcataatggagctataatgaaggtcagtaaaaatgcaaggtattattgatatcttatcattgctgtggaaacactcactggcctccattctgtgatccagacctgtgtcttagtagtagtactactaagattcagaaaactggcttctaactctggctagtcaccatgagacgttgggcaagttagttaactgcatcaagctccatttttctcatctgtgcaataaaaaagtacctctgcctactttataaatttctatgattatattaaataattatataagaaggtagctgggaaattttaaagcaccatacaaaatgtatgtttgtattatttttattattacttctcgaattgctacctcactatcttttcccttttagatgtatttcagtgttctaaggtgatcacatttctctaaattcattctcagatttcatccattctttcagaccatttaattcttttcagtgagatgattttacatattctcaaatagatactctaagcctttgccttcccctaagtagtttcaagttgcctactaaacatttcagtcacttatcttttgtatgtagggcactttggagaatataaagacactgtccctatcctcaaggagcttccaggctgatagagaagaggtgtggataaacaaggatggaattaggtagaatgaaataagtcacaaaaaagaagcaaaaatagaatgctaaaacatagtgggaatatagagaagatagattttaaaccgtttcagaggcataatggaatttaacctgaacgaaatcaggaagggggaaaggatgtcttaagaatagcaaagaatattgtggctttgatttgcatttctctaatgatcagtgatattgagctttttttcatatgtctcttggctgcttgtatgtcttctttagaaaagtatctattaatgtattttacccactttttaatggggtggttttttcttgtaaatttgttaagtttcttataggtgctggatattagacttctgtcagatgcatagtttgcaaatattgtctcccattctgtaggttgtctgtgtactctgttgatagtttcttttgctgtgcagagcagctgtttagtttaagtaccatctcacaccagtcagaatggctatgattaaaaagtcataaaaataacagatactggcaaggttgcagagaaagggaacgcttatatactgttggtgggagtgtaaattagttcaaccattgtgaaaagcagtatggcaattcctcaaagagctaaaaacagaactcccatttgacctagcaatcccattactgtgtatatacccagaggaatataaatcattttgccataaagacacatgcacacacatggaatgttcattccagcactattcacaatagcaaagacatagaatcaatctaaaggtccatgataacagattggttaaagaaaatgtggtatgtatacatcatggaatactatgcagccagaaaaaagaacaagatcttgtctttgcaggaccatggatggagctggagaccattatttttagcaaactaatgcaggaacagaaaatgccacgtgttcccacttatacgtgggagctgaatgatgaggactcatgagcacaaaaaagggaacagcaaatactggggcctccttgagggtggaagctgggaggagggagaggagcggaaaaaataattattgggtactaggcttagtacctgggtggtgaaataatctgtacgacacacccccatgacaagaatttacctatgtaacaaacccgcacatgtaccccagagtctaaaataaaagttaaaaaaagaatagcaaaacctgagcaaaacaaatcacctgagtaaaacaaatcacctgagtaaggtgtaggatgaaagtgtctgatttggagtatagaaaagacatagtatttgtgaaggggaagaaaggaaaaacagatggaaaatcagttctaaaaatgggctgttttcccctcagatgttccatatctaaaaccaaaaccaagtttccattcctcctcccacctcaccctcttatttccacacaacaaattactttctacccttgcttcagagtgcagccttacataagtctttggctgtaaccaagaggttgactcactgtgtgcgtatgcattgtactcttctgagacctttgcttactccttttctgtctacctaaaatattttacttctcttcaacatctcttcagttctttcctatttaaaaattcagttcaggctgggcatggtggcccacgcctctaatcccaccactttgggaggctgaggcaggtggatcatttgagcccaggagttagaggccaggttgggcaacatggccaaaccctgtcttcccacctccccgccgcaacccccactgagacggagtcttgctctgtcacccagcctcgagtgcaatggcgcgatctctggctcactgcaacctccgcctcctgggttcaagtgattctcctgcctcagcctccatagtagctgggattacaggtgtctgccaccacacccagctaatttttgtatttttaatagagacagggtttcaccatgttggccaggctggtctcgaactcctgaccttgtgatccacccacctcggcctcccaaagtgttgggattataggcatgagccaccacgcctggccgaaaccccatctttactaaagacacaaaaattagctgggcgtggtggcgcatgcctgtaatcccagctacttgggaggctgagacacgagaatctcttgaacccaggaggcagacattacagtgagctgagattgcaccactgcactccagcctgggcatagagtgagactcagtctcaaaaacagtaacattcaattcaaattgttcttctatcagagcactttacaggaccatctagactgaaatcatatctcttgttttctggaattatatctctggagctgggattacaggcgtgcgccacaatgcccgcctaatttttgtatttttagtagagatggggtttcaccatgttggttaggctggtctcgagctcctgaccttgtgatccgcctgcctctgcctcccaaagtgctgggattataggtgtgagtcactgcgcccagcctctgatattttttaaagcatggacaaacattaccatacttaaattttacagcattatgtaacttatcccatgtttatgttttgcctcaaattacactgtaaaccattcagggtagagaccacatattttatacatgtttgtctctttcacattgtctaatatagcaactgtgtatagaattacatctttgggcctattttgtaaacagccgggcctaagtgaaaagcattcttactaagttttcttatatgagttactttctgtttctgaaactatatttgactaaaaattgtatctaacctttgtagtacacatgggatgtttctctgtcgtctgctctatcttgtatttgaggttatattttcttccagtttatcagaaatagaaacagtttaattgaaccagaataattaataagaaacccctaatcattgaaaacattatgtcagtatcttaataatcctttgctctctgtcctagaaaattcttagatttctttgagatatcatctaaaatttggatttttaaaaacatttcagatgatctttttaggtaagttttttttgttgttgttttttgtttgtttgtttttttatacaggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagagtaagttattttccaggtttttaaaaataatattcaagcagtgaataacaagtaatgacactaaaatgttaaattgtatgtttgagagttcatctgaaaaataaaaataaattccattactttatagaataagtaacggaatatatgagttgtactttgtagaataaataatggaatatatgtgttgtgcttttgaacatattttttttttagattttttaaatacacctcgcctaaaatttacattaactatttttaggcgtacagttcagtggcattaagtacatttatatcaccacagtctgtcttcagaatgtatgtagaatttaacctcttttcattttatattgtatttctccaaaaacatcttgaaaaaggaaaaagattttccagaatttcataaaggaaattcataaaaaggaatatcataaagaggaaaataatagtattaaaacttttattatgtctgtatcagaacttttaaaaaaacagtcatcacattgattagtgctttgagtcttttatcttggcaactcttgtttattctaaacataatacataccaagtgtggttaatatttactttagtacttgacaagagtctcttttttatgaaactgtgattaattggatgacattttcccttagaataccataatatgtaatgccttttttccccctccccacccacatttctagcatataacagaccaacaaggaagatctccattaaatatttgtgaagaaaacaaacaaaacaactgggaagaagctgcaaaattgttgaaggaagcaattaacaaaccagtaagaattatcttcatagttagagccaggcatagtatttaaattaataagatttaaatttgaggatctgtggcaagagtggaaagacgattagatggcttctttactgctataaaacctcattgtaggccaggtatggtggctcacacctgtaatcccagaactttgggaggctgaggcaggcagatcacaaggtcaagagatccagacatggtgaaaccccatctctatgaaaaatacaaaaatcagctgggcatggtggcgtgcacctgtagtcccagctactcaggaggctgagacaggagaattgcttgaacccaggaggtggaggttgcagtgagccaagattgtgccactgtactccagccttggcgacggagcaagacttcatctcaaacaaacaaacaaaaaacctcattgtagactgcattatccctaacatttggacatttattcttgcataacaaaataaaacttgcaaaaataagtaaataaaactttcaaaacacttaaaattttcatataatttctatgcttgatgtgttgattacacataattttttttttgagatggagtctcgctctgtcacccaggctggaatacaatggcgcgatctcagctcaccgcaacctctgcctcccaggttcaagcagttatcctcagcctcccgagtagctgggattacgtgcgcctgccaccacgcccggctaattttttgtaattttagtagagatggggtttcactgttagctaggatggtctcgatcacctgacctcgtgatcctcccacctcagcctcccaaagtgctgggattacaggcgtgaaccaccacgcccagcctgattacacgtaattttaatctattcattgtcacatatccctatacttaggtctcttaagcaacattttatatttttaaatgaaagcattgcacatcattcagtctcagcaagttagtttatatataacagactcattttcctcctcataaaagtaaaataggtgtttccaagcttttttattctgctaactcaacctggcctttccatctaattacaactggaaataaactcataaatcgaaaatgctggcatacatagctattaaaataataattttatttagaggcataaagctcaaattagtgacattaaaatacagaagaattaacaatgagaagaaactcaattatgcctaagagttataatgattataaaaattattaatttaattatttttatttttatgagacagggtctcactatgttgcccaggctggagtacagtggctattcacagacaatcgtgatgcactgcagcctcaaccttctaggcttaggccgtcctcccacctcagcctcttgagtagctgggactacagacgtgccaccgctcctggctgtcattagtttaaaaactgtttgaaataaaaagatttataccaacaaataaaggataaagggtttatactaacagatataacccatttacctaagcctctccaggcattaaccaacaactatgcaataagtatttgttgagtatctctttggatttaacatgacaaagtgctgaaaattagaaggaatatatggtctctgcctttaatgttacacacataccacacacgcacgcattttgtcaaaacacttactccaagagcataagacagagtcaaggaaatagacaagcagtacaggtacccttatgttatacttcattgcaatttattttctaactatgtagtgttaactcatttttatccctgatataatttttatattgtgaatgaataaggtaggaggggtgaagttcttttatccaaagtgaactggcctggaagttatttggggacatcagttacttcctataacaataaaaatccattgagaatgctactactttctggaattttctaaactgggggaaggaaactggctcaaagttcattgataacttttacctgcaaagtgttccatcacaaattcctcttaggacaagttactggtggtacacatttctgttgtattatatgtgacccactagactcgtgaagtacttgacgaacactagattcagtaaccaagtttgtatctctcgttatgatatttacattacattaaaggcgctaaaacatcctgtcaaaagaatttgacattgagtatgtttttaagtcattctccttagtttactaaacttatttctggaacatccagaagaaaatattttagaaaatacaagtaatggaagtaaaattttttttttttttttttttgagatggagtcttgctctgtcacccaggctggagtgcagtcgcgcaatctcagctcactgcaagctcctcccggggttcacgccattctcacgcctcagcctccttagtagctgggactacaggtgcctgccaccacgcccagctaattttttttttttttttttttttgtatttttagtagagacggggtttcaccatgttagccaggatggtctcgagctcctgacttcgtgatccgcccgcctcggcctcccaaagtgttgggattataggcgtgagccaccgcgcccggccagtaaaatgtttttaaaatatcaccaacagattctcacttaaaacagtgtttctgatatttttcatgttagaaatctataataaagcacatgaagttgaaggaaagtatcttgttagattgtgatgtataattttttaagttcgttacgtaagttatcgtttcttgtagtatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagtaagaaagtttttattatgttatagtaaacctcattattcctttttgggagtgggttggtagaaaatacaacttctttttattcttgactcttaaattttgaaataatacaatgttcttctcttttatataaattactagtgttcaaactgctgaaacaggtaagtccctgcccaccccgttccctgcttcattcaaagcattttttaataattaaaaaacaaaacttttcttctatggcaatggcatttgatttgaatgccattaaatgttgtgctaatgcaacttgcctttattttttgtgttcattttgaaataatacaaatgttcttttctcttacattagttttctatttaaaatcaacctttttatttaaaatcaacctaatgactatatatttgttcttcaaagtattacacatacataaagaatttgatcgatgtgattggttatttaatggcttagttgtatctttttaactaggaattctacttatgtcataattaaataggctataatggaattaaggatttcatatacatttgataaattttatgtaagaattatttttaataattcttatattcttgataataagcagttaaccacaaattgggtagtcatattgattaaaatgttaattttagatttaaatttaatttgtgagtattcagtacagaagtgcagacagtttaatacaaagtttctatgcattgatataattgactttttacattatcatttataaaaggaatgatgtttttcaggccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacaggtttgcttggaaatcttatttacagttatttaaatgcacaaaatctgttgagtttctattgtaagcactagaggcagaaattgtgcttacatccttaaatcgatccttacatccctgtgataattggcggagtttcagttgatctacttacaaagcccttggttgggatttttcatttccactcccattgtcttaagaatacaaaagaaatagggagctatcctaaagaaaattagcaatcagatgtggagccaaattatacaggaaaaaaaattgtttagactagttaggaagtacactgtcaaggataaacttaataaagggctaatcagttgtatacattttgaaggaagaaagagaaacactggtgtggaagagaacatcctgggtggataagattatacttgcaaagggaagaatgcgaaagtcattctcaacagtccataagtggctcatctttttttttttgagactgagtcttgctctgtgtcccaggctggagtggcacaatctcggctcagtacaatctccacctcccaggtttaagcagttctcgtgcctcagcctcccaagtagttgggattataggcgtgtgccaccacacttagctaatttattttgtatttttagcggagacggggttttgccatgttggccaggctggtcttgaactcttggcttcaagtgatctgcccaccttggcctcccaaagggctgggattacaagcgtgagccactgtgcctagcctaagtagctcatcttaactcaaacagagaactctatacatagtaaaaaatgagaatagtatttacatttgatgaaaagaagtctgtctagacaagtatatttggatttgaactactgtggattttagagaggaagaagtgacataatgccataagaaggatgaatggaccaggcacagtggctcatgcctgtaatcccagcactttgggaggccaaggcgggtggatcacgaggtcaagaattcaagaccagcccggccaagatggtgaaaccccgtctctactaaaaatacaaaaattaggcatggtggtgggcgcctgtaatcccagctacttgggaggccaaggcagagaattgcttgaatctgggaggtggaggttgcagtgagccgagatcgtgccactgcactccagcctggatgacagaatgagattccatctcaaaaaaaaaaaaaaaaaaaaaaaagaaggatgaatggacaagggagagattataacagcttaaattaggcatgataatctaaatatggtgaaattgtttcacagtcttacaatgttagtgaagaaaaaaatagaatacatttcttaattctttattctcagggaatattaaacaaacacagttaaacaaattttggcacaagaaaatttcaacagccatgtccaaacttggtaaacattttgtacataactatatatattgctccttttatattatcaagccaaagatagagtagatcctctcagccaaatatactaggagtcacataaaaattgctatgaaatttaccaaaaactaaggacttcattatttgttaaaaatgtgttagaatcacattaatagaatgaaagggagggaagaaaacacatgatcatcttaattgatgcagaaaggcatttgacaaaatccaacaccctttcatgatttaaaaaactctcagaaaactaggaatacaagcgaacttctcagcatgataaagggtgttcatgaaaaacccacagctaatatcatattcaatggtaaaagactgaaaactgtcctcctaagataaggtacgaaattaggatgtccactttcaccaataatcaagaccttagtttttggcaaatgacgtatacataggaactcccaaagaatccacaagaaagctagagctactaaattaattcagcgaagtttcaaggtataagctgaacacacaaaatctgttgtctatataccagcaaagaataatacaagaaagagattaagaagtccattaaaatagcatctaagaataaaacacccaggaataaatttaacagaagaagttcaagacttgtacactgaaaactataaaacattgctgaaaaataagacctgataactggaaagacatctccacgttcaatgataggaatagttagcatcgttaagatgtcactactagcaaagtgatctacagatttaatgcagtccctaacagtattccaatagctttttttgtgaaagtggaacagacagtactcaaatccacaagaattgcaaggggactcaaatagccaaagcaatcttaagaagaatgaagttgagagattgacattactcaatttcaaagcacaccacaaagctaagcaatcaaaagcattgtggtactctagcataaggataaacatacagaccaatggaatagaattgagttttcagaaataaacccatacatatacagccggtagacttttgacaaggctaccaggttcatctaatggagaaagaatagtctcttcaacagatggtgctggtataactgtaagttcacattgcaaaagtaggaaattggaccccaacctcatgccatataaaaagttaaaatggctgggtgtggtagctcacacctgtaatcccagcacttttggaggctgaggcgggtggatcacttgaggacaggagttctagaccagcctggcccacatggcaaaaccccatctcttctaaaaatacaaaaaattagccagccatggtggtacacctctgtagtcccagctacttagaaggttgaggcatgagaattgcatgaacccgggaggtggagggggcagtgagccaagatcacaccactgtactccagcctgggtgacaaagtgagacttcatctcaaatattataataataaaaataaaatgcatcagtgacctaaatataagtgctaaaaccataaaactcatagaagaaaacaaagggataaatcttcatgaccttggattaggcagtggagtcagatatgacaacaaaagcatgaacaacaaaagaaatattgggtaagttaaacttcatcaaaatcaaagacttttgtgctttaaaggacattattaagaaagtgaaaagcaacagaatgggagaaaatattagcaaatcatagataagggtttactatccagaatatataaagaactcctacaactcaacaataaaaaggccaacaacccaattaaaaatgatcagggttcggtgcagtatctgtaatctcagcactttgggaggctgagatgggaggatcatgggaacccaggaatttgagacatgcctgggcaacatagtgagacttcatctctataaaaaacttaaaaaattagccaggcatggtggcacacactgtgtaccagctactcaggagactgaggtgggaaggttgcttgagtctgggagggagaggttacaatgagccagtattgcacgactgcacaccagcctgggtaatagagcaagactatctcaaaaaaaaaaaaaaagtaggccaggcgtggtggttcacttctgtaatcccagtgctttggaaggatgaggtgggaggctcacttgaggccaggaatttgagaccagcctggctgcatagtgagaccctgtctctacaaaaaagttttgtttttgtttttgtctttgtctttgtttttttttaatagcctggcgtggtggcacacacctgtggttctagctactcaggagagtgagacaggaggatctcttgaacccaggagttcaaggctacagttagttatgatcatccactgtactctaggctggatgaaagagcaagaccctgtctgtaaataaaataggtcgaaggacttgaatatataaatagccagcaaacacatgaaaagatgctcagcatcattagttattagggaaatgcaaattaaaacctcagtgagaaaccacacccactaggatggctataaaaaacaaaacagaaaataatgagctggtaaaaatgtatagaaattggaaccctggtacattgcaggtgggaatgtaaaatggtgcagccactgtggaaaacagtggttcttcaaaaatctaaaaatagaattactgtatgatccagcaattccactcctagatatatgcctgaaataattgaaaacaaggactcaaacatattcgtatgtcactgcagcattattcataataaccaaaagggtagaggcaccctaagtgtccatcaacagatgagtggacaaacaaaatgtgatctatatatacaagtagagtattattcactgatacaaaggaatgaagttatgatacatgtgacaacatgagtgaaccttgaaaacatactaaataaaccagacacaaaagaacaaatatttaattctacttatatcaagtaatctagaataggcaaaggcataaagggaaaaaatagattggaggttatcagaggtgctgggctaggggaggggtgggaagttcttaccagttagcagaatttctctttgggatgatataaactatgtggaactagatagtagtgatggtagcacaatgttgtgaacataattaatgccactgaatttcacactttaaaacgggtcaaatgacaaatgttatatctgttttaccctataacttaaaaaatgtatgatagctataaaatctgcatataatctaagtatactcagtctgccttctcctcccaagtaatattgtaatagttcactggtagagaagaggagcagtaatgataatacttgggtgataaataaattgcataattataaaataaaggagactcaagtaaaaaggaagcaaggcttagtaagttcttatggtaaaccagaatgtcatgataatctggtaaggcagttgtgttctttcactcattatataattaagaaattcctgtttgtaccatctgaaaaacagaattacacttactgtttagcatcatccttttaggatgaaaacatcctgatttcattagaaacgaaaaaatggtgactaaaactcattgaacatggtattggaaattgtaactgttattatctactcatattcttcaaatatacgatgtcagtttttattagaaaataggctttcattcagtctttttccattttattttgagaaatttgaaaagccataggcatattaaaaagtaatacagtttacaccatttaccattcattagatcacaagttgttaacaatttggtttagtgtatttactttctttgtgaaccattttaaactgagttgcaggtgtcattcctacatattttgacgtgcatcttctaagaataaggacatctctacctaccacaataacatttccaacctaataaaattaataattccataattacataatatctgattcaaattcagatgtttcccagttgtttcaaaatacttttatacctcccagccccgggatctagtcaaggctcatgctttatatttggatgtctcttcagtctcttttaatttagaacagtccccttcattttttccccatgaaattttttttttaatatttaataatagagtattttaattaattttaaatagagtattattaatatttaataatatagagtattttaagatagaaaaatagtattatttcagttaatgttgcaaaaatcttttttttttttttttgagatggagtctctttctgtcacccaggctggagtgcactggtgcaatttcggctcactgcaagctccgcctcccgggttcacaccattctcctgcctcagcctcccgagtagctgggactacaggcgcctgccaccatgcctagctaattttttgtatttttagtagagacggggtttcaccgtgttagccagcatggtctcgatctcctggcctcgtgatccgcccacctcggcctcccaaagtgctaggattacaggcgtgagccaccgtgcctggccgcaaaaatcatttttattcaagcttgggatcgttgtgaattgtatttggaaatactttaagtatttattcagaaactttataaccggtgactttgtacaagtaggaatatattctgtaggctaggatttctcaaatctttattaatcttattggataaactttatagttttaaaaaaaaaaaaaaagatctaggccaggtgcagtggctaacacctgtagtcccaacactttgggaggccaaggtgagaggactgcttgagcccagcctaggcaacatggcaagaccttctgtcttcaaaaaatttaaaaattagccaggcatggtgttgcacacctcttttcccagctacttgggagactgaggcaggtagatagcttgagcccacgaggtcgaggctgcagtgggccatgttcatgccactgcactccagcctggctggcagagcaagaccctgtctcaaaaaacaaaacaaaaatttactcttcttgaatattattaatatttgaaagtgcaaagtctttttagtcaaaatttaaaatgtcttacaacaggctttttaaaaatgcatttgtcctttggaaattaagatacttccttttatcttctttgaagtccactactgtattgtatgaagcatagttaatagaaaaatgtttcagtcatacaaaaatttaggtaaaattttgctaaaaattatccatatttataaactgatgataatatttgttagacaaccaggtcagcaaactatagcttatagccatattttgccaatttttgtatacctcacaagatgattttttttacgttttttgattgttaaaaaaaataactatttcctatcagcgaaatattttgaaattcatatttcagtattcctacataaagtgttattagaacactgccatacccatttgttgatgtatcacctgtggctttctttgtgctacagtgccagagttgattagttgcaacagcgattatatagcttacaaaacttaaaatactactctctgggccttaataaaaaaatgtttgccaacctctgctcaaaacagtaacagctcatttatatacaaatatgtagcttttgcttttcccatattaagttgttcatttgtaaaaagaaattgtagcctaataaccaaattatactttttcctttaagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaagtaagtatttaatattatgcatggtcttgtgctatgcttaagattctgtttaaccaagaaagtttaaaaatgttattagaaaatatttatacattacattggtttggaattaaataatataagacatagaatgagaaaaaatattatactaaagcattcttaaagttatactctccaattttacttttcttatatttgactatagtttgatatactttatatttttctttatctttctttatgcttaaataagttcactaaaacctgactcgaataagtagtaaaacattttataaggcagatgtacttaagaatcccaccataaaaactagttttatgttcagtctttgagagaaaacactgaggttttaagcatatctgaatttggttattgtggttttcaattttcaaaaatattttctggttattgaaagaagaaacatttatctaaattgataatatgagatttgtggctttttgcttaacatttttagagttctctgatattttacagcaaaatatttttcaggttaaaaattacgttactgaaagccatttgtaacagaatgattactatactttagctactaaagatgatttatttaaaggatgttggcatgtgtgcttacagtgaagaaaatctaaaatccatcgtacctgttaccaaactgaaaagtaaggcacctcactggacaaatcgcatacttcatgaatacaaggtaagctgtttaatagaaatgaaaagacattttataggctagttgaaactttgttagtgttataaatattttaaacagaggtagattaaatttatagtcctgaaattaaaaatgtatcttctagttcacaatgcttgaaattgaaagtagcaagatatttttatttttagtaatatataatcttttactgaataccttcaacatgccaaatactgtggtaaggactaaagataaaaatttgaaataatatactatccatgcccgtgaagcaattaaaacccaataacatagacagtatttttagacctcaatttttttttttaatattaacatcacaagagaaaaagtactcctgatacaatgtgccataattttattctttaggggcaatcttgattttagaaactgcttagttgatctatttggattatcaatggtacattttcctttcatatctcttttatttttaatttaccttgtttgtttttagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggtagattttcagctcttttttaccaatcatgtcatataatagttaaaacaacagtaccaacctacatgaagaatttagaaatggcatatatacaagactgttcattgcaactcattcattacataagaggaagggggacactaaatcactgtcagtaaggcgttaatattatattacatttctgcattagaatacccttcagccataaaaaagaataaagagtatttttgtgtagaatgatctgcaagatacatttaatgaaaaagcaaggtgctgaacaatatgtaatatgctgcctactcttgctattaaaatgggaggaaatgaggatgatttttacataaatacatattgcttgtatatgcataaaatatttcttgaagcctttagagaagggaaccaggtaactaggaataaaagtaaggagggaaacttttcattacatacctatctagttcaggccactataacaaagccctatagactgattggctaatgaacaacagaagttttatttctcacagttctagaaactggaagtctgagatcagcgtgctagcggggttggattctagtgagagcgtttttctgggttggagactgctgacatctccttgtagcctcatatggcagaaagaatgagggagttatcttggggtcccttttataaaggcatgaatcccattcatgtgggccctgctctcataaattatggcataattacttctcaaaggctctacctcccaataccatcactttaggagttaggatttcaacataccaattttgggaggcaggacacaaacattcagtccataacaatgccattttgcaacttgaaagttttaactgtgtgattatgttgcctgtttaaaacatttgttaggttaattgaaaaagatgaaaaaaagaaaaatattatatgtgacacaagggcttcactttgaaaaattagaattagtacaagaaccttttggggagcaggatgaagtatggaagggattgaatatccactagaatacttcagagcttctttcttgttttttgtttttcacatttaaacatttttttatttatgtatttattttttgagacagggtctcactctgttccccaggctggagttcagtggtgcaatcatagctcactgcagctttgaactcatggactcaagcaatcctcctacctcagcctcctgagtagctgggactataggcacgtaacaccatgcctggctttttttttttgttgttttttgttttctttcagagacaggatcttgttatgttgcacagtttggtctcaaactcctggcctcaaatgatcctcctgcctcagcttcccaaagtgctgggattacaagcatgaaccactgggtcccactcatttttttaattgatacatagtagttgtacatatttatgaggtacatgtcatattttgatacatgcatataatatgtaatgatcaaatcagggtaattaggaaattcatcaccttaaatatttatcatttctttgtattgggaacatttcaacttatctcttagctattttgaaatatacaataaattattaactatagtcaccctagtgtactatgaaacacggcaacttattcattctatctaactgtatgtttgtacccgttaactgaccctctccttattcctaccctaccctacccttcccagctctggtaatcatcattcaactctctacctccttgacatcaacgtctcacgtatatgagaacatagggtatttgactttctgtgcctggctgatttcacttaacaaaatgacctccaattccattcatgttgttgcgaatgcaagatttcattcttttttatggctgaataatatttcattgtgcatatataccacgttttctttattcattcatctgttgggagacacttaggttgattccatatctttgctattgtgaatagtgctgcagtcaacatggggttgcaggatcccactgatttcctttcctttggaagaatactcagtagtgagattgctggttcatatggtagttttatttttagtttttgagaaacctctatactgttttccataatggctctactagtttatattcccactaactctgtataaaagttcccttctgtctgcatcctcaccagcatttgttatgtttttgtcattttgataatagccattctaactggggtgggatgaaatgtcactgtggttttgacttgaacttccctgatgattactcgtggtaagcattttttaatatacttcttggccatttgtatgtcttcttttgagaaatgtctgttctaatcattgcctactttataatgggatatgtttgtttgctgttgaattgtttgatttccttgtaaattttggatattagtccctagtctaatgaacagtttgaaaatactgtctcccattcaccacattgtctcttcactctgtcgattgttacgttagctgtgcagaagcttaatagtttaaatagtcccatttgtctgtttttgtttttgttgcctatgcttttgaagtcttaaccataaaatctttgcctagaccaatgtccaaaagcatttcccttatgttttcttctactagttttataggctcaggtcttacatttaggttttttatccatattgacttgatttctgtatatggtgagagatggagtctagttttattcttgtgcatgtgggtatccaatttttccaacaccatttattgaacagggtgtttttttccccaatgtttgttcttggcacctttgttgaaaatgagttggctgtaaatacatggatttatttctgggttctctgttccattgagatctgtatttacaataacatcatgctgtttggttactgtaggtttgtgtagtttattttttgaaattagatagtgtgatgcctccagctttgttctttttttctcactattggtttggctatttggaatcttttgttattccaaatgaattttagaatttttttttatttctgtaaagcatgtcattggtatttcaataaagattgcattgaattacttgattgctttgggtaatattgctgttttatttttattgattgattgattgattttgagatagagtcttgcttcatcacccaggctggagtgcggtggcgtgatctcggctcactgcaacctctacctcttgggttcaagcagttttcctgcctcggcctcccaagtagctgggattacaggcttgcaccaccatgcccagctaattttttttttcttttgtatttttagtagagacagggtttcactatgttggccaggctggtcttgaacttctgacctcaggtgatccacccacctcggcctcccagagtgctgggattacaggcatgagccaccatgcctggcctatattgctattttaacaatattaactcttccaatccatgagcatggatatctttccaattttttgtgtgctcttgaatttcttgcatcagtgttttgtagttttcattacagaggtctttcagttttttagttagatttattctcaattatttgattttttttactagctatagtaaatgagattgctttcttgatttctttttcagctggttcattatcggtgtatagaaatgccacttatttttgtatgtgaattttgtgtcctgcaactttattgaatttgttttatcagttctgttagttttttggtagagtctaggtctttctgtatataagatcatgtcatctgcagagagggacagtttgacttcctgtttaccaatttgtatggcttttatttctttctcttacctgatgctctctctaggacttccagtacttccagtactatgttgattaagagtggttgaaagtggggtatccttgtcttattctagttcttataagaaaggctttcagcttttcccctttcagtatgatgttagctgtgggtttgtcatatatgtatggcctttattgattgaagtatgttccttctatgtgaattcgctgagaggttttttttttcatcacgaaacgatattgaacttcatgaaattctttttctgcacttattgaaactattatatggtttttgtccttcattctattgattgtatcacatttattaatttgcatatgttgaatcatcctcacctcccgggcataaatcccatttgatcatggtgtgttatctttttgatgtgttgttggacgcagtttggtagtattttgtgggtgatttttgcatctatgtttttcaggactgttggactcttgttttctttttttgttgtgtccttgtctggttttgttattggaatgatgctggcctcgttgaatgagttaggaagaatcctcttcagttttttggtccattttaagaaagttggtattcttcattataggtttggtagaatttagcagtgaagtcatctggtttttgtttattgagagactttttgttcctgattcaacctcattaccgagaatttatctgttgaggttttcttttccttcctggttcaatattggtaggttgtctgtgtccaggaatttatctttttcctctaggttttccaatttgttagcctatcattggtcctaatagtctctaaggagtctttgttatttctgtggtctcagttataatgtctcttttatcatttatgattttgtttatttggattttctttctctcttggttagtctacctaacagtttactcattttatctttttgaagaaccaacttttcgttttgttgatcctttgtaatttttttcttttttctttttttttaagtctttctttcttttagttctggtctgatctttcttatttctttccttctgctaatttcagggttggttttttcttgcttttctagttccttgaggtgcatcgttaagtgtttgagatcttcctacttttttgccatagatgttattgcagtaaactttcctcttacactgcttttgctacatcccttaggttttggtatatggtgttttcattttcattgcatttgagaaatttttttatttccttcttaattttttaattgacccagtggtcattcaggagcatgttgtttaatttccttttatttgtacagttcccaaaatttcttttgttactgatttatagttttatttcattgtgatctgagaagatacttttacaaaatttgttgggacttgttttttggcctaacagatggtgtatcctggagaatgtgtgttctgcagctgatggatgaaatgttttgtaaatgtctgttagatccatttatttatttatttgtttgtttatatttttttagagacagagtcctgctctgtcgcctaggctgaagtgcagtgagcaatttcagctcactgtaaaacctctgcctcctgggttcaagcgattatcctgccttagcctcctgagtagctgggattacaggcatgtgccaccacacctggctaatttttgtatttttagtagagacgaggtgtagccatgttgcccacgctggtctcaaactcctggcctcaggtgatccaaccacctcggcctcccaaagtgctgggattacaggcgtgagccactgcacctggctgttaaatccatttagtctaaagtgcagtttaaatccagtgtttttttgttaatttattttgatccattcagtgttgagagtggggtgttgaattccccaactattattgtattggagtctgtcattccctttagatctaataacaatggcaaaaatcgcagttatttttgcaccaacctaatataaagctttttttttttctttaacttttagcattttaaacacatcatcccaggctcttctggcctgtagtttcttctgagaaatctgttgtttgtttgatggcaatgtccttatatgtgacctgatgcatttatcttatggtttttagaatcctcttgttgtctttgagttttgacagtttgactataacatgccttgggaaagacctttttaggttagatctgcttgggtatctttgagcttcctgtatcttgatgtctgcatctcttacaagacttagggagttttcagctattatttcttcaagtaggttttctttgactttctccatttcttctccctctaaaatctcagaattcaaatgtttggtcactttatggtgtccccacatgtcacattggctttcttcattcttttttatttcttgatttctttctttttttttttttttttgtctgcctgggttaagataccttcgggtttacaaattctttattctgcttgatctagtctattgttgaagctctcagttgtgctttttatttcatttattgagttcttccattccaggattatgtacttttgttatcttatatgtcttaagtcacactgagtttctttaatgtcattttgatttttttgttaggcatttcaaaatttggggggagcatctgttactgaagaattattgttttcctttgaaggtgtcatgttttcttgcttttcaatgttttttgtatcgttatatttatatctgtacatctgatgtcacttcttcctattttatgcattggcttttgtagggaaagactttttcctgtagatgtagctatagtgttggttggatagggtgctttggctttgattctgggtgagtgcagtagtatagtctccctgtgatttcttcagctttaatgagcattagcggtgtctgagagtccctcagtggcttagactgtggttgttaatgaaggctgtagtaggcttttctggggactgtgactccaggtagaccagtgctcaggcactagtagttgtgccagtaggcagggcatgcctttcctcaggcccctagatagtacatgtgggcgccagcaggcataggcagagcataacagtacttaaggccccagatgaaatgcacaggcaccaacagcaggcagaacaggcctgtcgtcaggccctctgatggtgtatgcaggcaatggcagcagcgtgctagttgagtcagtcctcaggcccttagatggcatgcttaggcacagttgacagtggcagtgggcagagcaggcttgtccttaggaccctagataatgtgtgctggtggcagtggtgggcagggcaggcttctctccaagcccacctctggagtttgcaggtgctggtggcaggcaggtgggttgacctcctggcactatgtgcacaggtgacagcagcagtaggtgggttagacccttttcaatcccactttagagctcttcagttagaagttagtttatggtgctcctttttctaaccgtaagtcattataaaatacaggtttatcagttattttttggcatatttaacacatttaaatgggatgaacagctttttagtttataataggaagctaataaaaatcaaatctaatttgtttcattttgttttgttttttgagacagagtcttgctctgtcacccaggctggacgcagtggtgtgatcttggctcactacaacctctgcctcctaggttcaagcagtcctcccgctttagcctctcaagtagctgggattacaagcatgaaccaccaagcccacctaatttttgtgtttttcataggggggtttcaccatgtttgccaggctggtctcgaacttctgacctcaagtgatccacctgcctcgtaatttgttaattaagatttgttaagaatagaccaaatcagttaaagtaataatgaagcttatgcatttttaaaaggcatttagattaggaaatttcactgtaaacccagtttttattttcctcatttttatgtgtcttttttgttgttgttgttgttgagatgagtttcgcttttgttgcccaggctgcagtgcaatggcgtgatcttggctcactgcaacctctgcctccggggttcaagcgattctcctgcctcagcctcccaactagatgggattataggcatgtgccaccacacctggctgattttgcatttttagtagagagggggtttctccatgttggtcaggccagtctcgaacacctgacctcaggtgatccgactgcctcgccctcccaaagtgctgggattacaggtatgagccaccgtgctcgcccctttatgtgtcttgataggtctttataatcacataactcctgaaatatcccagtcatagtttagtcattttatattaattttcagggttatctttaagggcaacagttactttgatagatacacacgtgaatggagataaaatatctaggaacatagggtggaatagagtctgattttagtaatgacctggagcttaatttcttgaagtctcttctagcaggggtccccaacacccaggccatggactggtaccggtccatggcctgtaaggaaccgggccgcacagcagatgagcagcaagcaaagcttcatctgtatttacagcactccctatcacttgcattaccatctgagctctgcctcctgtcagatcaacggtggcattagattcttataggaacatgaaccctcttttgaattgcacatgcaagggatctaggtttcatgccccttatgagaatgtaatgcctgatgatctgtcactgcctcccatcacccccagatgggaccatctagttgcaggaaaacaagctcagggctcccagtgattttacattgtggtgagttgtataattatttcgttacatattacaatataatagtaatagaaataaagtgcactataaataaaatgggcttgaatcatcccaaaaccatccctgacacccctgtctgtggaagaattgtctgccacgaaaccgatccctggcaccaaaaaggttgggcactgctctcttgcggtcaccttgcttttgggtcatttgcttatcattttctttttctttccttttttttttttccttgggacacagtctcactcttttgcccaggctggagtgcagcggcaccatcatagctcagtgcagctgcaaactcctaggctcaggcagtcctcctgcctcagcctcccaagtagttgggactacaggcatatgccaccacacccagctaatttttttattatttgtagagataggatctcactttgttgcccaggctggtctcaaactcctggtctgggcaacaaagtgagaccttatctctacaaggtgattctcccaccttagcctcacaaagtgctgggattgcaggtgtgagccaccacaccatcctcattttctgttaaaactattttgcccacacaaaataggctgctgtttattagcttgtaaccacttttctatttctcttgtactaagttcattaaaggaaatgaaggagaaatgccccccaccatttcaagaaatttttcctctgctgtttcagagcattttataccaacatctgcaaatcattcttcatagaactggatggtgatgctgtgccatttctctaaactatattttatgtttgttagctttccaatttttggcaataatacaaagttttatatagtattcaaatgaaggtttagtgatattatttaacacttaaatataacatttcatattatgtataatactttgatccaggattcaaataaatgagttagcagtaacagacagaaggatgacaataatattcttaattaacagtctgctttttccttagataagaggttcagtttcttgaactataaatagaaatgctatccttgggtatctaaacaggtgattgaaccaaagagtaaaggtattttctatccatctagtcattaccttgttctctgtaaaccactgataaatttatggcacctttgaaagctttaagatagttgcatatttcagccgtcaaatgtgggaacaaccagcttgtcctcagttgtcttagattcaccaaggtctactaggattgcattcaacaagcttagcaaaaacatagcaaacaccttcatctgcaaaaataccttcatttgcatttaaaacactacatgggatacattagtgtcagagataggaaaagccatgggacacagttgtgttttttgtgtcagttgtttctaccttctataactacaggctcagtacttttgttggaaatttgacttctataattgagaagtaactatactacagttgtatttttttctgtatattgaactgttttgaagccatattaatggactgttttgtggcttttgaataaagaaatttcaggtgattgatttaaaagagaaggcagtttaaggtagtatgatatcttgactctgttcagtctgtaccttgataagtagctattttagtatatcctcctatgtataaggttatattttacaatataaatgtagatagccatttttaaaagatactattagtttttccttatacttaatgtatactcacataaattacctgtgtttcattcacagaacctcactttatttattttatttatttatttagacggagtctcactgttgcccaggcaggagtgcagtagcgtgacctcgggtcactgcaacctccgcctcccagacagaacctcactttaaaaatcccctaacccattatctttctggcacattcttagtttagtatttgtggtcaatattataagaattggtatttatagaaactgaatgcttctaaacatatgtatcttaaaaatgccatgaacactttctttgtttatatgtacacaaataatacatgtttagggcaagaaaatggaagttactgctagaagagaattgttattaacaaggatatattgaatgtctgcttatatacagtattatattaggaaagtgtaggaatcattaatactgctttataaatagttctgttgttggctggtccatgtgcagtagtgtttacaactctttgatcacaatcaattacagttcttctccactcccactgcttcacttgactatccttaaaaaaatagctctgatgaatttatgaaaggtatgttagtaattttttaaattatgcttacttttataataaatatatcagtgtacttattttcagtgggatgagattgttgaagtaaacatgttaacccagttgcataaactacaatctgaaagtactatgtaaatattcaaaagaaagatactgaataaagagatagcttttaacctgcagaaagaaaataaaggtagtacctttcattatcctgaaagccatggatagaattgacatctttaaaaatgtttgtcaatcttatatgacaaatattgctcacagcactctcctgagagtctaccaatctatgtgattctgtgctgcaggctgtgtgaggttagtgcggggtgctttgaaaaggcttcattaaaacattcttggaaactatcattctcagcaaactatcacaagaacagaaaaccaaacaccgcatgttctcactcataagtgggagttgaacaatgaggaatacttggacgcagggaggggaacatcacactccggggtctctcagggggtagggggctaggggagggatagcattaggagaaatatctaatgtaggtgacgggttgatgggtgcagcaaaccaccatggcatgtgtatgtctatgtaacaaaactgcacattctgcacgtgtaccccagaacttaaagtataataatttttagaaaaagcattctgaactattatatttagagcagacaacataaatgtagatagtaagagaaaataggtgaagtttttaatatgtatttcaatatagttgtttccaattatgttgcaggctttactcatcagtcttaagtatggttgttttatgtggcaattgggagatactgatacttgttttcagatccatagcatggaaaataaaatgagctttatagtacatacaaaacaggtaagtatcatttattttggacttcataaactattgtgttagtaaagttacttctttttttaaaaaagtgacatccatttaacttcaaggaaaacctgtaatatttcatgaaattaaaatatttaagaccaaggaataaagccaggccttctaagcaaggaaaaatcagaaacttacctgaatagtttatttcacttttataacaaactcttttgccatgtcttttcattctggtcagtattacctgtctcatctatcaagttattaggtagtccttccctgtccttgacctacctgtgccccctagctgtatccagcagattgattcttaagtcacttcaaaaagcctgagtaaatatccccctctatactctctcttaacaagctgtctcctgataagaaagttccctttcaaatagatagggaactgcccaatgtcatgaatgtcctttaaagattcttacatgttttatatttattattgacatgttttactttgtaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctatttggttaatgacatcatcgaactgcattcagttgcttagcctggaaatactgttacggtgttcagccgttccccaacttacatattttgtggatcaaagtcctgtctgatgttttgggagtcctttctcatttccttcctccctgcttgcactgcagccagtctagttcaagtcctcaccatccattctttagcttgtagtagcttcctacccctgactcaggctctgtacccttcctgcctatctgccacactgatgccaagttaagctttctcatcagtccgattatttcattacactgtgaaaatcattaatggttaccactatatgtagaattaaattccgaattctttagtattgaaaccaaggcccttagtacactgttgctaagctgcctatcaagattattgtctaaccacttctcccatactcattctatgctcccactgtttcctaactcctcagtcatgtggggaaattcagtactttctgattcagtaattttagagtgagacccaagcatttctgttcttgaagtattctgtgtacttactatgtacagttaggaattagaactgtaattataagcaactttaggagatagccgaatgtgt

SEQ ID NO: 17604 - DNA, 15861 bp, Human
tcccagctttccaggacctctcctccaaatttctagttctgagaatcccaacctaatccgtttgttcccctagatcgaggcatgatgcctacttcctaaaggctttatctctgtgttacctcgttttccctttctgcttttttcagttatccctactggattagccaattccttatactaaattatctctggtgaaatacctagtaaaccttgtgttttccagactggacccttactgataaggcaacatgtcacagaatcatttgacacacaggcataagaagcagaaaaaaaaaaaagtggatctgctaatgcacttttttttttttttgacagagtcttactctgtcgcccaggctggagtgcagtggcaccatctcggctcactgcaacctctgcctcttgggtttaagcaattctcatgcctcagcctcccaggtagctgggactacaggtgcgcaccaccatgcacagctaatttttgtatttttagtagagatggggtcttgccatgttggccaggctggtctcaaactcctggcctcaagtgatctacttgcctcagcctcgcaaagtgctgggattacgggcatgaaccaccgtgcctggccaaatttttttgacatggtctcattttgccactgaggctggagcgcagtagctcaatctcagctcaatggccacacctggctaatttttgtactttttttagagacggggttttgccctgttgcccaggctcctctcaaactcttgagctcaagtgatccaccaggctcagcctcccaaagtgctgggattagaggcgtgagccaccacgcctggccttaatgcactaacttgctcagcctctttggcaaaaattatttctcacagaagtaatgagtagaacagtagttactagaggctgggaaggatagggggatagggagaggttggttaaagtatacaaaattacagctaggtagaaaggataagtgctagtgtttcatagcattgtagggtgccgacaattaacaataatatattataaaggtcgagcacggtggctcaagcctgtaatcccagcactttgggaggccaaggtgggcggattgcttgagcccaggagtttgagagtagcctgggcaacatggtgagaacccctctctacaaaaaatgcaaaaattagcttggcatggtggcatatatctgtggtcccagctacttgggagggaggctgaggtgggaggatcactggaacctgggaggtggaggttgcagtgagctgagatcgtgccactgcactccagcctgggtaaaagagcgagaccctgtctgaaatttaaataataataataatttattatgtattttcaagtagctagatgagaggattttgaatgttctcaacacaaagtaatgataaatgtttgaggtgatgaatatgctaattatcctattttgatcactacacattgtatgtatccaaatatcactatgtacccccataaatatgtacaatcattatgtgtcaactcaaatagttaaaaaatatattaaaagagggaaaggcagaacgcttcctgagagcaaggacctcctttgtcgaggtcagggctgtgtcttcagcaacgaaacactatctgggacttagtacatgcttaagaaataggtgttgattgacagagctcccaagagctccacaagggtccccctaggactgtcacaggttcttgtatgtcggagggagaggtcttccccttcgtctccttggggggaggggaaggtgttggggaacaactgccccttcctctatctccctcgcccctccttccccatggccccctcccccgtccttctacctttctccttcccagccctttccggttctcccccgacccttcacggcacctcttcccgccgctcctcttcccgccgcccctcttccctcgccacctaccgctgcttttcctcccattctcgccccgccccttcccccgccctccccgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccaggtggaggaacgcgaactgggggttgtgggggtggctttgtggagtcagccaccctctttagttcttgcttgggcttcgctcccagctctaaggacacctgccatctagagcgctttctctgttaaagtagattttcaggtgcccaagatgaggagttgagtttttatgtatggtcccaagggaggagatgtgcaggaatgaggaattgtggatgcttacgagaaaggggctttagtccaaccacactggacacctctcttaaaatggagttaaaatgctcacatcttatattaaattttgtatttgttaccccgagttgcaaaggaaaataacatcatgaactattaattaagggttacttccttggccaggtgtagtggcttgggccggtagtcccagttactccggaggttgaggcgggaggctcgcttgagaccaggaattgaagctgcagtgcgctagcgcgacttttattccatagcttcaaagtcctttctcaaccaaccctaatgggaacagaaccaaatgttatttctatgtgcttttggggagaggtgccataaaaaactgaatatcctttctgggggaagtgggatggggacagtttaaagaaggtaggcattagaggggaaaatagaagatgtggcctggataaatcccaaactggattttaaaacatccttatgaagctggatgtggtggctaatgcctcaaattccagcactttgggaggcctaggcaggaagatcgcttaagcccgggaggtcaagaccagcctgggcaacatagcaagacttcatttaaaaaaaaaaaaaacttcatgaacaataccttaccttgatcctatactgtaaaatgtctatgctttcttcttacagcctctctgatccctcaatttggtctgttttcaaaatatagaacggtaagtagcaaaccacttctactgtttctactaatacagtgaagcccaaaaccgtttgggagggaggctggctttcaggtctgacctgccacttttgaaaccattgaggactgcgtttaaaaccaggttgtcaggcaggccttttgattcagataaaagtgtaagttttagttgaaaacagctcagtctttgtgttaatatttcctttaaagattcaaaaggtccttagaaaaagttatgccttgtactagatattttatgtactttatcaaattaaattctgaggatgtaaatggagaccaaccaaatgagaacaagcaaaggctatgtttttcagggcttgttatagcaagagagtcagccactgtcacttgcatttgagtagggactcgagtcaaagagaggagtgggaaaactatagtggaaaaaaggaatggcttcaggtatggcctgattggaggctgttggcacagggaagctgtaggtgagctaactagaagcacaacattctatggtatgggttaggggtgtgtatttggttttctctggttgtcctaagttggaatcaaggacagaaattacggaagctgtcagttagtaatcaaatcctaaccattttgcagctgggcgcagtgactcacgcctgtaatcccagtgctttgggaggccgaggtgggcagatcacgaggtcaggaaatcaagaccatgctggctaacatggtgaaaccccgtctgtactaaaaatacaaaaaattagccaggcatcatggcacgtgcctgtaatcccagctactgggaaggctgaggcaggagaatcacttgaacctgggaggcaaaggttgcagtgagctgagttcatgccactgcactccagcccagacaacagagtgagacttcatctcaaaaaaaaaaaaaaaaaagaaaaaaaagtcctagccattttgggctgattgttaaaggggttattgttttgcttcctggactgtcactagagatagcagtctgatttccttcaagtctggcttatagccggctggcctcctggcctggttattctaaataatggtttgggttcctggacaggatgctgcaggttgtgggtcagagttctgttttatataaggactagtcattgtctgtatatttggtctctcaattctcacaatgatgttgtaagatagacattatttgacatatgaggatattgacttcagcaggttaactttgagcattcagctcagagtaggcttcttccaggaagccttcccacgcgattcccttcctctagagatgtagatatgtatacacacacactttctctgtgcttacctatactgcatcatcatcaccatcataataataaatacttagatacctacatgccacaccagtgttctaaatgcttcatatataataactaatttcatctttcacagtactgtgaggtagggatcattatttcattattatccccttggccaaggtcacatggaagtggtggagctatgcttctcatccaggcagtctgactccagatccagtgcttttctctaccctgtcacaacattaggttgtaattgcctgtttgcctacgtcctccaggaaactgtatgcatgttgtcaggtataatgtcttatttgctatttgttgctcagtcttcagcatctcacagatgcccaataacacttttagtcagtgattcagtttgcttgggtttgattttcttttagaaaatgggagttatggtaccttcgtttcaaggctgggattagggtaaagtgagtgagttcctacatgtagaatttaagaaggcactcacgctcaggaggcaaggcaagtgctgcaggacctgctgtctttttttgttttttggagacggagtcttgctttgtcatccaggctggagtgcagtggcgagatctctgctcactgcaacctgaggcctcccgggttcaagtgattcttctgccttagcctcccgagtagctgagactacaggcatgtgccaccacgcccggctaatttttttgtatttttggtagaggcagtgtttcaccatgttggccaagctggtcttgaactcctgacctcacaggatgcacccaccttggccttccaaagtgctgggattgcaggcatgagccaccgctcccggcctggacctgctgtcttttgacaagattgttaaaaggatgactcacacaagagatctttggtttggctggtttttgtgcagtggtgtttacaactaattgatcacaaccacagatttctctgttccttttctattccactgcttcgcttgaccagtcttaagaaaaaagggagagagacagagagattgatctttggtttttcttccttatttccattgccactgctctaatttaggacccccattatctcttacctagattagcatagtggcttttcaatgggttttccccatccttttggtatcttcactttccacttcctgctacacactgctgcttcaattagtctctaaaacctcaactgaatgtagcatgtctctgtgcaaaatcttcaaggacttctcattgcccacagagaaagtctaacctcatcgacacagcctacttttctacctgtaccttctggtgctttctcatagtttatcctcctctatccttagtgccacacttttttttttttttttgagatggagtttcactcttgttgccagggtggagtgcagtggcacgattttggctcactgcaacctccatctgctgagttcaagcgattctcctgcctcagcctcccaagtagctgggattacaggcgtgcactgccatgctcggctaatttctatatctttagtagaagtagggtttcaccgtgttggctaggctggtctcaaactcctgacctcaggtcatctgcccgcctcggcctcccaaagtgctgggattacaagcgtgaaccaccgcacccggcctgattactgtagttttatagtaagtttcaaaatgaggaaatgtgaatcctccaaccttttttttcttagtcaagactgttttggctatttggagtcccttatatttccatctgaattttaagatcaatttgtcagtttctgctgcaaaaaaagatagctaagattttgttggggattccattgaacctgtatatctatttggagagtattgccatcttaaaagtgttaagtcttatgatccatgaacatgggatgtctttctatgtatttaggcctttaatttctttcaacaatgctttgtagttttcagtatacatgtcttacactttgtaaatatttattcctaatgtttttgtttttgttttttgagatggagtctcgctctatcgctcaggctggagtgcaatggcatgatctcggctcactgcaacctctgcctcctgggttcaagcaattctcctgcctaagcctcctgagtagctgggattacaagtgtgtgccaccacgcccagctaatttttgtatttttagtagagatggggttttaccatgttggtcaggctggtctcgaactcctgacctcgtgatctgcccggctcagcctccccaagtgctgggttataggcgtgagccaccgcacctggtctttctagatgttttattattttattttattttattttatttttttgagacagtatctcactctgttatccaggctggagtgaagtggagccatctcgactcactgcagcctccgcctcacaggttcaagtgattctcctgactcagcctcccaagtagctggattacaggttcccgccaccatgcccagctaattttttttcgtgtatatatgtatatatatctatatatagatatatagatataaaatatatattttatttatttattttgagatggagtcttactctgtcacccaggctggagtataatggtgtgatctcggctcactgcaacttccacctcctgggttcaagcgattctcctgcctcagcctcccgagtagttgggatcacaggcacccaccaccacgcccagctaatttttctatttttagtagagacggggtttcaccaggttggccaggctggtcttgaattcctgacctcaagtgatcctcccacctcggcctcccaaagtggtgggattacaggtgtgagccactgtgcctggcctatatttttttagtagagacaaggtttcaccatgttggccaggctgatcccagcactcccaaagtgctgagattaagggtgtgagccaccatgcctggccctagagatgttttattctttttgatgctattgtaagtggaattgttttcttagttttattttcagatttttcattgttagtgtatagaaataaaattgagttttatatattgatcttgtatctttcaaccttgttgaacttgtttattagtcctttttcttttttccaagactgagtcttgttctgtggctcatgctagagtgcaatagcatgatcataacttaatataaccttgaactcctgggctccagtgatccttctgcctcatcctcctgagaagctaggactacacacacaggtcaccacacatggctaatttttaattgtttgtagagatggggtcttgctatgttgcccaggcaggtcttgaactcatggcctcaagtcatcctcctacctcagcctcccaaagtactggaattacaggaatgagccaccatacctggccttgtttattagtaataatagttttgtgtgtgtgtgtgtgtgtgtgtgtgtgtgtgtgtgaatttcttaggaatttctatataacaagattgtgtcatctttgttgtttgtttgtttgttttttgagacacggtcttactcttccaccaggttggagggcagtggtacaatctcagcttactacaacctccgcttcccaggttcaagcgattctcctgcctcagcttctcaagtagctgggattacaggtgcctgccaccacgcctggctaatttttgcatttttagtacaggcagggtttcaccatgttggccaggctgatctcgaactcctggcctcaagtgatctgcctgccttggcctccaaaagtgttgggattacaggcatgagcccctctgtcatctttgaatagagatagttttacttcttcctttccaatctaggtgcattttatttatttttcttgggtaattgtcctggcaagaaacttcggtatagtgttgaatagaagaggtgaaagtggacattcttgtgtttttttctgattttagggaaaagcattgagtcctttaccattgagtagaatgtttgcttaggttattcatggatgccttttattttattttatttttgtttttgttttttctatggatgccttttataaggttgaggaagttctcttctgttcctggttcgttgagtgctgtgttttttgtttgtttgtttgtttgttttttgagacagagtttcacccttgtcccctaggctggagtgcaatggagttatcttggctcactgcaacctctgcctcctgtgtgattctcctgcctcagcctttgtttgttttttttttttttttttgagacggagtcttgctctgtcacccaggctagaatgcagtggcatgatctcggctcactgccagctgtgcctcctgggttcacgccattctcctgcctcagcctcccgagtagctgggactacaggcgcccaccaccatgtctggctaattttttgtatttttagtagagacggggtttcatcgtgttagccaggatggtctcgatttcctgacctcgtgatccacctgcctcggcctcccaaagtgctgggattacaggcatgagccaccgcgcctggccacctcttttttttaaaaaaaatcataaaagagttttggaggttcctttaaactgttaactccaatgccaaccacttctcttgccactgtgcctttgcttgatcaattttatttccttgcggtagacattctcccagccttctatattaaattttaccctttcttcaagaccagcatgtgtatttctcaattgccttattcgaccctaagcttcttataggcaggatccaacttttctttgtctttgtgtctcccgtaacatctgtaaatgagtgattataccagtaaacggtataagaacctttcaggaaaaaagctttagagcagcggtccccagcctttttgggaccagggaccagtttgtagaagacaatttttccatggactgaggaatggggtggggtgggcagagatggtttgggatgaaactcagaccatcaggcgttagttaggagtctcggcagggtgcggcggctcatgcctgtaatcccagcactttgagaggctgaggctggcggatcacaaggtcaggagtttgagaccatcctggccaacatggtgaaagccggtctctactaaaaatacaaaaattagccgggcgtggtggtgggtgcctttaatcctacccatatgggaggctgaggcaggagaatcgcctgaacttgggaggcagaagttgcagtgagccaagatcgcgccactgcactccagcctgggcgacagagtgagactttgtctcaaaaaaaaaaaaaaaaaaaaaagggccaggtgcagtggctcatgcctgtaatcccagcactttgggaggctgaggcgggcagatcacctgaggtcagaagtttgagaccagcctggctaacatggtgaaaccctgtttctactaaaaatacaaaaatttagctggtcgtggtggcatgcgcctgtaataccagctaatggggaggctgagacaggagaattgcttgaacctgggaggcagaagttgcagtgagccgaaatggcaccattgcactccagcttgggcaacaagagcaaaactctgtctcaaaaaaaaaaaaaagtctcataaggagtgcacaacctagattcctcacatgcccatgtcacaatagggttcgtgctcctatgagaatctaatgccatcgctgacctgacaggaggcagagctcagttgataacgctcactggccagccacttccctcctcctaacaggaggcccagttcctaacaggccatggactagtaccagtttgtgatctgatggttggaaacccctgctctagagtataaaggtcagagaattgcttaaaattttatcatatccttctataagaattattttaattcgtaatttttttgagacagtttcgctgttgttgtctaggcgggagtgcagtggtgcaatctcggctcactgcaacctctgcctcccaggttcaaacgattctcctgtctcagcctctcaagtagctgggattacaagcatgcgccaccacccccagctaatttttgtatttttgctagagatggggtttcaccatgttgacccaggctggtcttgaactcctgacctcaggtgatccacctgcctcagcctcccaaagtgctgggattacaggcatgagccaccacgctccgctcttctatgagaattaaaatgacattaaggaataataaatgtgcagtggtcctcttccagagagcggagaggaagttttggggcaatgtctgcccagattgaactctcttcctgtagttagtatcttgtgcggtgaaatttggagtctccatagatgatgaacctgttttgaacatttttcctttggcacaaatttgcttcaattctcaatttcctgctttctttaatgtttttggttaaatgtcagtgccttaaaagttcagattgaaagattagattcctgattttgtcttggcattaaggcaagggattaaggtggaatttaataaacatccacatggagattttagtgaagtgcaaattatgaagctagataataaaaaagtaggtgtggtggcatgtcttagacttgcatttaaaaatcagccagattgaagcctctgaggtccttttttttttttttttttttttttttttgagatggagtttcgttctcgttgcccaggttggagggttggagtgcaatggcgtgatctcggctcaccgcatcctctgcctcccaggttcattcgattctcctgcctcagtctcccgagtagctgggattacaggcatgcgccaccgtgcccggctaattttttattttttagtagagacagggtttctccatgttggtcagactggtctcgaactcccagtctcgggtgatctgcccaccttggcctcccaaagtgttgggattacaggcgtaagccactgctcccagccaaagtcctttttttacataatatgtattgaaccatcacaccaacattgtatctgatttttgcattagaaaatttttttttgccaggcgcagtggctcacgcctgtaatcctagcactttgggaggccaaggcgggtggatcatgacgtcagaagttcgagaccagcttggtcaacacggtgaaaccctgtctctactaaaaatacaaaaattagcggcatggaggcgtgcgcctgtaatcccagctacttgggaggctgaggcaggagaatcgcttgagcccaggaggtggaggttgcagggcgagactctgtctcaaaaaaaaaaaaaaaaaaagaaaaaatttttctggaaaataaaaatatttttattaaatgattctaggaaatctagggagatctgggacattttctcctctgaactattttatatgagtgtgtctcaagtcattctcgaatttctctctttcttttttccagccaaactgctctcagtatagattaccaggatgtcccagacactttaaccctgtgtgtggcagtgacatgtccacttatgccaatgaatgtactctgtgcatgaaaatcaggtaacatgattttacagctgtagactagccaagttttcttcatttctttttttttcttctttttttttttgacagagtctcactctgtcacccaggctggagtgcagtggtgcaatcttggttcactgcaacctctgcctcctgggttgaagcaattcttgtgcctcagcctctggagtagctgggattacaggcacctgccaccacgcttggctaatttttaattttagtagagacagggtttcaccatgttggccaggctggtttcgaactcctgacctcaagtgatccacccgccttggcctcccaaagtgctgggattacaggcgtgagccaccgcgcctgacctcttcatttcttttgttgaattttgattacttagggggtagtgacaattttcttggatgtaagaatcaaaggtggtatggtagttctcagttttcagggtcatgcttaaagagatgcaaaatcctcagtgcatttttcaggtcaagttaaacaatgagatgtgtgattagtcaactataggccaggtaatcaaattatgttattgcccacaaatgtgaaatttcctaaaattaagagtctatttaatagttaaactctgtggagtattaaattttatttttaattcaaagggcatgtgtaggtggtctgcacaccctgtattagtagtcgggaagtgggacttactgactctgcttagtctagaatgctaagtaatgagtgtatgatacttgatatgcttcatgtagcacacctgaccaggtgactgtcactgctccttcaggtatgcagctttgtatatagcagggattcattatttgaccttagtcggtcttctctgattctttttttttttttttgagactgagtctcacttgtcgcccgactcactgcaacctctgcctcccaggttcaagcgattctcctgactcagccttccaagtagctgggattacaggcatgtgccaccacacctggctaatttttgtatttttgttagagatggggttttaccatattggtcaggctggtctcaaacccctgacctcaggtgatcaggtgatccacccacttcagcctcccaaagtgctgggattacaggcgtgagccactgctcccagcctaagttttgtatttttagtagaggtggggattcaccatgttggccaggctggtctcaaacccctgacctccagtaatccacccaccttggcctcccaaagtgctaggattacaggcatgagccaccatgcccagctctctgagtgattctttggggttagtgtcctgtgccctagcgttagggaaaaaaatgacagagtggggactttcaccctctttgtttcctagatttagcttaaaaaatgattaaataagtgtagctgtggaaggaatctaatatatatctatctacatgggtctttttaacacaaataatgagacagtttcagtatggtaggtaataaatgtatttctatgattgttcaatttgcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattcagttcctactgttctctgttgaaaataccattctcattccagaggaggcagagttttacctctatccttcaagagtttttcagctgggcctgagaattaaatggacataagacagatcaacaggaggaaagcatacagacttatttaatacaagtttcacttggcatgggagccttcataaagaaataaacactcggcggggcgtggtggctcacgcctgtaatcccagcactttgggaggctgaggcgggcgtatcatgagctcaagagatcaagaccatcctggccagcatggtgaaacctcgtctctcctaaaaatacaaaaattaactgggtgtggtggcacatgcctgtagtcccagctactcgggaggctgaggcaggacaatcgctcgaacccaggaggcggaggttgcagtgagctgaaatcacaccactgcactccagcctgggcagcagagcgagactctgtctcaaaaataaataaataaataaataaataaacgctcaaagacacagagttgaacacttatatgctgaattagacaaagagtagtgaattatgaaagtgtgacatggcagaggggcttgggctgagttaattgggtagagaagtggctgaggataagcattagtctaacaaggttggtttgtacacatttcccttgacctcagtttccaatttcccccagtccttgatgataagaatgttactttacttctggcatagggagaacatctttcacaggggaattttatctcctgcttttaagaaacagaaggaaagtcagaatgatcttcttgcacctgctgtttttcaagtgcttttaactcaaaatagttaatatgccagggcagcatattttgggttggcatattaactccatcatcagcggcctcacatggccctgttcctctcaggcgtggatgaatttcagtaggtgtgaagtggagttattgttgagagggcaaaatttatcctaactccttctttccctaattctcgggtaattatgtgtagttggtacagtgttctgcacatggccaataattgtaagatacttggcgttaacattaacccaaactcgtaaagttaaagaatcatggaggtacaaatatttattagattcaaaatttcctttcaatacagttttcattctgagttcatacaggagtttggctttttctttctttcagagcagtggttctcaatccagggtgattttccccaaggggacatttggcagtatgtctggaggcatgtttggtataactgctgaggtgtggggtgctacctaggaatgcttctaaacatcctacattgcataggtcagcccccaacagcaaggaattttccaatccaaatgtcagtagtgctaaggttgagacaccctgttttagagtttgatacagtataaacattttataacaataatataagtgaccaggaatttagaatgatagagttttccaggtagagaattttagtcataaggcctaggtttaagtacattccagcaccaggaaatggtgagacgcgaggcaagaggtggctgggagagtggtatcgtggggagaacatggcttttgggggtgagctaaatatgagttcattctgattccaacacttgtgtttcagttttcgtatctgaaaatggggttgatgtttagctcctggagctatgatgaggaaactgtttagcatagtgcttgacatatagaagccactgaaataggtgctactattgtttcagacacccctcctagagaggagaaaacaggcccacaaaggcaaacacatttgcctaaggtgatagaactgagcctgggcctgcatggtggctcttgcctgtaatcccagcactttggaaggccaaggcaggcagatcacgaggtcaagagttcgagaccagtttggccaatatggtgaaacctcgtctctactaaaaatacaaaaagtagctgggcgtggtggcacgtgcctataaccccagc

SEQ ID NO: 17605 - DNA, 7825 bp, Human
cggcaggagtcctctgagaggcgcatcactcctgccccaatggacaactcggtagacagtgggagtgagccccccacctccccagcggacttgagacggcaggctccgagacgagggagtcctggttcattaagttggtttttataagaaaacatgtttggaggggggacagccacagagggattaagtccaagaaagttacaccctcccccacctaatccccctgaccccgacctccagaggctgttggggttcacagaggccctcacctcctcccttccctctcggtgtcgtcaagcaccctccttccccacattctctttctgctttctttttaaatccagaaaaaacagcacctcctctggattcagagctagagcaggaggagccttcccttcccggaatccctgttccctttggggtgagcaactgactgcgtcgtgggggcggggagggcttccctgttcgcgttcggccccagggagacctgcgggaatcgttctccctcgccaccacccaccccctgcttccttctccccctcgccttggccaggctcggggtgaggagtgttatcccggagtctgggcgcctcggcagtgacggctccccagggactgcagggggagcccgggctgcagcgcctgctcagttcgtgctcactgcgtcgaaggctcccccggcctggctccgcgcccagcgccgcatccgggaggaggagcgaggaggcggcggaagagcccgcgcggccggagtccggggctgggagtggagagggaacctccagggggcagcaccgagccgccaagccggtcctctcttcgcgcccagcccggggtccccagatagcccatagggaagcccctctttcggattcccgcagtgtgggccggccctccacctggactggataaaggggggaaagtgacccctcaccacaaggaccattatctcctggtgagaacaagaatcaggcctctcttggggcaatcagcttccccacttcggtcccccaaaggtgggctctttgccggcggggactagggaacagcctttcggttccgggggagcacaggggaccccaggcaccagcagccccatcccaccgacaggtggcagaggcaaggcagctcactgctatacagtgtcccaagaaccaagtggccgtgacttcctatcctcaatttcccagcgacacccggaaagacaccgtgccatagatcgaggcccggggtcaaggccccgcctctcctgggcggcccctgcccaggcgggcccagccgctcctcccccgcactcccggttcgctctcacggtccctgaggtgggcgggcgggccctggatgacagcgatagaaccccggcccgactcgccctcgcccccgctctgggtctgggcttccccagcctagttcacgcctaggagccgcctgagcagccgcgcgcccagcgccacacgccacgagccctccccgcctgggcgtccccggatcccgcgagcgctcgggctcccggcttggaaccagggaggagggagggagcgagggagcaaccagctgcgacccggaaatgccatataaggagcaggaaggatcccccgccggaacaacccttatttgggcagcaccttatttggagtggcccgatatggcccggccgcttccggctctgggaggagggaagaaggcggagggaggggcaacgcgggaactccggagctgcgcgggtcccggaggccccggcggcggctagagctctaggcttccccgaagcctgggcgcctgggatgcgggcgcgggcgcgggccctagggtgcaggatggaggtgccgggcgctgtcggatggggggcttcacgtcactccgggtcctcccggccggtcctgccatattagggcttcctgcttcccatatatggccatgtacgtcacgacggaggcggacccgtgccgttccagacccttcaaatagaggcggatccggggagtcgcgagagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcaggtaagcagtggcctacgccgagggggaaccctttcgccaccatcctggcgtcctgtccttcaccgcaggagtgctcctggatcttagaatgagagccgggtttccctttcattcctcgcatccccagagtcatgtgttagagggatgccaaggaaccccacacagcccaccccctgccctcatccctagcggagcgcagaggaccgagcttttgttttggatggagagctctggagctgcgtgggtgggtggagggggagggcttgttttgatgagcggggctgcgccccccacctccagtaagacttgccttgccttgcttgccgcctgtccccaaggaaggaccgtgatccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgttttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattgggtatgtgtttcctgggttaggggaaggactctgccctattgagggctgtgaggttttctgaagacttggcctttagagatacaaggatcctccagccagagtcaggcccactgtgtgaaactggagttcgttatttatgaggactgagtatgggtcttcaaatagggtctcggtctatccacccaggctggagtgcagtagtgtaatcacagttcactgcagctttggtgtctcaggctcaagtgatcctcccacctcagcctcctgagtagctgggactataggcacgtgccaccacactcggttaatgtttatagagacagggttttgccatgttgcccaggctggagttcttcttgataatgggcctgttcctcttcagtctgttgggctgaagctttaccttggttagctaaagccaagaaaggcaagagttagggctgggacatgtgtggccaaaggcagtgttactctcctggcatcaaatgttgggccagtcccgtcccccacctctactcagggttggaaaacccatgatcttgggaatccctgccatgtgcagttagaggaggtaagaagtgggcacaaggcctttaggggaacagtaacaatgctggggccgactcagcctctccctcccattccccatgtccccagcaacttgagggcatcaaagaagcctagacgaggtaaaggccagttctcaagccaagaatccttccaggaagaaattcttattacttgccagctggaactgccatccttggcagcttcgtgggacaaaggatagagtgggcagaagcctggcctggtgtctaaagttcccatccgggccaaatctgttcccattgtgtaggaggcctgaggttctaggttcttttgggcccagtcccctgagggaccactcccactgctggggcaatccctgtgggcacgtgagcatctgcctactctgtgagaggccttgacctggccacagcagacaccatgggaggaatgtggattgttggttggggagacggacataagacacaaatcacaacatggtattgtgttatgcaatatgggcaagaatggagctctttgggagcacagtgaagggcacccaacccacctgggggtttaggaaaggtggaaaaattgagttaggaagcataagcaggagtcaacctgattgacttggtttgtgggtgaggcagggaggacactggccaagtctactcagcagtgtggatgagacggattactgagtggaagcactacctccaaccccaatatctaagtcttttgtgaattggtcagactccacgattcactgggtggatgggtacaatagatttgatgtactggaattcccaacccttggctcctctcccaacttctgacccctaaaatcagaggaacaatgaggtatccccttgacctggtatggttatcaggccctgagtgaagtgaaagtctaatctgcttctacctcttctccttcctctaagggtctcccaggtggttctcaacccacactttctggagccagagggattccaataaacccctgacattggcccaattctttcttgtgcagtctagccttccctgaccaacactgttgacctctgccctttcccatggcaccagactcctcagccttgaggagggggaacaggacaccttctctagtaaggggcacatccctgtgagcctcctggcaaaattgccaggtcctgatgggacaatatttgtattggcgcacctcttcccagccccacctacccctccccatctcactctaggcccaggaacacaagtccatacctgttacacattcttaagagtttctcactccagactcccaagaaataaaacatggcaagaataaaatatgaaagaaggagcattgagactctatttctttaaagcagagggtcttgtaagttacaagtgcatcagaatgagattcccaggccccatgaacggagcaggtgactgataccttacatttgg

SEQ ID NO: 17606 - DNA, 7490 bp, Human
ggcgcctgccactgcgcccagctaattttttttatttttagtagagacggggtttcaccgtgttagccaggatggtctcgatctcctgacctcgtgatccgcccgccttggccccccaaagtgctgggattacaggcgtgagccaccgcgcccggcctcagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctgaggcgtgcgacactctgtcctgtcccaggcactgtggtgggggcatccggtgtccaggtgcagaggcaaaagctgctcccgggtttcccagaaatggttccgaggcctgggtcccagagagccagtgcaggttggggggtggacctctggctctgtgggggggtctgttctgctccagtgggccgtgtctgccttgtcatcatccagacagccacagctggctcctgggtcccctcgtcaagcagcatttcccagtaacagtgacttcgtggaacacttaggaagcccttaaaaaccatcctcggacctctgaggcagggactccagggggcacagcacctgtggtggggacaggcaggcaggctggatgcggggagggcccgggaggaggagtgaggagccacgcacggaactgctcagactctcccagcaaaggtcctggcccttgtgcatgcctttagttacatgtctgccttagaggcaaagacgagccgtcacgggggacccaccgggtcaggggtctgcggacacgcttgcaggaggaacccaaggaaagggggtgggggtggagccccacagattgcgtcgtgggtgggcgtggagcttgcacagcaggcctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcctgggggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtggccctgggggcagccatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctggtctttgcaccctgtcctccatccagcccggcccagcgcttgggcttgtcctggacacctaacacccacctgccctcgtggccagcagtggcctgcgtggctgggagcccggtcagaggccgccggggccctcagtaggtgcgtcgtgggcgctggggacggcagcgggtgccctggcgggccgcgtgcagccggagagatgccatgtccctgctcctctgcaatgaaaagcaagcgaaaagtgcacatctcaggtccagctgtccccatctgcccctggccttgcgccagctgggcttgagctcttgcagcccaggctcctgcctgcagcctcagggctgtggaggcctctagcagggctcaggctggcgggcagtgccagcagttgcagggatcaaggtcagactctgcacagctaggcccatgtgtctcggcagagtccaccagtcccacccagcagctgaagggagaaagacgaggaggcagggagcagacgaggaggtggggagcaggcagcccgggcctcagaggacacatggccttcccccgctggcacccccacatcagggccaccaggggactgctcacacccaggggttgccgcctctggacctggctgtccctggttctgctgacctcaggagtgacctgggcttacagaggtactggcagggaggtcatgggccgggtgaggggtgctcgctcctggaaccctgtttccaggtatctcgggccctcaccctcccctaggcaggaagcagtctctctagctcaactgtcacccctcgtctgccccactctggtccccacacccacagcacacagcagaggctcaacacaaagtagccaggcagtgctgctcccggacagacatgcctgagggaccgtgctcagtgattcaggagtggtccagatgtgggaaggcagccacgcttggttgggggcacaggacgtgtgggggctggggtccctgtgccgcagggtgggcgtgagtgggcgctgagttctactacctcctccctcagctggtgcctttaaaggagggaagccatggggcagtgggtctgctctgacccgacaggcaggagtgaaggggaagggaagggaagcccggagcccactgggaagaagctgggggcagaggtctggtgcgtgggctgcagagctatcccccaaccccggcgacagattctagtgccaaaagtggttcaggtctaccgtgttgtgaagatcccctgaccagagacacgtccgtccagaacccactgctacttggggtgggggtggggggcagagggcgcacagacttcttcacatgatcccagatcagagggagaagggaggtgtccgcccggcctgggccttcccagagaacagccctggaacagatgtgtgcaaggcctgtgccgggggaggtggcgggggaggcacaggggacccagaaagggcttggtggccccggacgctgccgtccctcagccttccgaggggtctatggtgaagctcccgggaggcgctgcccagtacctggagggcctgctcttttcagcgtctaaaccatgcctgaggacacagacccagccagactcaggttcagagaacaagccctctaactctgtccgctcatgcccc

SEQ ID NO: 17607 - DNA, 15725 bp, Human
  misc_feature (1)...(15725): n = A,T,C or G
aggaatctcgctctgttgcccaggctggagtgcagtgacatgatctcggctcactgcaacctctgcttcctgagttcaagcaattctcatgcctcagcctcccaagtagcttggatcacagatgcacaccaccaggccaggctgatgtatttttacagagacggggtttcaccatgttggccaggatggtcttgaactcctgacctcaagtgatccgcccacctcggcttcccaaagtactgggattacaagcgtgcgccaccatgcttggcctcctcataacatttttaacagcagttataataaatccgcatgcacaccgtgtaatgcctatggaactaataactagtcttctatcgtgcagtgctactagtcacatatatagatgtttttgtgattctcaaatacacaaacccacctaagagcatcatatacccagatattcactgcagtctgaatagcagactgtgaacaacttaaacatcagtcagtaggtgaccggttagttgtgtcattctttttgagaaagggtcagctccgtagcccaggctgaagtgcagtggcaagatcatagctgactgcaacctccacctcccagattccagcaatcctcccacctcagcctcccaagtagctgggatcacagacgtgcaccaccacgcctggctaatttttgtatttgttgtatagatggagtctcgctatgttacccagactggtcttgaactcccgggcacaagtgatgcccccgcctcatcctcccaaagtgctgggattacaggcgtgagccacccagccctggcccctagttgagtcattcttacaaagaacatcacgctgctgttaccgaggacttcccattagtcttgatatggcacaatctccaagacacttaaagtataacacaccctgcagtgtgtattatgaattgccatttgtgtggggaaatgattatattcatatgtaagtttataaattcagaaagcattccgaaaattcatagagtacccaggggtaactttgcttgtctctagtgttgaactagaagtgggaggaagatttaattttcactacatgccctttggtgccttttgaattcagaacaatttccgttatttattaaaaataaaatacagccgggcgcggtggctcacgcctgtaatcccaacactttggaaggccgaggcgggaggatcacttgaactcaggagtatcacttgagctcaggagtttgagaccaccctgggcaacatagtgagaccctatgtttacaaaaagaaaataaataaagtaaaataccacgtgttactgaatccctggtatttggcgggacactggatactggaaacaattgtggagctctttggaaatttaccttaaaagggagtccgctcaaaggcaggaatgactctacaagggtgaattttcaaatctgccataggggcctcgggcctcagcagcatccagagccctacggacgggcaggttcttacgtctcaactcccatcgcaccagtcctgcagctttctaaaggtatccagcactttctaccttgcattctatcttcatcttcgctaggcctcacagcaccgcatgattccgggggagggtgcttatcagactcgcgtgtggccccacggcacctagggcaccgtcgagcacacggtccgggaagctccaatgaaacggaacaaaccgcgagatcaggggaggtaggaggcccaccctacgccctgcccccgcggagcacaagccccgcctgcgtcccgagctcccgggtccgcaaagctgggccccaaagagctccaacgccggaaccaaggagcacggaatgccgggaacaagctcctcccgtgcgcgatgacgacaaggccgaggcgcgaagggtgggaccgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgtaaggcggggctgaaccggagggccgggcgggcaccgcgcgccgccgcgcacctggcgggcccgggaccgcggactggagcccgccgcctcggggctgcgcagccgtccttctcggcgtcctccggggtcggtcctgtgtccctcctaagccccaccgtcccggccatttcttcccgcatcgatgcagtctccgcggagaacaaagcggctctagagcgcggcgttccccgccctctggggcttccaggcaccctgaggactcggcacaatctctgcggggacggggtgggcactacacctgtcctccatcctgctggacataactagccccacatccctggctccctaaaatctgggaaaagcccgttttctaatgggacttttagttatcgttgaaaaagtcatagtctggttcatttctgtcctttaaacaggctcgtttctggcgctggagacatcaaacttactaaagacggcaatgtgctgcttcacgaaatggtgagaggtgctctgggctaggtcagaaaggtcttgattttccgtagaatgttttctttgtagaaagatttgcagtgtccattttcaaggtaggagaacattcagaagtggcgtgtaatcagtaatagtcctgagtgcctggagtctgacagccctgcctttgaatccctgcttttttgccattcacagtccgggctaaagggctgtaattgtatattaaagttaattattttaaaacttgaaaaattaagagaggttgacacaatcacatgggcaaaatgcatgaggatgatttttcttttcttttttttttttattagacgaagtctcgctctgtcgaccagcctggagtccggtggcacaatctcaactcactgcaacctctccctcccgggttcaagcgattcttctgtctcagtctcccaagtagctaggattacaggctcgcgccactacgcccagttgatttttgtatttttagtagagacaggatttcaccgtgttggccaggctggtcttgaacgcctgacttcaggcgatccccccgcatcagcctcccaaagtgctgggattaccaggcccgtgcccagctgggttttctctttttaaaacagcagtttctctgttaggtctcatctctatctccaactggaggggagataaatctgtctctttgcaagtcttagggatggagaatattagattattgaggggagtatgctttttactcatccctaaattcccaaaacttagcagttcaaatccaagaaaaggaaattatttcctgctgatttgagttcagaataatatgtagggttttgctagtggtataccatgccatcaacatccagatgaaatatctttagtaaggacttgctaacctaggaggtgtagtttttgtttttagtgggctcagtggtggcccgtgtttgaaaagtggagccacagttaaacttgacttcagaattgtttgggggctaggtgtggtggcttatgcttgtaatcgcagcactttggcaggccaaggtaggtggatcatttgaggccaggagttcacgaccagccctggccaacatggttaaaactccgactcagctaaaaatacaaaaattagccgggtgtggtcctgcacgcctgtagtcccagctgcttcagaggctgaggcaggagaatcgatcgcttaaacctgggagactgaggtttcggtgagccaagattgtgccactgcattccagtgtaggagacagagtgagggtatctccaaaacaaaacaaaaaattatttgggttttagtgtgtgagaaatacagcgtaggtagagagaagcacattgaacatttacaatttaagaaataattataaaatggacacacacaaccaccactgtagctaataaattgttgctaccacctcagaagtctcgtcccattggaacctctctccaatctccagaagtctgtttttcagttttctttgaaaaaattacaaacctacaaaaataattataatgtgtgtgccctttaggagatacctggcttattctcactagagctctacacttgccataaagaggcaaggatgtacaattatgtgttactgttaactggtagctctgtcatcttgagtaaacttctactgagcctcaagcttcctcatctgtaaagtagagataacctgggaaataaattacacatgaagacgtttcaatcattataattgcatgtgcatgatagttaatcgaagtaatttgtagccaacatttgggtagctttttcaagtagatagcactcaaagaggcccttcctgcattttgtctgtggtatatttagactgcttcatattgttttaagtgattcattctttttctactttcagcaaattcaacacccaacagcttccttaatagcaaaggtagcaacagcccaggatgatataactggtgatggtacgacttctaatgtcctaatcattggagagctgctgaaacaggcggatctctacatttctgaagtatgcacaactcttgtttctgtaatttttttttgtatataggaagtgtctgatatttatacaaattgatgtgctgttaatagtagctgaggtcatacagtagaattagggggcttaaatctgggtctttatcctggtctaaaacaaattgtgaccttggacaggttatagaacctttcttggcctgaaaataattttgtaatcaagttgcattgcctatgtgatttgcatctgtctttagtgtagattaataattgagatctaaaaatggaatgtttaggactaggcatatttgttaggaaaaaggcaaccaaaagcttatatttggataaattccacttttttagccctgactagttccaaggttaaagcaaacctcagtgaatatgaatgtattgtcagaatttcctggagaaagagaacagtctttatttttattagtaaatgatgtgagttagtttgagattacctatagaaaggatagaatagtccaggcgcagtggctcacgcccataatcccagcactttgagaggccgaggtgggcggatcacctgaggttgggagttcgagaccagtctgaccaacatggagaaaccccgtgtctactaaaaatacaaaaattagccaggcgtggtggtgcatgcctgtaatcccagctacttgggaagctgaggcaggagaattgcttgaacccaggaggcggaggttgtggtgagtcgagattgtgccattgtactccagcctgggtaacaagtgcgaaactccatctcaaaaaaaatgaaagaaaataaagataggataatgctaccatctgtgagttgttgggacacagtgttggttttgaaatgattcagagtggtttgcacagtgaacacccaagtgtgctttatagttcccttggctttgaccctgtgctagagcattcattacctgttcatctgctctgcattgaaaggaatatttgtccttttaaatgtattcagaaagccagcacattatattacctcgtgttcaaaggtatgatgatccagaacactccttcaataattacctgaactttatcatgaactatggttgcacctaattgaagatgcaagtgttaatgtgtgtttattttagggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggtatgtattaaattttgtctatgtctggtatagtatacctatatagaaaatctctgatagtagaaacatgaatatgattaccaatttcaattacaaggtgctgtgtaggttcatttttgtggcaatgatacctaatctgtgtctctaaaaatgaggaaattaaaataatagtatacctaaccaggttataaaagtaaaattgaagctttcattaaaaggtttataaagtggagatttttttattagaaagcttccagttaccagtatttttaataaaacgaggaatgttaatgttaattaatgttaatgtttgggaattatagatggagatttcagaaatgtaaatgacttcagctgttgccttttacatataatgtattctatttgctgatagaaaaagacttaaatcagtgtagaattgtaaaatgaaactgcctactttagccttctgaaaagcaacatgtttctgctgcaaattgaatttacttaacggttatgctcctccaattgcaggctgtagtggactccattttggccattaaaaagcaagatgaacctattgatctcttcatgattgagatcatggagatgaaacataaatctgaaactgatacaaggtaggtggtagaagactgtgaaatactaatgggcatggaggctcacacctgtaatcccagcactttgggaggctgtggtgggcaaatcacctcaggtcaggagttccagaccagcctggccaacatggggaaaccccgtctctattaaaattacaaaaattaaccaggcgtgccgggcatgactgtaatcccagctactcgggaggctgaggcagcagaatagcttgaacctgggaggcggaggttgcagtgagctgagaccacaccattgcactccagcctgggtgacaagagcgaaaccccgtcccattaaaaaaaaaacaaaaacaaaaaataaactgtgtttagaaatttaggggtgctttgtacaatatagatagttggctttttttttttttgagatggagtcttgctctgtcgcccagcctggagtgtacagtggcatgatctcggctcactgcaagctctgcctcccgggttcacaccattctcctgcctcagcctcccgagtagctgggactacaggcgcccgccaccatgcccggataatttttgtatttttagtagagacggggtttcaccatgttaaccaggatgatctcgatctcctgacctcgtgatccgcccacctcggcctcccaaagtgctgggattacaggcgtgagatggcaattttaaaaatatctttggatataaaatgttatatatttacttgaagatataagttggataaactgctaggagaatattgtttttagtaatattttctcctgaaataaggtgaatgttatgtttatggttagaatgattctgaaaagtgaacaacatcagtcatttggcatttattgaattgctaggtacaaagcataatgagaagtagtagaggaatttaaaaaaatatttttttcaaagagttagttagaaaacatgtttgttttccctttggggtgtgtgtgtgtgtgtgtctgtgtggagaatggagtctccctatgttgcccaggctggttttaaattcctgggattaaggtgtcctctcacttctgcctccgtaagtgctgggattacaggtgcttggtagaaaacatgtttttaaaggacgtcatcacagtttgacagcctaccagtgagaccatctctgcagacttttctgtacagcgtaggatcttcaggtaatttaagaaataggccgggcgcagtggctcatgcctgtaatcccagcactttgggaggccaaggcgggcggatcacgagatcaggagatcgaaaccatcctggctaacacggtgaaaccccgtctctactaaaaatacaaaagaattagctgggcatggttgtgggtgcctgtagtcccagctgcttgagaggctgaggtaggagaatggtgtgaacccaggaggtggagcttgcggtgagccaagatggcaccactacactccatcctgggcaacagagcgagacttcatctcaaaaaagaaaaatgtgactgcgtgaaatatcaataccttctcatttcagtgtttaatatattaaatacccatctgaaaatcaataaccataattttgtgtgtgtttaaacagcttaatcagagggcttgttttggaccacggagcacggcatcctgatatgaagaaaagggtggaggatgcatacatcctcacttgtaacgtgtcattagagtatgagaaaacgtaagtttatagccccttaacagtgaaatggagaagcttcgtattttaggcgagttacttttttgtgaaactttgtttcccactgtaaggacaataatgctcaaattggtttgggggagctataggaaacagtctctgaagatgcataaggggcaggattggagctcagtgaactgttaaatcttaggactaatccagtttcagaagctgctttcttaatgtttccctgctttctgtaacttttttttttcttaatagagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaaggtgagaatgaaaactcaatgtataaactaaatagtacgtatcatcctttttacttttaaggtgaaagatgttgaaattaatttttatttttgttacagggaattgaccccttttccttagatgctctttcaaaagaaggcatagtcgctctgcgcagagctaaaaggagaaatatggagaggtatccgagtaatttgacttttactcattttgcaagtgaattgggattatttctttttccttatactttatttttgggtttttcaactgtatagttaattggcattaactatattcacattgtgcaccccgtcagcactgtccatctctaggacttttttcatcatcacaaactgaaactgtatacccattaaatagttactccccatttctccctcccccttgccccttgtaaacattattttactttttgtttctgaattcaatatacttttttccaaagagctccccacaataaaaagcttttttaaaaaattttttattattattttttgagacagtcttgctctttcgtgcagtggcatgatcttggttcattgcgactaccacttcctgggttcataggattctcagcctcccgagtagttgggattacgggtgtctgccaccatgcccactgaattgctttgtgtttttttagtagagatggggttttgccatgttagctaggctggtctcaaactcctggcctcaagtgatccacccacctcaacctcccaaagtgttgggattacaggtgtgagccaccatgcctggctaataaagagctcttgtccaccttttagatttcatttgctaacttggggagagtggtttaaatggagggttaagagaaaagactagtttttagctggttgatggcaaatggaaaggcttaaagtacattttaaaatttaattttgtgtgtaattctgaaaaattccttcctaaaaattactggtcttatctttgaaattcactggtaacgttgcttatccatctcccttaaaatgctatttcaggctgactcttgcttgtggtggggtagccctgaattcttttgacgacctaagtcctgactgcttgggacatgcaggacttgtatatgagtatacattggtaagtgtatttttttcttaaaggtaatagaaccttttagctcgtgaattatttttgtttgtttgtttgaggtggggtctcactcctgcccgggctggagtgcagtggtgtgatcacagttcactacagcctcatcttcctgggttcaagtgatcctcccgcctcaggcttctgagcaggtgggaccacagacgtgtgtgctaccatgactggctaattttttttttttcttggtaatttttgtagaaacaggttcataattgtgttgcccaggctggtcttaaactcccgggctcaggctgtccttcaccctcagcctcccaaagtgctgagattacaggcatgagccaccgtgcctggttcatgaagtctttagcagaaaaattaattgaaattcaggatcagatttttgtttatatacattttgaaggtttatgtgtagtaatgggaagccattgatggggaaaatcacatttcttttatgtgatttttcaaaaggagataatttgctttaatgtgatcaagtttgttccttattaatatgctacttgtcattctctgtaagtccctcttctctcttcactctgcacaaatcctgtttttgaaaatcatatttttctacacatagggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggtaagatcctcactgtatttcaattcttttatattgttttgctggtctgaaaggcatggccgaatactgtgtttttatcagtagtttacacagccagacaccatgcaaaagcagtcttccctttagaatgactgatggtatgctaaggtttttcatagcatatcattattaaaggtgaatacaaataaatgaactaatactgatctgttgaaagctgccagtggctagtgaagccattctggttgaaccattctcctatttggtatgttagtcacttgtattttgtcatagtaaatttgtaagaaattaatggctttcatatgtatattttgttattcataattagttctgcagttttcttagcatttttccttttcccccatccaacaggctgtgtggttccaggtgctggtgccgtggaagtggcaatggcagaagccctgattaaacataagcccagtgtaaagggcagggcacagcttggagtccaagcatttgctgatgcattgctcattattcccaaggtgtgcatgcttttaacagtcaatcttccaaaagattcagctgatcaaacctttctgataatgtaggatttattcataaagtggattttggataagcaagtttgatcagttttctttctgactctagaacaggtattcctcatcatccagatatatttggtttctctgggaagcctgaatagctgacattgcagatggcaagagataacctgtagtttaatatttgcagtattaggggttatacttgagtacaaacttgctttttgcttttgttttagactgatatcattgttttctattatataccagttttgatatataatttatgactggtgtattgctgctgggtttggggtagttgagagagttgatcagtaacttgtgtctggtattctctgaagggaacataaatgttctgtctttatgcaatgagttttttttttttttttttttgagacagttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctcgagtagctgggattacaggcacctgccaccacacccggccaggtttttttttatttttagtagagatggggtttcaccatgttggccaggctggtctcgaactcctgacctcaggtgatccaccttccacggcctcccaaagtcctgggattacaggcgtgagccactgcaccaggccgagattttctttttcttttttcttttttttttttttttttttttactatcagttattagttcctgttttctcaagaattaaatttgtttactttaggttcttgctcagaactctggttttgaccttcaggaaacattagttaaaattcaagcagaacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaatttggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgagtaaacagaaatgtatccagaagaagagaggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacacaatattgttggttcttactgactgaacttattttaagatttggttgccttttaggtgagccaatggtggcagcagaagtaggcgtatgggataactattgtgtaaagaaacagcttcttcactcctggtaagtttgggaaaatgaaaactaaactgttagagaatcatacttttttcatttggtgttctctgtttagttgctcctttcccccatgaataatgtgatcagctggaagtatggaaactgaactagccctctgatgtgtagaggggaagggggaaatttaattggatgtaatgtgtgcagcttggttggaagtgggaagttgagtcgaattagggctcctaatcatctgagccatcttatttttgtccccctttcagcactgtgattgccaccaacattctcttggttgatgagatcatgcgagctggaatgtcttctctgaaaggttgaattgaagcttcctctgtatctgaatcttgaagactgcaaagtgatcctgaggaatacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctcctttctgttcttgcaatggtatgacgcacaaaagcaatcttaaggggaatgaaaactgtcccaaaggttcagaaaagtagtgaaggggcctctggaacggccgggaccctcaacgtggttttccttaattccctgggcggtcctgaaggtggtgtggccagtcctccgcctcgctccgtcagtttccccctgctgaactattgggtgcggggcgggtggtggcgcagcctgcgcatgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggtcagtgaaccggccgtccatcctgggggcgctgggaaggggatggggcgctccgccctgacgggagagagccttaggcccttctgccggcttccgggatgcggctgcagcggcaggctggggaggtagctctcggtgcgcgtggcgcctcaccgccttatacttttcaacttcttgttgtggaatctttcaaacctaaaaaagggaaagagaggccgggcgcggtggctcgagcctgtaatcccagcactttgggaggccgaggcgggtggatcacttgaggtcaggagttggagaccagcctggccaacgtgaaaccctgtctctacaaaaatacaaaaacaaaaaaacccaactatccgggcgtggcggcgggtgcctgtaatcccagctactcgggaggctgagacaggagactcgcttgaacccaggaggcggaggttgcagtgagccgagatcgtgccattgcattccagcctgggcgacagatcgatactttatctcaaaaaaaaaaaaaaaaaaaaaaaaaaaaaggccggacgcggtggctcacgcctgtaatcccagcactttgggaggccgaggcgggcggatcacgaggtcaggaaatcgagaccatcctggctaacacagtgaaaccccgtctctactaaaaattcaaaaaattagctgggcgtgatggcgggcgcttgtagtcccagctactagggaggctgaggcaggagaatggcgtgaaccccggggggtggagcctgcagtgagcggagatagcgccactgcactccagcctgggcgacagcgagactccgtctcaaaaaaaaaaaaaaaaaaaaaaggaaaaaggagaatataacgaggaacgacccccgcccccacgtactcggccagcttaaatagctgccagtttgtggccagtcctgctcctgcggaatcgcacactccccctctcctggagccatttggaagtgggtccagacattatcccattttattctagggatttattaagcttgaatagtcaaa

SEQ ID NO: 17608 - DNA, 8831 bp, Human
atttgtgtcaccacaaagacatctaaaggcacgacaaactccatgtgaatgcctgggatttctttttaccagtggtcggctctgcaaagccagatcacatttactccaagttgcagttactcatccattgccatcctcctaaccttccaaccagtcctgtgcatctgggaactaccctgtgttataatgaaaacgataccactcatggcaacagagtcactgtcatcaactctcgcctaggtcaaaagccttttgaggagaagtggcaaggtctctatatttgcctttttaaaaatccctcttgtagcaacctggcgtgctaattttgaagtttacctggcactgagtttctctttggctctctcccctctccacagccccttccggtcctttattcacctctcacctgcatagcaagccctggaacctggaactccctcccagttctcacgcttgctggggaagataactgggtctaatggcgctattgacaaagcctggtgttgatgccgcttgacttcccgacccctgtgtggattctttcagcttcaaaaacgcccttggaagtggttttactgtaaatatttgaagtgtgcgtgtgggggaggggtgagacctggatgctcactccgtgcctcgctcactcacgggaagccctttcctctccacttcccaggaggccccggcagcacgagagacatagcctttccccgctcctgcccggggactggccgggggtcgcagcggcagggcttccgaaggatgccgggccccacgggtttttcagggccgaggtgtgtgggccttgactcccgcaagcccatgggcatccctcggcagcgaggaagagccttgtcaccgaggacccgctccactgagcaggcacgtgggcgacgtctgcaagccgacttgggttctgcaggccagagcgcccagatctaccgtctccgccttgactggggcaggggctcccagagaggattcgtggaggccaaactcacactcacatgcgcgtttacacccccacacccccgcacacacacctgaaaatgcggggccttcccatagcagataaggttcgacctgcagagctttggccacggggacaaaaccctcccctgctgcgccctggaggcccgagagcagggagggcttgggaaacaccacggtcttcagtgcgctgccgtcgcctcgcagagcggccaggtctgcgcagcgtgggcgctcaggagcgtggaaccaccgcgctccgcaaggcagacgtggacccactccagcgccgacaaggaggccggagaggacgcgcgcagctggctccagggaccaaccaagtccggaggggcccacgtgtctcgggagcgggtcttgggccgccgcggggctctccaggggcccgggggttgccagtgcccgccgtccggctccgcacccaggggagggcgggcagaggccccaggttgagcctcggagtatccactccccgttggtgtccccgcccgccagcgccgcgcaacagcccgggctgcttaggacctcgcggcgcgggggcggggcggcgggcggccgggacggtgacaggtgcgcccctcggccaatggcggagcccgcggccctccccgggcccccgctgcgcgcgccaatcggaagccgcgctgagcttcaagtgcgcggaggggcgcgggtccccaccacggcggcagcggcctccgcgcggtcgcctgagggctgcagcgcaaagaaccgggctcccgggcccggacgcggggaagcactcgcgtgggagtttgtgcgagcgcggcccggggcggggcccgcacggaggaggcgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgatggaaaaatccaaaaatttccgcatcgacgccctgctggcggtggaccccccacgagccgcctctgcgcagagcgcgccgctggccttggtcacgtcgctcgccgccgccgcatctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggcacgggcggcgggcacggggggccccaccaccacgcgcatccgggcgcagcggccgctgccgccgccgccgccgccgccgccgccgctgggggcctggcgctggggctgcaccctgggggcgcgcagggcggcgcgggcctcccggcgcaggcggcgctctacggccacccggtctacggctactccgcggcggcggcggcggctgcgctggcgggccagcacccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactgtgagtaccctgcggcccccgtggatgcgcgtggcgggagggcctcgcgcatcctccaccggcaccgcctgcccctctctgcgcttggctcccagcgagcgggggaagagctgcgaagccgcctcggctctgcccggggcctgcgaggactcgcccggacccccaggcatgagacgggcagcgaattattaaaatggccatgcgcaggccttgccttctcttcctctcttaacgggaaggggcagttggaggtgtgagactgagatctaatgattaacccgaaggctgcaggagaaggaagtcgccgggggaaggcgagccgagagcgccctgaattaggcaggcccgggaatgggggtcagggcttatcaccggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaaggtaacgaatgcccctccaaggtggggccgagggagcccctgttctccccaccccagagccgctgggcttcgggcagcttcctctccatccgggcgggacacctcgccagaggcctgggcccctcaggctttcctggcacacgcggactctccgggctggggctccggggctctggctctctggggctctggctctccccgctcgccccatcggggtcagctacttatgagtcgggccgagcagatgtatatggctcaacgctttcagccgccgaacacccaaacaaagagaccccattgtttctgtctgagtggatttgtttagactggggagatgcaggcagagcaggggaaaagcaaaaaagaaaacagaaataaacactccagaattcagattcctttgctggaagctgtggttgtgactaaacagagaaaatctaggaccccagaggctggagaagtcacaagagggtgagaagaatccctgcagaaggctgtttgcccacagccgccccaggctttcctagctcagctccaagaaggccccagtggtcacccatccctcacctgggagagtcagccctactgactggctggaagagggaaagctgcccctcacctcagacacgtctgcgtctgcgaatcccctgccagcctgggcttaaacccagggtgccgacccagggcccatcccttctgatagaaagccaccaatatgacctgcatttcccagagccaaggacgctaagttgcccacggagggggctggccagccccgggggcccgtggtcctaggcctcctaggggtgctttctggagcttcgtggagcccagggtcactcagaaaatttattaaagtgagacaccttgcctatttctgattccaaatgttgacctagagttggccaaattttaaacacaaccagtcttaagttcagaagaggtatctgcacctggcaatccaaaagggcaggcataaccgtgccaaagacggcggaatgtgttctgagaagtcctcctcgctggtccggggaaaacctgtttggtttctttaattggttgtctctgcctgttggatggcatttcccaaatggtccctccggagccagtggtttaattaaagttctaatgtattgtcaagttgggaattcggggccttgtttgactaaagcagggggcgtgggccatcctctaaagcaaactgcccatcccgggggacctgagctcatccaggcctggggctggcctcctttctttcctttgctttctttcttttattgtccaacacttgtcaggctcctgggaaatcaagggaagtctcgttttgaggtcataaaattctctgtgatgtaaccgtgcgaaattatgtaaataaagccgggcaggcctccttgaacacacagagaaccggatcctgcctgcgcctctgcctgtaatttgcgtaatgagaattgtcctgaaaaggcttctagtctcctcaggccttgcccctgccgcccgcaccctgaggagggggcatgccaaggaaaacatttggaaggtgggagggtccctggtgaatacacagacttggaccctgggtttggtcctgttccacctgtcctctctcccttcccttcctcccttccttccttccttccttccttctttccttctttccttcctccctccctctttccctctctcccttccttccttcctctttttctcctcctcctcctccttttctgtcttaaggaggcagtgcagggagacctggaacagcaggaccagctcttcccagacctgtttggatctgagcctgaatctctaggaaggcgcagtgaggagagggggagagatttggttctcatcactcactgctcctttattttattattttattattttttatttattgagagatggggtcttgctgtgtcacccagggtacagtgcaggggtgcagtctcgctcactgcagccttcaactcctgggcttcccggaacctcccttcctggcccccgactggcctcagttctcctcttgcctctgggtcaatccactgctaccaaagccggctcctgtggagaggaagcctcctgcgatgggccctgtttaacagggacactcagacgtctcctagacaaaaaaaaaaaaaaaaattggtctcattaactccaaactatccatttccacttggtggtcctgagtccgcattccttggggagtgggcactgatagtgagggaacagccccgccctctgcagggccaggccttggcgctggggccttgagtgtagtggtacaagcagcaacgggaggggctggggcgaggaccggagccggctgtgggcctcactgccctttggtccccagcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgcgcgccctccccgcccccgacgcatcccggcctcccaggggacactgttacctttgcacttgtgacccacgggcggtctgaggcatctagcgctgcgcctcgacggttcagacggcgggcgcacgggttcatctaaggtgcccagagcgccgattcagtagcttcgggtggggcccaagaatcagcacttaaccacccctcctttcattctgaagaaggtgatccccaggccgcattcgagaaattttgttccagaaagagaggagggaacatcctgagatttaccgcgacgtagccagctgccctgacccttcctccgcagacggagggcgcgggtagaaaagtccccggcctgggtcgttggggacatagtcctagctcccacggagctccagcccagctctggggtttgctgctgagtggggggttgcggggaggaggaagctacgagccccctccccattctgcttctaagtcgtctcaccctgaggccattccagggccgacccaatggggcccaggcgcacgcggccgggggactccggggacaggaagccctggggtggcggtggccggtttctcacgcccgcttgtgcccgcaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggcctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggatcagcgtgcacgagttttgggggattatgcccgcggcattacaatttgcttgtagaaatgatggggagggtgtctactcggcggttggcagctgagggtgaaaatcggagtctcaagtgggtgtcaggaccacctccgcgcctgctactggggagtcgcaatgtgaagtgttggcaaaaatacctgtggccaggtgtcagcgcatgcccggctgcctggtgcacacctgtcccgggacacgtgtccctcggaagcggagctgtggactctatttattttcctatttccttgctagctgttgcttcgttggcactccagaagtggaaatacgctatttggacgtttcagaaaataagcttaaaacgactaggcgttagtagcatgtggggtccctgtgacctcaggcgctactgaggcacatttcccggaacgcaccgaattgcgcggtgcttctctctctcctcgaccccggccctctctgttagcagaaccttccttggctggccaggatcggtcttcttggctctgtgcaaacaagtccgcgaggacagcggcggactgcagcagcgctccacaccgcggctgcagcggctccgggttaatcagcctctgcagcgcgcgccatcaatcaccgcagccaggcccagcgccatgtgctgcacacatgcgggctcagcccgcgctctcgtccgcccaggagcgcaggcccgcggcccacccagcccggcgcgactcccggcccccttcccccatcgatgacccagtggcctctcctggccccggaggagacgggcgacggggacgccgctcctatcccttctcccgggccttcctccttccttctgtttgtcactttctcagcagcacctgcgtgtgcccttctcctccctcctcccctcccctcctcccagcggataaaatgagttcagaagggcctggcgtttcatttgggtgattaccgcggggcgagcgcagccactcctctgcctcagggcgcggggagattaatatcctctctggcaactcattatcaccccgggccccttccataaaatcaacctcatccaaggccggggcgcggctgctgggagtccgggcagaagcagctgctgggcgctggcgcaggggccgggcctccgccgcctggggtccaaaggtgtttaggggaactgggagagggtttgccactggtggaggaggcagagtgcccagaggaagagggtgggaaaaccagagggaaggggggaagacagatgctttttttttttttttttttttttttaaatctgcaatccctacatttctttttaatttctaacacattggtgaggtt

SEQ ID NO: 17609 - DNA, 47110 bp, Human
catcatgctccaggtgcctcatcctacagacagacaagaaactaccctttgccatgtacagtcttatctttttctttagttttatacccaaacccactgatagaacaggaagtcgcttactatactgacttcctagtcacttttaacccattttactataccaacaaaacaagtcccaagccctatagtatatttttgtacccatcccccttagtgcttagtggagaatgacttgtacgtcataggagatccctgtataattgtgtaaaaaaattagatactcttaatccttcctacatggcttctcttgagatagcataattccaaagtattatctctgttgatcaataagcttctgtaggggagaagaagtaatacctttttctaacctattggaaggttcatggctgagatgcctataacaaaagattaataagagaaaagctgacaaacttatttaagataagttttacatatcacaggggtcttcagaaataaagaagaccaaagaaacagaaaaagctgtgtacttttatgctctggtttgttgaagagtggacagtagtgggaagtatgattggaagacaggggtgtgatctaatgattataaaccggggggatttagcaaggcctgttcatattcttctcggtgtcctcgtgtctccggagataaacatgtgcttctcctctgggtgggttgtggggggcacccttggatgggggtcttatggcctgcttcgcaggagaaggagacagatcagtgtgtgaccttcctaggttttctcaaataccaggtcccaaattttggagtagtgtgtcttgaaccccatcactttctaccagcatcatttatttcttcttcaaaagattgtcaaaaagttattttttattgggctgactgtagattcttaattatccctggtgtttctattagatgtaatctgtgctgactagtaaaacattcagatagtttcttttattagtaatctttgaaaatacttcagtagggaatgattttttcagatctaattataaaaatagtaacttttttgtgttttttttttaagttctaggtaaagatagtttttgagatagggataattgtttaggaaaaaatttatagcattacttttttaaaaatctatgttaacagttacatcctttgtaactctgaattcccaaggaaaatttgggcaaaggaaactttcaggtatgggaacaggatatgcacatttactctctttctactcttagcttaattttgacatacttgaattgtgtaatctttgtatattgtgtaagcattcagatagctatgtatcctattcttatttttctattgtgtttttaaaaactctttcccaaaactattcaggatttttttcctcaagtggcaagttgccccattttgtaacagtaagcataatcatgtcatcttgacaagtaacttaaattacatttgagataagtaatttttcttgagcttattaaaattgttaacatggtgcctgaatttgttgatgaaatcagtctaatgtcatgtcttgttggcctttgaaagtctagatgttatttcaaagtagtaaacattcataatttcaactgtcttattttatgaaacagctgttttagggaaaccaatataatggtgtcatcaaattctgaaaagtgtctttctcccaccccaggggcctggaataggaaatgcctctctttctacgtttggttttgtgggagctgcgcttgaaatcattttgattttgtatcctttctttaactgaacgttcagcctatccacaaattttataccaagttttctggggcagtagttatttactaagacacttgtctagaagagaaaacaacaggttagtcttcctcaagcacttaaagcggctttttgttttgcttttcctatgggccttaagactttttggagactgccgagaacttaggaaacttgcattctgttggagagtttttttccttgattctcacagctatcttatggtgtcctctgttgtcggcttctatagccttcgattttttggaaactttactcccaagaaagatgacacaactatgacaaaggtaaggtagaatcttaggtgactgtggcctctcgtttgccttccctgacagactgctttatttaatagtcattctgaatggttcatttgcagtgataggtatttgtttgtaagttgcgtaagcacaaactggaagattttcaaaatgctgagtgagtgggaaagggatgtaccctgtttaatttggatggcgtccattcactgtaaatgcggagaactgcagagcttgttaactagctatagaaggctcctgaaaggactctttttcctctaaagaaaacgtattgctaatgagtaacttggattgtgctaactgtacttcagggagcttgtttgaagtctgaagaacttagttgctacaagtagtagggacaaagtatttcaaatttgaataattaaagtaagacggaagagttctattcagaaacattttgtagtctgaggctaatttgactttttccacaacatgtcattgggttcagaataaaaaggctgttgccgtatatagtgactgaatctttataaaatattcccgtaggctgacaaagaagaataactaataagagctgaaagcttgttttgtttttattttatatttttagcctacttaaaggggagaagttattttacacacacacacacacacacacacacacacacacacacagctatttctttaaacttaataagtagttgagatatttagtatctagtttaagtgatcataaatattaattgatattttcaactcctcttatttactatggaagaataaacatgggatgcattattacaaaagtttagaggttttggatttctggtgctttttaaatcttacaattaacattagaaatagatgtgataaaagagatcttaagcaataatctggccttaaaaatgtagtcagaagtatccaatatgttaattattttttgcttgacaggcagagccttttgaaagtaacagctgcaatcagtaatgtaaagtgcattatctaggtgtcaagtaatttaagtattctataactatatctgtgctaggtactgtaaacatcttctagaacttacagatataactttatttattttaaaagtgtgttattctttgaaaattctgtactgaatagtatcattaagaaatcggcaaagtacactaggtaactagaatgcacaatcatttctcagaatgttactgggtttgattgtcatcctgctgtttaactgcccaatattctttctcgtttctcataacagatcattggaaattgtgtgtccatcttggttttgagctctgctctgcctgtgatgtcgagaacactgggtaagtttcagtgagaaattttcacttaaagatccatgtttttaaaaactgtctttactgaacttatttaacatttactcataaagattacctttgaaatacagtgtttcttcctacattattttacacttttacttctatactttatgtataggggcataccaagacaaatacttttatcaaataatgactacttattttttaaacacttaaaagcattctttctccaaacaacgggctggtttttgttgtattttgtttttactgacacatctataagttaggctttcgagtcctctagtgaggaaactgcattaaactaatttttctatttaaaagcttttgagcgtttataatttagtatggtttaaaaaattgaaaatttgtaaattattttaagctgctttgtgtccacaaaatagaggtgaacgcagtgtaatctctgagaacacactctgattcaaaggacacccttgagagttcctacttgcctgtcattcatttctgtcattttcttattgtttcagtttacggagaatttgataatcttttaaaagaaaaacagatttttgctttgtcattgaaatagttgagtaagtcttcccttagttgtcttttataaaatgctattgtagaccatattctgagttcttcactaaatattatttcagacaaaagtttccattaagcatttctatctaattctctagacttaggttttgacttaagagtgcacacgaatgattggaaaattttgatcattaaattttagctacttgctcataacaaaaattgctggtaactttgagttgcttttgcattagctctcatattgcctccattatttattgaagacttacagataccagggatgcaggctgtgcaaagaaagtagaagctttgtagttatcttcataattcttacaaaggatttcatgtttgtaatagaaaacaaaattaaagtataaatgtaaagggaccactgttccataagctaataaaaaactggtgtgtgtaatagtcttatttcttttgtgtttgctttataggacttgtaattgttttgacatctgcttatgtgaatcttgaaaatgccaaaagtatgctctttagcaacctgatttgatgttaaatgttatcatttatattatgacagtctattaaataatttctgttatatttcagccaacctatcattttaatacttaggaaactcattcactgtactattatttaagattgattgctaatcattaatatataccgattttatggaagaaaattacatgctgagtatagttttaacacaaagaaaacaaactaatggtaaaatttactttttgaaggccaacaaattaaattccagagtagtttgccatagagataaataaaaagaaaaaaaagaaagatggaacaattaaaatgcagctaacaaatgcctggacccagctgtccaaacaggattaatggagtgcattagggtacagtgagtcatgtggtgctttgcaaaatatcaacacgcactgcattacatgttatgcccagtggcattgaatagatgaaaagaaataaatacgttaaacagattcatagaggcttttcacagtattaaaaaagcaaatttctagactaaaagaaaaagctttattttagcattatgggaaatgcaaactagagagttactttgtaattcctctattaaccctttagaattgagtctttgattttaagaagataaaatatagggaattgtcatgaatattatcctagtgtataacaggattttgatttaccagctgaaaagcttataagactagaatagaggatgtatttaagcaatcagattccaagctgtgacatttttcagtctttcttgtcgcctctctcaaggaaaccctgaccttagtgtggtctcctttgctcctgtgaaatcagccagcagcgtcccatcacttacaatggaatgagaaatgcagtaacaagaaaaatcatattttatctctatatatgtaatttctctattatttcaacagtttttttagtgaagaatataaatttgattataacttgaaatacatcgaatctagtataaaagaaataatttggtgatgtttttgcttcaaaaatgaaagtgttcaatggacatgtttcttttttaaacatttgcccactattattgttgatgcatcgcaggctttagatttaagtacatggtgtgatatgacatatttattaaataattccttttaaatagcttgttatatttgaatgaaaaattttgtactaactgaaaaatcaccactaagtaaattttataagcatatttcttgccacaaagaattaagttgtgagaaaaattttgaccatgtattcttggttaagtagaattagtataaatgatggttttatttttcataggaaacacaaagaatctgtagttaaaattttttattagaaccctgaaaaagtaatgctatgtaaatgaatatatttttcaaaacattgttttgctgcctgtttatatttaagttttcagaatccaaaatttggggagatttgatgtctgtatttttagtaaacagtttactgtgtagtttaatagactctcagggtgataaaaggagatgtttgcaaacaaggtgaaaatagaacaagatcaaactaattatctatagatgtccaaaattctatgcaataaaatattttgaatgttgcagtgaattttagaagaatagattctgtgtgattgctgatatgttctttattatgcttaatcatgaaacaattaagacattgattttttgtgttattctttatttgaattctcctttaaagaggaaaatttttctcaaatgcaaatgatagtctttgaaatgcttttaataatttctatattgtaattatttttacagttatttttcatcttggaagctctttctataatttgtaagttatttagtgtccaaatacaatttgtttttaatgtacttatggtagtaaaacaaaaacacttactctttcaaatcagcttgaatttattttcagtattttcacatatttctcatttgggtcccatatagtctattatcttacaggagttaaagtagattattcctttttgcttcttgatgaagggaccttgttttataacgggtcttttttggagaggtctttatttggggttttggtaatccctatttatctgtaccctgggctttctctagctcttgttgtgaaacagaaataaacaatgctttcacagaggcttagcaatgacaaatgtgaaatggaagtataagtcatatattcctaattatgacattgatataaaaataatttcaaaccctatattgaaaatttctcaccaaaaagtatatatgattttattatattcagatatattatagaaaataataaatgaataatatgacttattattattaactttattatttaactttattaaagttatttattaacttatagtaattaacttttggttgattactaatgttcttatatctgagcaataagcttatatatacagttgagatctttaagaataaagaattcttaaaaatgttttgtgccaaatgtctaaaacagttaagagagcaactcatgataccaccataaaaactcatattcctgatatctacgaaatgtgtttcctgacactacacttctttcagggcaaacagccctgtctgagaaaatgtctgtgggtcacacatacctaaatttagtcacctgttgatattcagctactttaaatttactttattataattttcatgcggaaaataatttcctttaggaccatttagctggagggaaccttaagaggtaatttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatctattaaatagggaatcctttccccatttcttgtttttgtcaggtttgtcaaagatcagatagttgtagataatgcggcattatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctatgaagaaagtcattggtagcttgatggggatggcattgaatctataaattacctggggcagtatggccattttcatgatattgattcttcctacccatgagcatggaatgtttttccatttgtttgtaacctcttttatttcaatgtttattgcggcactattcacaatagcaaagacttggaaccaatccaaatgtccaacaatgatagactggattaagaaaatgtggcacatatacaccatggaatactatgcagccataagaaatgatgagttcatgtcctttgtagggacatggatgaaattggaaatcatcattctcagtaaactatcgcagggacaaaaaaccaaacaccacatgttctcactcataggtgggaattgaacaatgagaacacatggacagaggaaggggaacatcacactctggggactgttgtggggtggggggaggggggggatagcattaggagatatacctaatgctaaatgacgagttaatgggtgcagcacaccagcatggctcatgtatacatatgtaactaacctgcacattgtacacatgtaccctaaaacttaaagtataataataataaaaaaatcattgcccagaccaccattgagaagtttttccctgttttcttctagtagttttacagtttcaggtcttacctttcagtttttaatccaattaaattgatttttatgtaaaaaaaaaaaagtaacttgaaaaacgttacagttaaaatgttacaattaaaactagacaaatgatcgtaagggtctaatttgtcctaagaataaagacctctagctatctgagtattctgtttgttttcttttttctgaaacagatcctcattctgttacccaagctggagtgcagtggcaccatcatagctcactgcagcctcaacttcctgggctcaagcagtcctcccacctcagcctcccgagtagctgggactactggcagctacttacaccacaccaccacacctggctaattttttgtatttttttgtagagacgcggttttgccatgttgccaaggcttgcctcaaattcctaggctcaagtgatccacctgccttggcctcctaaagtgctgagatttcaggcgggagccacgtgcctgtccttgctgagtatttttttttttctttttccttctttttttttttgagatggattctcactctgttgctcaggttgaagtgcagtggcacaatctcggctcactgtaacctctgcctcctgggttcaagtgattctcctgcctcagcctcgcaagtacctgggattacaggcgcctgccaccatgcccagctaatttttgtatttttagtagagacggggttatgccatattgcccaggctggtctgaaactcctgacctcaagtgatttgcccgccttggcctcccaaagtgctgggattacaggtgtgagccaccgtgcctagccaggctgagtattcttaataatacatatgcacagtcatttctgagatagatgaacaaattatttcatttgtaggaaattgtgtttttagtttttaatcatataagtgaatgcataaataaatagtcctgataaagaatactaaaaattagagatccggccgccacttctaattccagtctcctcttccaagtttccagaaatgtctttggtttacagcttttcagaccttttcctgtgcatatgtatacatgtgtttgtgtgtatatatgtgtactttgtagaaaattttaaaatctcacctgagtattactttgtttctaattgttttgttggcattctccttctttctgatgactcttaacttcctatgctgcctagagagagttaaaagaagaaaatgttttgaaataatttcctttatcagatctcagtcacctgaacattaatttcaaaccaaaagagagttacagaaagagataattaaatgtttgccagtgacttgtaattgcctcattctatggattctgtttttaatttctctgtggtgtttactgtttgtaatttcaccccccacatcttgtctgtcttcatttctggtcactgctcctctctttttccctctgcttctctggccattccttagctgtgtcttttactgctcttcaactaccacccattcacttgcccccaaatcgagacctccaaaccaccacccaccctaagctaaaacagagaaatctagctctgtgctacttacgggtgtcctcctgccacctcacactggtcatttctaaaacagaacctgtcatttctctctctcctgtatttcccttcagtctctgggacactttctatccaagtggtcaaaccagaaacttgagacgtatggtaaatgcttccaccttctgtgccagtacctcatggcagtacttgctttcatcttggtaatatttctcacatctacctcttttttctgaaacaagatttagctctgttgtccaggctggagtgcattggcacaatcattcacagctcactgcagcctccaccttctgggctcaagtgatcctcccaccccagcctcccgagtagctgggaaaacagctgcccaccaccacacccagctaaactttttaattttttgtagagatggggtctcactctactacctgggctttctcacttggaaaattgaactccttgaactcctgggctcaagtgatcctccctctaggcctcccaaagcgttgggattacagatgtgaaccaccgcacctggcctcacatctacctcttgcttctcattttcctttttaaaagtgagaagagtcagacttgtatagcataaaaagcagagagctgagtatatgattttagtattttattgtgagagtagtgtttgtgaagtagattctaagcggatgtccttttatttgagaaggatagagaaagaagacatcaaaccaaaccaaaagaaataaggacatatttaattttccaagtgagaaagtttgactgagccataccatggagacctgtctctggagaactttcctcaggaagatcgcagccagttaccatccatgctggagggcttaggcgtgcacttctttgaaaattagcacataaggttctttcctggactctaattataattctctttcattggattttagtctgtcttcaagttcacatactctagttctggacgactaaatttaatttgcctccagattagaacaaaatgaaattgttgcacgtaaatcctcatgactaaaattgattcgatatttgcaaatacagttttccatctctaagctttggttcccattgttcccacagtcttctcccattcacctttctctatctatccaaatcttttttattctctgaggcagagtcaaatcctgcatcacacgtgaaggtgtctcagagtcttgcactttcaaccttgtattatacgtacctgtctgtattgactttctcatgaaactttatgttccttaaaggacaagacttgttttctgcatctttttatttttcacagcatctagttaataagtatttttgatgttaataagtattttgatgtcagtgggtgccaccatgttgagtgtatattgtgttctagaatagatgaactaagatactccatttgtcttgcttttgccctggtggtctttatttccatattctaagcttttctgaccaaatattttggtttgctattaatattttaaaagaccattacaacagtagccaagaggtggaaacaatcaaagtgtccatcgttggatgaatggatgatcagattttggtacataaacaataatggaatattcaggtaaaagaaggaaggacatttaagtgaaataagccagtctcaaaaaggcacctctttataagtgtgattccacttataagaggtatctagagtagttcatttcatgagttgccaggaactagggtgaggaggaatgggagttcttgtttaatgagtatagattattcattttttaggatgaagagaattctggggatgggtagtaccaatggcgaatatacttcctatcactgaactgtacacttaaaaatggttaaattggtccatttcatgttatatgtattttatcacaattaaaaaagaaaaaagagtaactaaatgggtacatactacaacatgaatggaccttgaaaacattatgttgttatattgtacgattccatttccatgaaatgtccagaataggaaaatccatagacagaaagtggattttttttggaatatatccaaagcccttgaactgtttatttttaaatagttaattttatgttatgtgaatttcacttcaataagttattttttggctgggtgtggtggcttacacctgtaatcccagcactttgggaggccgaagcgggcaggtcacttgatgccagtagttccagaccagcctggccaacatcgtgaaaccccatctctactaaaaatataaaaattagccaagtgtggtagcgtgcgcctgtaatcccagctacttggaaggatgaggcaggagaatcacttgaacccaggcagcagaggctacagtgacctgagatcgtgccactgcactccagcctgggtgacagagcgagactctgtctcaaaaaaaaaaaaaaagaaaaaagtatttttttataagtcttttactcagtagatactcagtaaatatttgtcctcttctccgtttccttggcgtggcagtctaatgccagggcctaattgtttttagtaagtcagtctttatgtgtttgcatttgccttcttagtgccaggcacttgataaggggaggcaggtggaaggacttttgaaagtcgcctttctggtgtatagagtcctaacctggggcacctcctttgtcccttctttccattcagagtctacttgttatttaagggctagttcaatccccaccacacacacacatgcacagtggaagtgtgatcttgtcatttccctgctccaaatgctgcaaagacgtttgccattcaaatactgtacagtttccttaaggtaacacatacgatctatacctgaccccgtctgtgtctcgtgccattccaaacctcacattctgagccattagtaataaagacataatcttcaggtgtgttagaaacaaagtacatctgctatgccttctatgcctttgaacacattgctttgtttactgcgagtaattttcttcaccagccgttctccggcaaaacctaacatgtcattcaagactcagctcagccatgaactccacaaatcaagtttgccatgaggtatctcccgtgcactctcatataacacttggtgcagttttccgtttatctaccaggtcacttatcacattctatccaatggcttttcttttcctccataaagctgtacgctccttgaagaaagggatggcctgccacacaacatttagcacacatatgcggtgggaggtttacacactctcacttcccagttcacttaactgtttgtatatagacatttggccatactggaaatattgcattgtttaaaaagtcttgtcttcctaggaaggctatcaataccgtgaagggaataaatgtcttacatacttactttgtagcttctgtagtacatgcacagtacaatgtaggaatatggtagggactcaaaaattctttaaaaatttaacttataacacaaaaacaaatacagaaaatatagagtttctaaataaatgtaattggtacagccatacattaatatattaatgcatgatattgggtatatagtctgaagtctaataaatgcattttaacagctttattgaggtataattgacatacaataaactgcacatgtttaaagtgacaattttataagttttgacttatacaaacacctgtaggaccaccactgccatcaagatagtgaacatattcatcacccccaaacatttctcccctcagactccgctcgtgttcccctatccaccatcagctccaggcagccactcatttgccttttgttttttttttccagacagattttttagagcagttttaggttcacagctaaattgagggaaaagtgcagagatagcacacgtacctcctgtcccccacatgcagagccttccccactgccaacatctcccaccagagtggcacattggttacagttgatgaacctgcactgacacattatcacccagagtccagagtttacgttagggttcattcctggtgttgtacattctatgggtttgggcaaatgtataatgtcccatatccactgttatggcatcatgcagagtagtttcactgccctaaaaatcctccgtgccctgtctatttatccctctctctctctctcacccccggcagccactaatcttcttactgtctcagtagtttcacctttcccagaatgtcatatagttggaatcacacagtatataaccttttcagataggtttctttcatttaacgtatatttagggttcctccatatcttttcatggcttgatagctcatatctttttaacgtggaataagattccattgtctggatataccacagtttaatttatttttgtataaatttacaggggtacaagtgcaattttgttgcatgcatagattgtgtaatggtgtagtcagggcttgtagggtgtctgtcacttgaataatgtacactatgcccattaaataatttctcatcgtccagcctcccccctgccctgttgcctttttcagtcttcattttctatcattctgcaccctacatccatgtgaatgcattatttggctcccatctataattgagaacatacagcatttgtctttctgtatctgacttgtttcacttaagatgatgattccacccatgttgttgtgaaatacatgatttcattctttgctctggctgaattgtattccattgtgtttttataccacattttctttatccagttgtccattgattggcgcttaggttgattccatatctttgctattgtgatcagtgctgctataaacatatgagtgcaggcatctttttgatataatgatttcttttcctttgggtagatacccagtactgggattgctggatcagatggtagttctattttcagttctttgagaaatctccatactgtttttccatagaggttgtaataatttacattcccaccaaccgtatagaagtgttcccttttttctgcatcctctccaacatttgttgtttttttttactttttaatagtagccattctgactgatgtaagataatatcacattgtgttcttaatttgcatttctctgattagtgatgtggagcattttttcatatgctagttggccatttgtatgacctcttttgaagtctgtcttttgcccactttttgaagtgtgtcctttgctcactttttaatgaagtcatttttgttattgttgttgagttgtttgcattccttgtaaattctggatatcagtctgctgttggatgcatcatttgcaaactttttctcccattctgcaggttatctgttcactctgttgatattttgctgtgcagaagctttttagtttaattaagttccatttgtttatttttgctttagtcgtctgtgctttcgaggtcttaagtcatgaattcttttcctagaccaatgtccagaagagttttcctaggttttcttctagtatttttataatttcaggtcttacatttcagtctttaatccatcttgagttgatttttatatatggcgagagataggggtccagtttcttttatctgcatatggcaatccaattttaccagcaccttttattgaaaagggtatccttttttcattgtatgtttttgtcagttttgtcaaagatcagctggctgtaaatacgtggctttatttttgggttctccattctgttccattgatctgtgtctgtttttatactagtaccatactcttatggttactgtatccttgttgtataatttgaagttaggtaagttgatgcctccagttttgttctttttccttaggattgctttggctattcatgctcttttttggttccgtatacattttagggtagtttttttaattacgtgaaaaataacattggtattttggtagggattgcattgaatctatagattgtttgcagtagtgtggtcattttaacaatattaatacttctgattcatgagcatgggatgtttttccatttgtttgtgttatccacaatttctttcattagtgttttttgtagtttgtttgtttgagacagagtctcgctctgtcgcccaggctggagtgcagtggcgtaatcttggctcactgcaaacctccatctcccaggttcaagcgattctcctgcctcagcctcccaagtagctgggaccacaggtgtgcgccaccacacacagctaattttttgtatttttagtagagatagggtttcaccatgttagctaggatggtctcgatctcctgaccttgtgatctgcccaccttggcctcccaaattgctgagattacaggcgtgagccactgtatccagcctgtagtttattttatttatttatttttttcttaaagatatctttcacctccttggctaaatattctcctagatatttctttatttttcttcttcatttgtgaagcttagttttgctggatacaaaatgcttgactgacaattattttgtttcaggggactacaggtaaggaccccaatcctttctggcttttaaggtttctgctgaaaaatttacggttaatctgatagattttcctttatagattacctgatgcttttgtttcataccttttaagattctttccttcgttttgactttagataacctgatgactacgtgtttgtgtgatgatcattttgtgatgaatttcccaagtgttctttgagctttttgtatttggacatttgcatatctagcaaggaagttttcctcagttattccctcaaataagttttccaaacttttagatttctcttcttcctcaggaacactaattattcttagttttgaccatttagcataatcccaaatttcttggaggctttgttcgtgtttttaaattcttttttctttgtctttgtccagttgggttaatttgaaagccttgtttttgagctctgaagttctttcttttacttgtccagtctatcgttgaaactttccagtgcatttggtatttctctaagtgtgtttttcatttccagaagttgtgattgctttttctttatgatatctatttctctgaagaatttttcatccatatcctatattgttaacatttctttaaattggttttcacctttctcttgtatctccttgagtagcttaataatcaaccttctgggccgggcacggtggctcatgcctgtaatcccagcactttgggaggccaaggcaggcagatcacgaggtcgggagatcgagagcatcctggctgacatggtgaaaccccgtctctactaaaaaatacacaaaattagccgggcatggtggcgggcgcctgtagtcccagctactcaggagattgaggcaggagaatggcgtgaacccgggaggtggagcttgcagtgagccaagatcgtgccactgcactccagcctgggtgacagagtgagactccatctcaaaaaaaaaaaaaaaaaaaaaaaaaatcaaccttctgaattctttaactggcaattcagagatttcttcttggtttggatccattgctagggagctagtgtgatcttctgggagtgttatagaacccggttttttatattgccagaattacttttctggttccttttcatttgggtagactagttcattgggaaggtctggaacccaaggcctgctgttcagattcttttgttccactgggtgatcccttgatacagtgttctcccccttcacctagggatggggcttcctgagagccagcctgcagtgattgttattgttcttctgggcttaaccacccagcagggctaccaggctctgggatggtgcgggggaatgcctgcaaagagtcttgtgatgtggtctgtcttcgggtctcccagctgtggataccagcatctgctttggtggagttggcaggggagtgatggagactctgtgagagttcctggttgtaggtatgtttagtatgctggctttctcaaatgctggttatgccaggagtgaaagtgtcatgtggacagactcaggacctctggttagccaggatgttgcaggcagtggaattagcttttgttttctccttcctgggagcagggttattctgtcatgagttgctgtaatggcctgatgtggttggccagttggttggcctcactttcaagagagttccagctgccatagtagtagaggtatctaagcttgccccaagttggccaaggtaagtattctggtttctcaggtgatgggtggggccataaagctccctagactttatgtcttttgtgttcagctgccagggtaggtagagaaataccatcagctgggggcaaggtcaggtgggtctgggttctgattctccctgggcagggcttgctgcagccaccgtggttgttggggggtggttctcaggccaatggggttttgttccagaggggatcttggccacctgtgctgtgttatatagtttgccagggaagttggggagagccagtagtgaaaggcctcatccagctcccacacagttggcaaggctggtctctcttctgcagtccctgccgcagaccttgtcccaggccgtaagcttccccgctgagaaagcaagcatggctttcaggctttgcccttccccatctgcccacactgtccgtggtggcttctgtgctcttatctgcagcagttcccatttgcaccctgcccccctaccagattctgctcaagaaaatttgctcaagaaattctgctcaagaaaatttgtgcccaaagttattacaaatttcagttggaagcttctttcatcctgtaaccccaccctaattccactggctgccttccccaaggtcccctgtgagatatagtcagggatggcttccctgggcttgagctggagactgggagagcctacagggctcttcctgccactgatgctgcttttattttttgtgtggctccctgaatctatttcaactctaagtaaggttaaatccttttcccattatctggattttcagctaccacagtgaggatgtgtgttcagaggaaggttttccccacctcacacactgggaactcagttttttgcctgtgtctcatggaatttgcaatgatatgctgcttctttcaaaggattcgtgaattctttgttttcctggtacatcctacaatggttcttggagcaaaagttgatggtgtgagtctccgcgcactgttctgtccttccaagtgggaactgcacattagtcctgcctcctgtctgccgtcttcctccaattttttgtttctggctattgtaaatgggattgccttcttgatttccttctcagctagatagtagtttttttttttttttatatagaaatgcaactggtttttgtacattgattttgtattctgaaactttactgaatttatcaaatccaagagcttttttgtggggggatccattaggtttttctagagataagatcatatcatgaacgaacagggataacttaacctcctctttaccaatttgggtgccttttgtttctttctcttgcctgattgttctggctagaactgtcagtactctgttgaataggagtggtgaaaattgacatccttgtctttttccagttcttatgatttttggctgtggtactgttgtatatgatctttattattttgaagtatgctctttgcatgcttaatctgtggagggctttcgtcatgaagggatgctgaagttatcacatgctttttctgcatctttggagatgatcatgtggtttttgcccttaattctgtcagtgtgatatatcacatttactgactgtgtatgttgaaccatccttacactcctggtataaaacctgcctgatcatggtgtattatctttttgatgtgctgttggattcagtttgctaatatttcattgagagtttttgcatctgtgtttatcagggatattggtctgtagtgtacttgtctgtttgggtatcagagtgatttgggcctcatagaatgacttaggaagaattccctccgcctcagtttttgggaacagtttcaggaggattggtattagttcttctttgtacatttggtagaattcagctgtgaatccatctggtcctgggcttttctttgttgagagatttttttaatggattcaatcttgctactcatcattggcctgctcgggttttttatttcttcccggttcaatcttgagaggttgtatgtttctagccagtaatttatccatttcctctaggttttctattttgtgaatgtatagttgtttataatattctctgatgatcttttgtatttctgtggtatcggttgtaatgtttactttttcatttctgattttctttgtgttgtctcttttttttcccttgttactctagcaattggtttatcagttttatttattttctcgaagaaccaacttttcattttcctgatcctttgtactgttttttggtttttattttattgttttttttttggttctgctctgatctttgttatttcttttcttctactgattttggatttggtttgttacttttgtagttccttgaggtatgacattaggttgttaatttgtatctttcagtatctttcatgtagtcacttgatgtcataaacttccctcctagcactgtttttgctgtatctcgcaagtttcagtatgttgtgtttccattttcatttgtttcaaaaattttttttttaatttctgacttaatttattctttgacccaatggtcattcagaggcatgttgttaatttctgtgtacttgtatgttttctgaaattcttcttggtattgatttcgtgatattgatgcatgaaaatttttgatttttaaaaatttgttgagacttgttttgtgttttaacatatggtttatcttggagaacgttttatgtgctgatgagtagaacataaattctgcagttgagcagaatattctgtaaatgtgttttaggtccgttgcaccaagtacagtgtttctttgctgattttttttctcgataagctatgaatagggtgttgaagtccaccaccattatttcattgctgtctgcctctttctttagctgtagtaatatttgttttatgaatcttggtgctgttggctgcatgtatatttggatgtattgttatatcctcttgctgaataggtccctttatcattatataatgacctttgttgtctttttttttttttaactgtttttgatttaaagtctgttttatctggtgtcagtataactactcctggtcttgtttgtttttttgtttgtgtggaatatctttactttgaggctgtgtcttcataggtaaggtggatttcttgtgagcagtgtatggttggatcatgtttttctctatccattccaccaatctgtatcttttaagaggagaatttaatccatttatattcaaggttaatattgatatgtgaggttttgttcctgtcatattttttcattgttttctagttttgtaagttctttgttatctttttctctatttctctttgtggtttggtggaattctgtagtattgccattggattcccttctctttctcctttgtgtgattgttttacttgtgagttttatactttcatgtgttttcatgacggtgaatatcttccttttgtttccacatttaggactttgagcatttcttacaggatctgtatagtggagacgaattctttcagcattgcttgtctgcaaaagactttatctctccttcatgtatgaagcttaatttttctgaaaatagaattcttcaatggcaggcttttttcttttctttttgcgacagagtctcactgtgtctcccagctggagtgcagtggcatgatcacagctcactgcaacctctacctcccaggctcaaacagtccttccacctcagcctcccaagtagctgggactacaggcacatgctaccatgcccagctaacttttgtgttttttgtagagatggaggtcttaccatgttgtccaggctggtctcgaactcctgggctcaacccatccacccaccttgacgtcccaaagtgctgggattacaggtgtaagccactatgcccaggggcaggctttttgttttagtgctttgaatatgccctctcattttttttctggcctataagatttctgctgaaaagtctgccattgctcttttcttactgattttagaattctttcactttgactttcgacaatctgattataatatgctgtggtgaagtcctttgtgcagtgtatttttcatggaccactggacctcctgtatttggatgtctaaatctcttgctatacttgggatcttttcaccatttattttattagatatgttttctaaactttttgatctttcttccccctcaggaatttgtacgttaggtttttatgtagtctcaaacatctccaaggcttcattcttttttgttcctttttctttatttttgtctgcctggattatttcaaaagacctgtctttcacgttctgagattctttcttctattggtctattgttgaggcttttgattatattttatacttccttatattaatttttttgtttcagaatttctggttttttttttttttaaagacaactatttccttagtaaacttcttattcacatcctatattgatttctgatctttgtactggttttcagatttctcttacatctcattgagcttgtttgaaattagtattttgagctttaatctggcattttgagggtttttttttttcagttaggatctattgctggagaattattgttttcctttgagggtgtcatattgccttggctttttcaggccttttgtatctttacattgatttctgcgcatccggagcaatagttgctgcttatttttaaatttactttcattgggaggggactttttttcttgactatgtgaccatgatgtgtttgggcaggtagggctgtttggctttgtttcaggatgtgcagtgataaaaacgctgcatgatttctttggctataaatagcctttgtggtagctgtgggtttgttggtgttatggggcggttattggtggcagctattgtgaagttgtactggggactggaatgcctgatggatcccttttcaggtttcattggtagcagtggtgggctaagcatgtctgttcttgtgccatgggacagtgtattctggcgcctgtgttggcagttccaggctatttcttgggcctctgtgtagctttcctggatgctggttgtagttgtgtatgctgaatgggtaagtgggccctcagcccccttgtaacccagggtggcatgggtcatggtggtagcagtggttgtgcaatgatcttctagtttccaagcactttgcccttgtgttagaagttgttgcagtgggctttgcatgttgacctctaggtcagtaggcgatgtttacaggttagagccagctacagtgggtacaacaggatttgtgcccagcctcttttccatgggagaagtacttgggtgtctcaggtggcagattgggtaatggaaaactcatgagcccggatgccatgctccaccttggagaggcatggggaagggcccaggcagagctggactgggcaattgtactcaggtcccccatggtgattgtatgcaaaagtcccaacaagggtagtgaggcagcccccaagcccctgggaaaatgcttgggtgaggggtggccaccactatgccagggtctcagcctagggaaggattgacattgacagcccaagcagccacagttgtggccagcagacatggaacttgtgtccctctcctatccttgttctcgtggagtgctccctcccttgttccgactgtggcagcgaacccaggtatctagtcagtcctagaagtttgcatccagtctgccactcagcttagggccgtgggagatgccacccagcccccatcctggcctctgaggcaactctcctcctgctgaggtcttaggagacagcctggttcctgtgccagttgggctggatcccaggtcatgctcatttctcagttctggctgcaggagttcttcccctactcaagcctcttttctgcaaaccccagcccaagtccccctaactccagtggttggtgctgctaatttccacacattgttgagcagctaagatcaagaatggcatcttactgtagctgcctgggtctgagagagcacataggacacaccctggagcagtttcttctcatggtttcctggctgctccttaaatgtgattctgagattaggagagtcaaggtgctctccaatggcctggattgtacagtttcccagggaaagtggaccccagaaggacactcacttacactcttccatatgggggattcattccccatttttggccccaggccacatgggctgcctgttttccttctctttttcagaattcgacttttccttttcaggaagctgcttttgccacagtttatccatttacctactgaaagacatcttggttgcttccagattttggcagttgtgaataaagcttctctatagatattcatgtgcaagtttttgtgtggacaaaagatttcaactccttggggtagatatcaaaaaacatttttcttggatcatatgctaagagtatgtttagttttcttttttaaaaaaccttctctgctgctgctgagatgtgaaaaagaagtaaaaatattaagaaatgaaaaaagaaaatttaactgtcaaagtgtcttctaaattggttgtgtcagcaaaagaaactatcatgagagtgaacagacagcctacacaatgggagaaaattttttcagtctaacaaaggtctaatatccagaatctacaaggaacttagataaatttacaagaaaaaaacaaacctcattaaaaagtgggcaaaggacatgaacatacagttctcaaaagaagacatttatgtggtccagaaacatatgaaaaaaagctcaacatcactgagcattagagaaatgcaaatcagaaccacaatgagataccatatcatgccagtcagaagggcaattattaaaaagtcaagaaacaacagatgctggtgaggtggtggagaaataggaacacttttacactgttgttgggaatgtaagttagttcagccattgtggaagacagtgtggcgattccccaaagacctagaaccagaaataccatttgacccagcagtctcattactgggtatatacccaaaggaataaaaatcagttataaagatacatgcacatatatgttcattgcagcactattcacaatagcaaagacatggaatcaacccaaatgcccatctgtgatagactagataaagaaaatgtggtacatatacaccatggaatattatacagccataaaaaggaacaagatcatgtcctttgcccggatatggatggagttggaagccattatcctcagcaaactaacacaggaacagaaaaccaaacaccacatgttctcacttataagtgggaactgaacaatgagaatacatggacacagggaggggaacaacacacactgggccttggtcgggggagggagagaatcaggttaaacagctaagcatgtggggtctaacacctaggtgatagattgataggtgcagcaaaccaccatagcacatgataacaaacctgcacatcctgcacatgtatcccagaacttaaaataaaattcaatttttgaaaagagtggttgtaccattttacattcctgacagcatagaatgagagttcctgttgctccacatcctcaccagcatatggtgtcagtgttctggattttggccattctcatacatgtgcctgaccttctttgtataactataaattagtttgcacttcctagaattttatatatatgaaatcatacaatatgtaccatttacctgacttcttctactcatcatatttaagatgcatctgtgatgatgtatgtatgaatagttcattttttattgttgaatagtactctcttgtatgtatatatcacaatttgtttatctgttcacccattggaagacctttgagttgtttacaacttttgggtattgcaaataatgcagcttgaacagtcatatcaacatttctgttggatgcatatctaggaagggaagatttaatttgcatttccctgataactaatgtgattatttgccatttgatatggtgtggctgtgtccccacccatatctcatcttgaattcccacatgttgtgggaggggtctggtgggaggtaattgaatcatgggggcaggcctttcccttgctgttttcataatagtaaatctcatgagatctgatggttttaaaaagggggtttccctgcacaagctcacattctctcttgctgctgccatgtaagaagtgcctttcaccttccactatgattgtgaggcctccccagccacatgcaaccatgagtccattaaacctgtttttcttcccagtcttgggtgtgtctttatcagcagcatgaaaacagactaatacagtaaattggtaacagtagaatggggcactgctgaaaagatacctgaaaatatggaagcgactttggaactgggtaacaggcacaggttggcacagtttggagggctcagaagaagaaaggaaaatatggtaaagtttggaacttcctagagacttgttgaatggctttgcccaaaatgctgatggcaatatggacaataaagtccaggctgaggtggtctcaggtggggatgaggaacttgttgcgaactggagcaaagatgatttttttttaaattttattattattatactttaagttttagggtacatgtgcacaacgtgcaggtttgttacatatgtatacacgtgccatgttggtgtgctgcacccattaactcatcatttagcattaggtatatctcctaatgctatccctcccccctcctcccaccccacaacagtccgaggtgagtgatgttcccattcctgtgtccatgtgttctcattgttcgattcccacctatgagtgagaacatgcagtgtttggttttttgtccttgcaatagtttgctgagaatgatggtttccagtttcatccatgtccctacaaaggacatgaactcatcatttttatggctgcatagtattccatggtgtatatgtgccacattttcttaatccagtctatcgttgctggacatttggggttggttccaagtctttgctattgtgaatagtgccgcaataaacatacgtgtgcatgtgtctttatagcagcatgatttataatcctttgagtatatacccagtaatgggatggctgggtcaaatggtatttctagttctagatccctgaggaatcgccacactgacttccacaacggttgacagtcccaccaacagtataaaagtgttcctatttctccacatcctctccagcacctgttgtttcctgacttttaaatgatcgccattctaactggtgtgagatggtgtctcattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcagatgagtaggttgcaaaaattttctcccattctgtaggttgcctgttcactctgatggtggtttcttttgctgtgcagaagctgtttagtttaattagatcccatttgtcaattttggcttttgttgccattgcttttggtgttttagacatgaattccttgcccgtgcctatgtcctgaatggtattgcctaggttttcttctagggtttttatggttttaggtctaacatttaagtctttaatccatcttgaattaatttttgtataaagtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctattccattgatctatatctctgttttggtaccagtaccatgctgttttggttactgtagccttgttcttgttatgttttagcaaagagactggtggcattttgcccctgccctagagatttgtgaaactttcaacttcagagagatgatttagggtgtctggtgtgagaaatttctaagcagcaaagcattcaagaggtgacttgagtgctgttcaattttaaaacattaaacatttaaacataaaacatttaaaacattaaggcattcagttttaaaaggaaaacagcataaaagtttggaaaatttgcagcctgacaatgcaatagaaaagaagattccattttctaaggagaaattcaagccagctgcagaagtttgcataagtaatgaggagctgaatgttaatcaccaagataatggggaaagtgtctccagggcatgtcagaaacctttacggcagcccctcccatcacaggctgggaggtttaggaggaaaaagtggtttcatggggctggacccagggtccctctgctgtatgcagtctagggacttggtgccctgtgtcccagctgctccagccgtgactaaagggccagggtacagcttgggctgttgcttcagagggtggaagccccaagctttggcagcttctatgtggtgttgagcgtgtggtgcacggaagtcaagaattgaggtttgggaacctccacctagatttcagaagatgtatggaaacacctgggttcccaggcagaagtttgctgcaaaggcagggctctcacggagaacctctgctagggcagtacggaatgaaaatgtggggtcagagcccccacacggagtccctactggggcactgcctagtggagctgtgagaagagggccaccatcttccagacctcaaaatggtagatccactgacagcttgcactgtgtgcctggaaaaccaataccagcctgtgaaagcagctgggagggaggctgtaccctgcaaagccacaggggtggagctgcccaagaccatgggaacccacttcttgcatcaccatgacctggatgcgagacatggagtcaaaggagatcattttggagctttaagatttgactgccctgctggattttggacttgtctgtggcctgtagcatctttgtcctggccaatttctcctgtttggaatggctgtatttacccaatgcctgtatccctgttgcgggaagtcacggaccacgaatggagggactggctggagctgccgcagaggaacataaattgtgaagatctcattttaatatggacatttgtcagttcccaaataatacttttataattttttatgcctgtctttaatctctcaatcctgttgtcttcataagcagacgatgtatgtcacctcaggaccactgtgataattgtgttaactgtacaaattgattgtaaaacgtgtgtttgaacaatatgaaatcagtgcaccttgaaaaagaatagaataacagtgatttttagggaacaagggaagacaaccataaggtctgactgcctgcggggtcgggcagaaagagccatgtttttcttcttgcagagagtcaataaatggacatgcaaatagggaagatatcgctaaattcatttcctagaaaggaatattgatattaataccttgggaaaagaatgcattcctggggggaggtctataaacggccgctctgggaatgactgtcttatgcggttgagataaggactgagatatgctgtggtctcctgcagtaccctcaggcttaactagggtggggaaaaactccgccctggtaaatttgtggtcagaccagttctctgctctcgaaccctgttttctgttgtttaagatgtttatcaagacaatatgtgcaccgctgaacagacccttatcagtggttcttctttttccctttgtcctgttccctcagaagcatgtgatctttgttagatccttattagtagttctgctttttgccctttgaagcatgtgatctttgtacctactccctgttcttacaccccctccccttttgaaacccttaataaaaacttgctggttttgaggctcaggtgggcatcacggtcctactgatatgtgatgtcacccctggcggcccagctataaaattcctctctttgtactgtctctctctctcagctggcctacacttatggaaaatagaacctacattgaaatattggcagcagggtcccccaatatatccccgttgtatctaggaagtaactaacttgcttttgatttttcaggctcataggcagaaggtacttgccttgtctcagatgagactttggactgtggacttttgagttaatgctgaaatgagttaagactttgggagactgttgggaaggcataattggttttgaaatgagaggacatgagatttgtgaggggccaggggcagaataatatggtttggttgtgtccccacccaaatttcatcttgaattctcacatgctgtgggagggattcagtgggaggtaatttaatcatgggggcaggtctttcccatgctgttgttgtgatggtgaataagtctcacaagatctgatggttttcaaaaggggagcttcccagcacaagcttccattctgtcttgctgccgctatgtgagaagtgcctttcgccctctgccatgactgtgaggccttcctagccatatggaactgtgattccattaaacctgtttttcttcccagtctcgggtatgtctttatcagcatcatgaaaatggaccaatacactgttgcatattttctttggcaaaatgtctattaagatcttttgttaattttaacgattggatttattttcttgttatttaactttgagggctgtttacatattcttggttaaagttctttatcaaaatatatgacgtgtaaatatttcttccatttagttacctgtcttttcattctcctaacaatatctttgaacaagcagacatccttaattttgatgaagtcaaatttattaaattttcttttatggattgtgcttttgatgtcataatctactaaatctttctctaacccgggatcacaaagactgtcctctatgttttcttctagaagttttatacatttagtttctgtgctttggcccatgactcactttgagttaatttttgaatatagtatgacatatagattggaggggtttttttccatactggttgccagttattccagcaccattgcttgaaaagtttattcattttccactgcattacctttggattttcattgaaagccaattgtccacatatgtgtgaatgtgattctgtttctgtgctctctctttttttttttccatcagtgtctttttttttctttacatcagtactacactgtctggattacaatagattggtcataaaacttgacattggtagtataagttctttaggtttttaaaaaattgttttgtgtgcatgtgatatggtttggatctatgtcctcacccagatctcatgttcagttgtgattcccagtgttggaggtggggtctggtgggaggtgactggattttgggggcagtttctcatggtttaacaccatcccccttggtgctgctgtcatggcaatagtgagttattgtgagacctggttgtctaaaagtgtcgggtgcctcccccaaccctttgctcctgcaccggccatgtaagatgtgcctgtttccccttcactttcccccatgattgaaagtttccttagacctccccagaaactgagcagatgccagtatcatgcttcctctacagcccatggaatcatgagccaattaaacctcttttctttataaattacccagtctgaagtatttctttatagcagtgtgagaacagactaataccgtttgtttgttttggagacaaagtcttgttctgtcacccaggctggagtgtagtggtatgattttaagtcattgtggccacaacctcgtgatgtcaagtgatcctcctgcctaagcctcctaagaagttaggactacaggcattcaccactatggccatctaatttttaaatttcgtgtagtctttggctcttgctgtgttgcccaggctgatctcaaactcctgcttcaagtgattttcttgtttcagcctcccaaagggctgggattactggcatgagccaccacatctgctaggattttgactgggattgtattgaatctataaaacatgttggaaaggattaacatctttacaatattgagtcttttacatgtcttttactttctcttgtttgtagttttgtttaggtcttctttagtgaactttgttagtgtcttttaaggaatttgtttatttcatctaagttgtcgagtttattatgacattctttttgatgctattacaagtaggattattttgttaatttcgtttttggaaagtccattcttagtgtatagaaattccactggttttttatgttgattttgtaacctgtaattttactgaattcatttattctaaaagttttgtttgatggagtccttaagattttctacctgtatgatcatttcaactgcatatgtagataattttactttttctctgcctatttggatggatttttaaagtttttctaacttgattgctctggctaggacttcaagtagtatgttgaatagcagtggcaaaagtgggcatccttgccttcttccagatcttagaagctttcagtttcttcccattgattataatgttagctgtgggtttctaaaaatatctattgtcttggctgggtgcagtggctcatgcatgtaatcccagcactttgggaggtcaaggtgggtggatagcttgagtccaggagttcaagaccggcctgggcaacaaaatgagaccctgtctctgcaaaaaatacaaaaattagcctggcatggtggcatgcgcctatagtcccaactacctggaaggctgaggtgggatcatttgccaggaggctgaggctctgcactctagcctgggtgacagagtgagattctgtctcttaaaaaaaaaaatgtctctattatggtgagataaattccttctttacctgttttgttgagagtttttatcatgaaagtatattcaattttgtcagttgctcttttctacatctactgagctaatcatgtggttttgtctttcattctgctagtgtggtatatcacattgattgaccttcatatgttgaaccatacttgcatcccagcaataaattggccccatttggctagggcgtacgatcctattaatgtgttgttgagttaggtttgctagctagcattgtattgaggagttttgcatctgtgtttactgggaatactgccctgtagttttctttacttttgttgcctttttattggctttggaatcagggcgatgctggccttgtaaaatgagcttggaagtttactttccttttctgtttttggatcagtttatgaagagttcatattagtttttctttgaattgtctggttgaatttaccttttgaagccatctggtcctgggcttttctttgctggaaagttttgattagtgattcaatcttcttgtttattagtttgctcaggttttctatttcttctaaagttagtctgggcagattgtatgtttctaggaatttatctgtttcttttgggttatccaatttgttggcatataatggttcataatagttccttatgatctttttatttgtgtcatttgttggaatatctctttttatttcttattttagttatttctgacttctctttgagttagtctagctaaggtttttatcacttttatcttttaaaaaatccaactcttgttgatttttctaatgtttctatattttctaattcatttatttctgcttcagtctttattattttctttcttctgctaactttgggtttagtttgttcttttctgattccttgttctttgagattattatacttctttggttaattttcatcatatttgaaagattttcagccactattttttcaaatagtgttttttcttctcttctccttcagggactctaatcacaagtacataagacatttcaaattaattcatggttcattgatgcttttttcattcttattttgctctttgttttgttttcctgttgctgtgtctttaaatttactaatctcttcttctgcagtgtctaatctgccattaatcctatctagtataatttgcatatcccacagtataattttcctttgtagaaggtcagtttcagtctattttctttcatatctctacttagcaagttttatctttcctctagcttttgaaataagaaatgtagttaaaataaccgttttaatgtctttgctactcattctgtcacctgcttcatttcttgattagttgctccccacaagcatacactggtcagttgtctgccaggttcttcctttgtgcagcccactggccactgtgtcatccttatgctccaagcttcatctcatgaacttagggagatggctggagctctcctcagctcttctctctacactgcagtctctctttaggtggtaaactgtggcaatcatagggcccaccttgtttgtttctcatctctcagtgatcactgtccttcgtttcctgatgtctagggtcttgaaaactgttgtttcatatactttgttcagtatttcagtttataaagttgagagggaaaatctggcctcttttactccatataggctggagcctgaagtcaataagtatatctccaattgatataatttcatgaaaatatacttgcacagtaagactggtgaaaaggtaaagtcagctgggcacagtggctcacgcctgtaatcccagcactttgggaggtccaggagggcggatcatctgaggtcaggagtttgagaccagcctggccaacatggtgaaaccccatctctactaaaaatacaaaaattagccgggcgtggtggtgggcgcctgtattcccaactacttgggaggctgaggcaggaaaatcgcttgaacccaggagggcttgggttgcagtgagctgagatcgcgctgctgcactccagcctgggcgacaagtgcaaaactccatctcaaaaaaaaaaggtaaagcgtttgcttcaacagcatcatctttcattccacctcagaagtggagcctctctttcgttttatgatgactttgtttttgaatgaataaaacaattggcaatgagccaatttaaattattcctgttttaaaatgactgtagatttcattatttcatactctttgtcacttttttttcccaacactgtcttagctaatattatttcaaaaatctggtttagaggaagagatttgaaaacatagtctaataatctaacctttgagttcagaaggaaaaaagtatgctaatcctaatatttcagcaaagaacatttaatctataagttttttttttaaaataacaagatgtacgtgttctttctggtaatcttacattaaaaccatggatatttatgtcagccatttgtgtaaatgccaacatatataatttattgataaagtcatattaatgatccctttatgtgtcaagctttataaactctctcttaactactttttgctgctttaggaagatgaataagcttgctaaaagtagaagtttactcaggtgggctaaagaacataaattctattgactcatattgcaggtagagaaaccagccctttcttaaatgagattttattctgtatgttaattcttttataggtatgaatagaaaaagatcattattcaaggaattatgcataaaatattttcagttgaattctagttgggggaggtgatgtgcagtttgtcatgaagaattttttttattgacagataatctagataatgtgaaccttatgcttaactactgcttaacttactaagcttcttgcctggtgtgtattttacttaatcttttaacaaaatgaacttccaaatggacataagcatttagatacttgactaagggagttaacaacatttgataattagatctttctaatagtagtattttaaaatatttgcttgcttttaatagtagtattacttctaatagtagtattttaaaaaatttgcttggttttaaaatgcttttacctttttacggaaatagaggtttaaaactcttttacatttgtcaaatgattgctattaaagctttgtctgagtattgccattttttcttaattgttggtgcttttaattttaaaagtacattttataatctaattattgccatgccagaaacctctcaggcagaattttagagaagttcatttttaaggtttcttgtggtccagtctttatagaaaattttcagaattgaagaactgtgtgttggtcagagtgatctgttagtcaatcttatcagatttttaaaaatattaaattcaacacaatgatgtcttggaactagtttttatgaggtaatatttgtctatttcttcggtgcactatagcaacaggctcctgggtttctgttgatgaagtcaacctgaaatagcctgaaaaccaaaacatctgatgatagagactgttctttgcctagatatgtctaagtcttgaccctgagtctcaagataccaagttgagtccactaagaagttctagtgaaagcactttcccgttttgcaaaacataccttccattcttaccgtgatgatgcattcagcttcctgacttctcattatatggtattgctgtcacaacgtaggacacaggccatgtacagggctggtaggattacccaccacagagcatataccagtggtttccaaagtggagtttgtgcatttccttgcattcataaagtaagtcgttggactgtgtgaagaaactattagaacttgcatttatatttattgttatgatttttaaagtctttgttttgtctgtatatgtcattgaatagtatatatgtagcttataaataattaaatacacatatatggggtatagatgctcaaattttgtttttactgatggtagtatatgttaaaaaaaatttcaagagcaggtaagactggtatagagcatctgggcaagggtttgattctgggatctcccgtgtcctccgtcagtgaacttcgtgctgtgtaaaatttgggtgtctgtgtctgggtttttcttgtgagaagattcatagctctcagcagattctcaaaggagtctttggccctaatgataaaattacttatctgagatctctgggttgaagccactgaagcttgttttggtaggactatatcttgtttaaagatcacttcctaggctaaatgaaatggtactgtatttgaaaaataaaacttataattagatatgtattccttttaacaaagtaaagttttattaatatgaatagctgagaaactgtagccaagattgttgtcatcatctcataaccatgtgtgacatatgctgtgtactcttctggtgtctgcattttaacctttttaaaaaagctattttattgtatgttttcattaattatctaccttaaaaaaatattttggtatattactgtcttttaatttcaaacacatttgtcctgggtagaagtggctacagaagagctacttttgagatctcctgtttttatgacaatgtttgtatttggtttttctgttgtctctctaagctgcttttgtagaggctatctgtagtagattatgccattgcattggagggaggattagagttcagctcaaaggtcaactgataatgtaaaattgagtatagtcaaagttattcttgagatcacccataaaaatccttaaatcacccttaaaatacaaggtacataattttatttatacaattttatagacgattgttattacttattctaattctttgtagtttaaattttatatggcccccaaatgctctatccttttttccttgaagaatgttgacattcccattatctgtctcttgaccgacacctgaatgatgtgatttatttatctgtcagtggtcagaaaaatcctaccattcatgtatttttttccagtaaatactggacctggccatgtgctcatttaatagaatgactatttaaactatttttaagtaaaaatacttttacaaatgtgtataggtgaatttaagtaacttcaatgcatatattagatcatcctactgtatttcctgctttgtctttttaccctacaagcctataagcattaaactcagattaacaatttttaatggaaggaaattaccttatttattcatttatattatacatattaagtgtgtataagacattattctgggcactgggattataggggtgaaacaaagttcctgttcttatagaacctacattctagtggggaaaacaggcaataataagccaaaaagaaaaaaaaatagtctatgtatgctgtgaagactcgtaattagtatagaaggccatggaaggtcctgctgttttaggtaggggagtcagaggtttcctgtccgaggagatggcatttgcccagagacccgactaaagagaggggacgggcagttcctccagagagcagcagcagaggaggtgtaaggatgttctcaggcatctttttcatcgtgactcttgcttcctgtgatcagttacagccgtcctgtctcggtagagcatgcagtcagccatcctccccatgtaagcagcacgagagcttgatttttaacatcagcatgagttccgtcgaatgtcgaggggcgttcattctgacctcattactcatcacttgctagtgactgtggcgtgtatgtgaagtaggttaggtctggcttgaggctgtcccactagataatagttacatattttaaattaggatttattcattagagcatctcacgtcacagaagtgagaaagtccatagaattcgatctaacttgtactttacttgtagcacactaaatatgtcttaacctgatttcattaagggctattttatttatttttaacaggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctaggtaatcctgaggtttatgggtattttttcctctttctactaaataattttgacatttgagttaatattacatcttcagctatttagtttcccaaatttgtaaaaccttagaggtcaaattattgatcccctactttgtgcaaaattccttcattaagccttagcttccttatctgtaatacagtgatagtatcatcttcctgttagggtttttgtgaagatcaacggaaataattctgtaagatccttagcatagcgcctggcacatcctaagaactcagtaaatattagcccctttattatgacgatggtggtcatggtggtggtgaggatgatacggtgtgaaaagcttatctcttggtaataataccttttagttaaagcttttttgaggcttggattttgcaagtattaggctaacccataagtctcttcattaagccagagaataaattcaagatgaaaacgttagcattcttggcattgatgtaatagaagagaggggatttactgttatgtgttccaagagtcacatgtattgtaatggtgttaaaaacgggtaggtttagctaaagggtacaaacgtaacctatgaatgtatttttatgcttatttccacattagtgctaaacatatttcaagttttatactttaaaaataccaggacaaagtaaattatcttggtttggggtgggagggggttgtaattttatgacagaagaagggaaaggcagtgacttcttgtagaaaatttttaaaaatcctgacattagctcatttacctgagttgacatgatttgaatgcatatgactccatactggggcttttagctattgtaaaaggccacatactgatggattcattaaggtccagttttcagataacttaaacgatatgagcagcaataaagcttctcagatcaccaggcctttccaaccttgatgtttgagagggtgacctttgggaggcacaaaagatttcagatgagctgtccatatgtattttactttgaatatgccctgggaggggatggctcatcaaatattgcaatgcctgacaggaaaaagtcacagctcatttcagctgacacaccagataacttataccttttaatgcttaggtttaataaagctggcccaacttgaagtaggaatcaaacagtcctttttatcagatgtctagcattaaaacttaatttttaagcctgttataatatcagcaagattagttagccatggtttcagataaatttccactttccattcgctaaatgagatggttgcaaatgaactgccgtaactttagcttttgaattaggtattctggacatcattttgctaagaaagcctttattaaagtaataaaacataacctgatataaaaggccttatatgcatgtcagttccttgaccataagagagagtagaattagcaagagttgtataaaactacctaatagatacatttacttttcttccccagtgtttttcagtattctttggggtgtgctacggggcaatttatacatagaaaaagagtcttattaagtatatgtaatgtttgaatgatctgagatcttaacagggatttagctgagacttgtaatttgattgtaaagtagctatcccctttctttctttttttttgtagagatttttttcccctctgctactctgcccattgataataatagtatccatctcagagaatatctagcacatagtaaacactagaaatttagctgtggtgatggtggtaatggacgggattgtttctggagttgtctgcagaagagacacatcagaacgtttcagaatgcataacctacatgacagccaagttttaggcgtgaactcagataatcgatcctaaaagggtgccttcatttcagctcagtcagtgggtaccgcagtgatcctctgtcttcactcagtcccttttctaacaagcttgattttagcacacttcctcaactccagcagctgtgggttcctattgtcattcctgggacctgaccattttttgtgttggattgatttcttttttcccttcccattcaaacataggctcagttttaccttttctttcattaagatatgcaggtgacaggaagattaaaatttggagtgctatattagtttatgagtgatgtaaaactgcctaataggtcagttaccatgtgaaattttagggagaaaaatcttttccaagtaagttgttgagatgccagaaaggtctgagcttcgtgaaaagtattttctcaacatctgccctgtggaagtgctgctgtgtggccataggccacatgatgatcatttggtcaataacagaccacttgcctatgtgacagtggccacagcagatgatcatggagctgaaccgtttctgccagcagtggcgtggcggctgttgtaatgtcctggcgccacgcatcagcttttctaggttcatatgtttctagatgcacagatatgtgccatggtgccgcagtggctgcagcactcaggacagtgacatgctgtctgcttggtaactgaggagcagccggccacaccctgcagcctagggatggcatggctgtgccctctgggtgtatagatacactctatgatggcatcacagcgacagaatcgctcgacagcgcatttctcagaatgcattcctgttgttcggcaacacctgactgtgttgctgtatgtcattgtgtttcatttttattaaagtgcttgacgctccagtgccacagaagctcttacattttcttctgccctttctccctgtgagagggcaatgttggtctgtgtatcaggtatattatgtaaataattgttttatgatacagagagaaataaatgtaactttaaaagatagtgatagttttttattctgtgaaatacctttgggtagtgagatattatttatgttcagtttattcttttgtcatttctttattttttagtaatgttttccattcttttctttttaattacatattaatatttggctgtggctttccctacattttcctgcatgtgtgtaaggggcaatttattttactttatttaaaatttttttgagacagggtctcctctgtcacccaggctggagtgcagtggtgtgatcacatctcactgcagtcacaacctgctgagctcaaggaattctcccacctcagcctcccagagtgctgggattataggcatgagccactgcagccagctaatttttgtgtttttcatgaacatggggtttcacaatgttgcccaggcctgtctcaaacccctcagctcaaacgatccttccacctcggcctcctgaagtgctgggatgacaggcgtgagccaccacgcccagcctgtgtgtgtgcattttaaaatgcaagtgggaacgtatctgtctcgggttaggttccctgagaagcacacttcagatgggaatctgcttgccaggaagaggtttattagccgggttgggacaacggaagaggaaggggctgtgcagagggaggaactgtgccgtgatgcagtcacactggaagcctccgctggccctcggggatgttgtgacttcgatggcccttcagagctccactgaactgagaagaagggacaggctcttaggaccctcacgtgctgtcctggaaggggcaggacttccgccttgcagcagtcttcagcttaggccatccccaaagggaggttgccagtagggagaagaaatcattcattcctcaaggggatctggccagcacctcacagctttccaaataacacttagctttgtaaatctcctcttctccctaccctaaccctttcccagccactcagcaatatatcatttctcaccattttcttaatttttttgcagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcatatttggtttataagcatttatatgtggggtttatttgttcttttgttttttccatcttaaatatcatcatggctaaaacttaagggtatttatagtttaattccatttcagttttatagagggcagtaattattctgatgaatgttgaattaagaaatggatattttctttctctgttgtgcagttattggtagatcaatttcttataacccacaatgtagcatcaataattgatagcatgtattttatttaattacttgaattatttagacttgatttctctaattttttccataaaaggactgaacagcacctacttgtggtctggacagcttaacccagagttcctggaagaataaatgctgttagcatctggttaatttactggcagacagaagcctacttacagtggctttcaactttttgaccacagtaagaaataacccattaca

SEQ ID NO: 17610 - DNA, 7644 bp, Human
atttttagtagagtcaaggtttcaccatgttggccaggatggtctcgatctcttgacttcgtgatccacctgcctcagcctcccaaagtgctgggattacaggagtgagccaccacgcctggccaaatagtgacattctaaccattgcctatggaataggagacatgcttctatttgttgaaattgtcatccctcatgtaaccagcctggggaagaacattcaagggggcataaccccctccatgggcacaaactgagtcttgggctctggtacaaccagggttctactgaaaacttatcatttcccattagtgttaccatagcaacacgaatgtcttcattcattcccctagtgtatgaacagagctacactcaccccacctgttctcccaagccccctcaaagtcctttcatctctgagattctgtgattcaattaattatcaccaatgcctgcactgctttttgtcgttttcatttattccatctgctgagtcaccgtgtcctgctctagatgagagtggttattcacaacggttattcagccgtcagttgccatggacaccgcacagcctgcttccttcatcacccattaattctcagcaaggctggctgtaagcatgggtaccactgcagttacccaatacccaaggggatcaaactctcctagaaaaggtgggggcccaatgacgcatgaacaggagcaaaatctctgctctcaacagtggaaaaataaaaaacagcctacggctcattacatctggtcaaaccatgtggaggcagcagtttatcaaataagtcaacaaggtaccattttgttttctggtccatctttggcaaatgctttagtctgtttgctaaccatttgaaggtatattttgatactgaaaagttgttggctgggcatggtggctcacgtctgtaatcccagaactttggcagactaagctgggccgatcatgaggtcaggagttcgagaccagcccgcccaacacgatgaaaccccatctctactaaaaatacaaaaaattagccaggcgtgggggcgtgcgcctgtaatcccagctactagggaggttgaggcagaagaatcgcttgaacccaggaggcggaggttccagtgagccaagatcacaccactgcactcctgcactccagcctggtgacagaactagactttgtctcaaaaaaaaaaaaaaaagttgttatgcagattactagctccccttgaaagcaaaatgaaggaggcttcaaaggcaggaccctccaggaattggttctgcatagggggtttgcaagtggtggtgcatgggcagctgacctagaagacacggggcagctacaagccaaacccagcccagcacagagggcctaaggagaagaaggcaccgagggtgttccatggtagggggagggtgaaaggacttcagaggtgaccaggatgtgagccactagaaggagagaacagggccatcagcccacaacccattgctcctggtaacacgttatgtttgcagagtccagtggaggggacggggaatcaatacatcaccccacattcacacgcttgccaaacatcagtggatggcgaaatccactttccctgaatctaagcccatcgggttcactccctcacctaccaccacccacaaaggtccctatgtagttcgagagataagtgccaggcctctgacccccaggatatggtgggaagcattgctcctgacccagggagcttggttcctgcccctcaggtacagctggagagctgccgccaccccgctccagcccctcaccatgaaggtcaactcccctatccttcccccacatcctggatgactgactgacactaaatgaaagggcggggcagggtgatgggctgtacctgtgccccaccccattcctctcgcctggactcatatggcagggtaggggcggggtggggggacagttgggagggaccttgagggctttataaggcaggcctggagcatcaagcagagcagagacctgagaggcaccaggcccagccgtggcaccacacacctcccagctctgcaggtgagaaaacccaggaggagaggggagaggctaggaagtgggttgacaggtcctctcccccatcaaggtaccaggccactggccagagtctggggctcaccccttggggtctccagagctgggaccctttctttatcccaggatggaactaggtcttggctccagtacctaccctggtattcccaaccttgccttccacctgcccttctgccgcagccggggccctgcccttagcctatcccttcacactcttcccagccctgggaggtgaggaggactggggttcttctcctttctctcagacaagaaaactgaggcccagaggcaagatgtgacttgcccaaagtcacagggattattaggcaaggctgggataggaatccacagctcctggatcccacttcaagccctttcctagaccagtgccatccaaaagaacgtcctatgatgcaggaaatggtcttcatctgcactgttcaatatggtagccactagccacgtgtgcgcttgaaatggggttagtgtaaggaagtttttgttgttgttgttgtttgtttttttatatagagtctcgccgtgtcacccaggctggagtgcagtgacatgcaacctctgcctcccaggttcaagcaattctcctgactcagcctcccgagtagccgggattacaggcgcctgccacaacacccagctaatttttcatatttttggtagagacagagtttcaccatgttggccaggctggtcacaaactcctgacctcaagtgatccaaccccctcagcctcccaaagtgctgggattacaggcgtgagccactgcacctgaccataattttttaatttaattaatttaaatgtaaagagccacatgtggctggtggctatagcactgaacaacacatgtggttagcatctgacaatacagctccagatcactgatttttcaaacatttcttcagcagcagaattcttttcttccaaagaaaacctaacagaaaacctgattatgaaaaacttaatggccaggcaccgtggctcatgcctgtgatcacaacactttgggaggctgaggcaagcagattgcttgagctcaggagttccagaccagcctgggcaacatagtgagacctcatctctactaaaaataaaaacaaaaaaattagctgggcatagtagtgcacacttgtagtcccaactactcaggaggctgaggtgggaggatctcttgagcccaagaggtcgaggctgcagcgagtcaggatcacgccagccactgcattccagcctgggagacagagcaagattctgtctcacaaaaagaaaagaaaaaaagaaaaacttaaaagcagtacagtattttattaatacaaatgtattctgacaagagaaaatttttatcattttcttatgataaagccaatcagaatagtgagaccaaaagcatacaaaaatagtgagtccagggaatagatgagcatttgaattttatgtttgtttgagattccagtttagttctgtattatgttttccccaaacttgattcaccctgatacataattgctaatggtgacagcttaattttttcttaactgcttcattataatcacaggatattcctcagttaagcaaaaatgacaggagaacctttcctctcagggctgcacaaaaatcagtgtgagctggccaagcattgaatgtgctgcagtctccaaagtgataacatgcggtctgtaacacagctggatgtccatgttcctttggtattactatttaaaagtttcactttttgtttttgtttttttgagacagggtctcactctgtcgcccaggctggagtgcagtggtgcaatctcggctcactgcaacctccacctccccggttcaagcgatcctcccacctcggcctcccaagtagctgggaatacaggtgcatgccaccatgcctggctaatttttgtattttttgtagagatggggtttcagtatgttgcccaggttggtctcaaacttgtgggctcaagggatccatcctcctcagcctcccaaagtgctgggattaccatgcctggcctaaaaagttcactttaaataacaagtcttgggctgagcacagtggctcacatctgtaatcgcagcactttgggaggctgaggcgggaggattgcttgagcccaagagttcaagactagcttgggcaacatggtgaaaccctgtttctacaaaaaatacaaaaaaaattagctggacgtggtggtgcaagcctgtagtcccagctcttctggaggctgaggtgggaggatcacctgagcccaggaggtagaggctgcagtgagcagtgattgcactactgcactgcagcctgggcgacagagtgagaccctgtctcaataaataaataaattacattatttaaacagctacagaaccactaacatggcctcaaattctgcagaacagaaactagggaaaccattgccctaggatttgactttctccaatagaagcagtggctgtaatcggggtaggtaaagagaaaaaacacaagacttcggggctggtgtggaactggcagaaactggagaactgatctgaagaaatagtccacaactccacacagaattgcagactcacccgggtgcggtggctcatgcctgtaatcccagcatttgggaggccgaggcggctggatcacctgaggtcaggagttcgagaccagcctggcaacatggtgaaaccatctctactaaaaattacaaaaaattaccgacagcgatggtggcacgtgcctatagtcccagatattctggaggctgaggcaggagaatcacttgaacccgggaggcggaggttatagtgagccgagatcccaccactgcactccagcctaggcaacaagagtgaaactctgtctaaaaaaaaaaaaagaaagaattgcacactcatcagcaggtagaggcctggagccacatggttcagtcccctgcctctgggcctctgtggggacagcctcacccttaagctagtcccttctcccctttgcagacgagatgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcaggtaggagctgctgactgccctgcttgcctcacttggccaggtttggccaaggtctccccagactggctctgacttcagttcctggaaggtaggcatccttcccccattctcgcctctctcacctcctcagacccgtccaagaagcagggaccatggctggaggaagaagaagaagcctatggatggatggacttcggccgccgcagtgctgaggatgagaactaacaatcctagaaccaagcttcagagcctagccacctcccaccccactccagccctgtcccctgaaaaactgatcaaaaataaactagtttccagtggatcaatggactgtgtcagtgttgtagggcagaggagggggactcatctgggggtgaagttgtggcagggagaagagctgagtgcctcttaggggcagggaccctggctgattcttcttgggtcccccagagccccacattgaacgagaatccacaggtatgggcaggataatatatggtagggttcatagccagagtaacctttttttttaatttttattttattttattttgagatggagtttcgctcttgtctcccaggctggagtgcaataatgagacctcagctcactgcaacctctgcctcctaggttcaagcgattttcctgcctcagcctcccaagtagctgggattacaggtgcccgccaccacacctggctaatttttttgtatttttagtggggacggggtttcaccatgttggccaggctggtcttgaactcctgacctcaggtgatccacccgcctcggcctcccaaagtgctgggattacaggcatgagccaccgtgcccagcctcagagtaagctttttaaaagataaaccgtgtcacactcggttttaacgttgcaatgtttcccagtgcacttagaatacaacctgaactccctgccacagccctgaaagctagccctgaggttctcctcccactgtgcgccaagtggcttccttctctttgtcctctcggtcctttcccttacacagacacgccatgttctctcttgctcagagcctccgaccttgccattccctgtgcctgcaacgctcttccccaggcacaaatatggtgggctcccctttcctccttagctcttgggtgaaatgcctcttcctgagagacctaccctttctgctcctcacccttcacacatagacccagttattctctaccacagggtcaaataaaagagaaaaaattaagctttttaaagaatgaatgctagttgtattcagaagtcttacagaggactatagattgaggcctccagcccaggagcaggctctggcacaatgtttcagcccattgcttatatacatctgggggctaaaggtggaggttccgtatgtgcaaaatcccatcagacttgctcagaattacatgacagcagaatcacagcaagatttgggtcctagatcacagaggcatcatcactaacctcgtcagatgtcatcttggaaatgttctgtgtcagaaaagccagggactaggattatttctcttttaagaaacgtgaagactcaagccgggcgcagtggctcacatctgtaatcccagcagtttgggaggccgaggagggtggatcactttaggtcaggtgctcgagaccagcctggccaacaaggtgaaaccccgtctctactaaaaatacaaaatttagccaggcatgtgcctgtagtcctggctactcgggaggctgaggcaggagaattgcttgaacccgggaggcagaggttgcagtgagccaagattgcgccatgacactccagcctgggcaacagaacaagactctctttcaaagaaaaaaaaaaagaagaagaaaagaaaagtagtgactcagccaagagacatgggagggcctcaggctctctcctgtgctgtcttcaaagcatctttccggagggctgcacgtctgtctctagtcacagagtcaggtgctttgtgaaactgtgccgacaagcagaaaggagcaaacacagcttcttaatgtttgttgctttgtctcacaatagcagaatattttctttagaacacatttcacaatctgtagttgttttgtttgccagtttattgtctgcctctcgggcaaaacaggaaactgggagcgtgacaagtccctcctcccttctgtatcaccggtggcaagaataggaggaacccaataaatatttgtaaataattgctcatgagtggctgatgcaggcattgctggtgtctcactccattccatcattgttcttgtgcctgttgacaccattaccttgagctacccgccacctgagggct

SEQ ID NO: 17611 - DNA, 19310 bp, Human
  misc_feature (1)...(19310): n = A,T,C or G
gcaacctgacccctgctcatcactacaatgactttcgtttcaagacctatgcacctgttgccttccgctacttccgggagctatttggtatccggcccgatgattacttggtaagcatctggatatcaggacactgtgactccagtatcagagggatattcccaaaggaaggccccttttctccacagtctcgctctggtttttatttagaaaagaattgcatctgtagttgatttttgtgttgggcaaggccctgatgtgtctaaatctcttagttcttctctgtttgccccagtattccctctgcagtgagccgctgattgaactctgtagctctggagctagtggttccctattctatgtgtccagcgacgatgagttcattattaagacagtccaacataaagaggcggaatttctgcagaagctgcttccaggatactacatggtaagggagagagaagcactgtccacctgtgctgctcacttctgggcaaggctggggaggctgtcttcagcagggtaaaacagtgtcagcacttctatcttaagagtgtagttcaggccaggcacggtggctcatgcctgtaatcccaggactttgggaggccgaggcaagaggatcacaagatcaggagatcaagaccatcctggccaacatggtgaaacctcgtctttactaaaaatacaaaaaattagccaggcgtggtagcgggcgcctgtagtcccagctactcaggaggctgagacaggagaatggcgtgaatctgggaggcgaagtttgcagtgagccgagatcctgccactgcactccagcctgggtaacagagcaagactccgtctcaaaaaaaaaaaaaaaaaaatgttgttcagttttgtgcttttcaccccatttcttttgcctctctatggtaaaaggggttttgtttatctgttctgttttaagtgttgttgatctcccaggctcaagtgatcctcccacctcagcctctcacgtagttgggactaaaggcacgcaccaccacacctggctaatttttataaacttattttcttttattttttcgtgacggagtctcgctttgttgtccaagctggagtacagttgcacaatctcggctcactgcaacctccgcctcccaggttcaagcaattctcctgcctcagcctcctgagtagctgggattacaggcatgcgccaccatgccaagctaattttttattttttagtagagatggagtttcaccatgttggtcaggctggtcttgaactcctgacctcatgatccgcctgccttggcctcccaaagtgctgggattacaggcgtgagccaccgtgcccggcctaatttttataaatttttagtagagatgaggtcttgctatgttacccaggctggtctcaaattcctgagctcaagtgatcctcctgtttggcctcccaaagtgctggggttacaggcatgagccactgcacctggctattttcgtcttctgttcttagttcagcttctagtttggggaatgaggtaggttatttcccttggtaatactctctgcagccttactctgattgctatggaggttctggagaagttaggtaactctccttacctgccttaccatccccaagaatatactatacccagggcagagagtgtcgtcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgagtttgttacttagacatcaaaaatctcagttactaaaacagcttgattgttcttaggcattaagtttgtgggagatggaactctgttccttagcactgtatgtcctgggctgtatttaaaataagtcttaattagttcattgccattcctttacatttttactttctccccgtttatcctcccacaatgggatttatttccttctctagctagcctgggcctcacagtcaaatgttctgcttattttcataccaacatcatccttcctcagattttggtcctggctgccaaatccaaatttatattttggaagctgagtgctgctgaagaatattacacaaccgtgtatactggcatttacagaattatgatatccaaccccacttgggctttcaatatcgatcttcagtccatttgctgttgctctcaatagggatttcagatgtttggcattctaatcaaaccattttctgactctcatctccctagctttgtttctcaacaagctaccttaactttttatcctatttcatcctctcatgctgcccctgtcaccaatggataaatgtatctacattttactttattttttattttttgagatggagtttcactcttgtcacccaggctggagtgcaatggcacgatctcgggctcactgcaatttccacctcccagattcaagcgattctcctgcctcagcctcccaagtagctgggattacaggcgcccatcaccacgcctgggtcgtttttgtatttttagtagtgacagggtttcaccacgttggtcccgctggtttcaaactcctgacctcaaatgatctgcctgccttggcctcccaaagtgctaggattacaggtgtgagccaccgcacccggcctagatatcactcttgacctctgtactcttctgtcatgtgaacacttcccactgttgcacatattaaactgtattgtgtttattttacatttgtatccctttctaaatgtataatgtccttgaagacagaaactctctctttaatatctttatatctctgtaaggaggcacagtgcctacatggtggagattcagtaaatgtttaactgaattgaagctagtcatacaaggtcctaccacagatctgttctgtcacaaagtgtactttaccagaacctcattgtggaatcttcacagcacaaatatgtattccttgttcttttgagaaggtagtgttctcttcatggagacatacatggaaagaacaaagatggtcttgtgggctaggcagtgggacttggaaaaattatattaactcaaatgagagaaagctaagggtatgtaaataaagactaaccaggccgggcgtggtggctcacgcctgtaatcccagcactttgggaggctgaggcaggcagatcaccaggtcaggcgttcgagaccagcctggccaacatggtgaaaccccaactctactaaaaatacaaaaattagctgggtgtggtggcacgtgcctgtaatcccagctacttgggaggctgaggcaggaaaatcgcttgaaccagggagttggaggttgcagtgagccaagatcgcgccactgtactccagcctggcgacaaagcaagactccgtctcaaaaaaaaaaaaaaaaaaatttagccttacaggttcactgtaaggctaaattaaataattacatcatgaaagctgtcaagccaggcgtggtggctcataccaatagtcccagcactttggaagactgagataggcagatcccttgagcccagaaattagagaccagctgggcagcatggtgaaaccgtctctatgaaaaataaaaaattaggcaggtgtagtggtgtgtgcctgtagtcccagctacttcggaggctgaagtaggtggatattttgagcctgggaggttgcagctacagtgagccgagatcacaccactgcactctagcctgggttacagattgataccctttctcaaaaaaacaaaaaaattgtgagatcctgaaaaatatttttatttcttccaaggctcagatcatgtttttttccttccattaggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccagtaagtgggctcagggccactaggggggagaacataggcccacagcacttttcttttcttttttttttttttttttttttagtttcactcttgttgcccaggctgatgtgctgatgtgcaatggcacgatctcagcctactactacctccacctcctgggttcaagcgattctcctgcttcagcctcctgagtagctgtgactacaggcacctgccaccacacccagctaattttttgtatttttagtagagaaggggtttcatcatgttgggcaaactagtctacgaactcctgacctcaggtgatccacccgccttggcctcccgtagtgcagggattacaggcgtgagccaccgtgcccggccacagcactttttctttaggaagggacccagcttctggaaaggagtagccttgactcagcagttggatcagtaacattattgttgacagaagtatagaatgagcttgaacgagctttcttaatacaaaatgaaaagaagattaatttcgggtttatagtatatgtgggaaggagagctgttcaagagttaaagacttaaaaaattatagtcttaaatgcatgtctgcaaattatattagaactttattagggctgggcacagtggctcatgccagtaatcccaacactttggaaggctgaggcaggcggatcacttgagtccaggagtttgagatcagcctgagcatcatgatgagacctcatcactacaaaaactcaaaaattacctgagtgtgatggtgagcacctgtggtcccagctactcaggaggctgatgaggcagaattgcttgagcccaggaggtcaaggctgcagtgagccactgtacatgccactgcactccagcttgggcaaaaagaatgagaccctgtgtcaaaaaaaaaaaaattgttatagacttctttgtggaaggcatccttcttcatcatgcctagtaagtgtaattactgaagtgtcacaaatatcttagattgtttcatttttttaaggtatcctgtaatatgactctcaagaagagtgtcttagtgggcataaattaagatagcaaaagtactgaagaagttgagttaattagagcattcccaaaattgctgagtagtggcaattttagattctctttggtggaatcagagtggaagaggtaggcaagaagatttggagaaaactagattataatacatactgtagagagttcctggggttagaggaaggatctcattttctcctgtttttttaatgtatttttttctctttttgttttcttgatcacttattatctgaccttctggtttatggaggatgaggcagttatgtgtaggtttcacttccccatcctgatctgactaaactagccaacagattttctcaccctttcctttttgccttttccagtatgggtggcatccctgcccggaatagtaaaggggaaaggcttctgctttatattggcatcattgacattctacagtcttacaggtgaggagcatatggatcccaaattaagagagggtggatacagataaccagtcacgtttctcttttagataggtttgttaccaagttcttccggaagcaagaacagtgagttgcagtctggctacttacttcattagttttcagatggtttatttccttgattttgcctctttccccggcctttataacccttcctcccccatctccccagacataatgtataccttctgtggaaagctgagtcagtccttggaagcaccagggtagaatatgccatctgtctggctctttgcaaaaacctatgagatgagtcatgttccacatggggatacaactggaaacgttacccttttccaaggaggaaaaacaggagggtcactgtgttctgtaaaatgtattagactgtggaactaagaggcaatggagtgatcatcagggaggagctggaattgttagaccccagttttgttcctgtaaggttttaaatactaatgaggactggacggtacttgatttgttggttcagtattatcatccagttttaactaccctttccagtcttgcccatctgttccttcagctctccttttataataaatattcatgttcctgatttgtcagggacataaattgcccttttcccatggggggaataattgacttacctagaaacaacattggtctctgtgatgaaccagcactgccatgcctgttcttgggaaaaccagtgtaccagtagatgtgctttctcagcttctgtcttttcaagattttctattacccctttaaccccctaaaatataaagttattaaggtcatttatttaaaaatgacgtgagtaggtgatgtacatttttcttgcaggtttgttaagaagttggagcactcttggaaagccctggtacatgacggagtaagtagtaatactagaggctctcttaccgtacacttctgcctccatcacttctgattggcctcagtttcttgcaattttttcttttttcttttttcttttttttttttttgagacagggtctcactctgtcacccaggctggagtgcagtggcgtgatctcggctcgctgcaacctccgtctcgcagtttcaagtgattctcctgcctcagcttcccgagtaggtgggaccacaggcgcgtgccaccacgcccagctaatttttgtatttttagtagagatgggtttcaccatgttggccaggctggtctcaaactcctgacctcaaagtgatccgcctaccttggcctcccaaagtgctgagttgagatggagtctcgctctgtcactcaggctggagtacagtggcacaatctcagctcacttcaacctccatctcccaggttcaagcaattctcatgcctcagcctcccatgtagctgggattacaggtgcccaccaccatgcatggctaagttttgtatttttagtagagatgaggttttgccatgttgaacaggctggtgtcgaactcctgacctcaggtgatccgcccacctcagcttcccaaaatgctaggattacaggtgtgagccactacgtctggccccttccgtttatttcatctgtaggttttacccttctgctaggggctcagtctgggggaagatggcccttggactagagttcctcttgccgggcctcctaactctatagcatttcttctgctctgcaggacactgtctcagtgcatcgcccaggcttctacgctgaacggttccagcgcttcatgtgcaacacagtatttaagaagattccctgtaagtggtttctaccaattgactgcctactcctgcccagtggctcccttaccccaagagaacagagggcaggacacctctggtagggagctgccaatgccagaggcctctccttccacctacatcccatgagagccatttcttgtcctttgtgttagtctgtcatagtcatttccaagttgctgtttcccccttggctcttcctgcatatgtcaatgaggtgaggaccatttctggggaattgggatttgcaaaaaaataaataaataaataatgtgtagttgtggatgtaggatccatgccacagagataggcagagcctatgtacagagatacgcagtgaggttaatggtgttctgttttgtcttctagactatctcaggtggttacagaagcatttactgatttctgcttagcacatgtttttagtctcttttctcaactttcttgtttaggaagtgccaatatttttttgcaaatcttccatgctgctgccatagcaaattctagcttctctttcccttcttctcatattaggcatcattattcccatagcgagggagaggggacctaggcatgccagtcttaagggatatggaaaaaccaggctgggtgcagtatctcacacctataatcccagcactttgggagaccaaggcaggaggatcggttaagcccgatagtttggaaccagcctgggcaacatcatgagaccttgtctctacaacaaattttaaaaagataaaaaaatctttacaaagtgataaaaattacaagtatcaattatttagtgctgggcacatacatgctaagaaaatgtagagtgaaagagttatctttcttggcccggcacggtggctcacacctgtaatcccagcactttgggaggccgaagcaggtggatcacctgaggtcaggagttcgagaccagtctaaccaacgtgttgaaaccctgtctctactaaaaatactaaaattagccgggtggtggtgagcacctgtaatctcagctactcaggaggctgaggcaggagaatcacttgaacacggtaggcagaggttgcagtgaactgagatagtgccattgcactccagcctggggtgacaagagaggaaacttcatctcaaaaaaagttatctttctcaggttttactataggatactattaaagaaaaaggggggccaagcgcagtgtctcacaccagtaatcccagcattttaggaggccgaggagggcagatcacaaggtccggagattgagaccatcctggctaacacggtgaaaccccgtctctactaaaaatacaaaaaaaaattagccgggcatggtggtgggctcctgtagtcccagctacttgggaggctgaggcaggagaatggcatgaacccgggaggcggagcttgcagtgagccaagatggcaccactgcactccagcctgggcgacagagcaagactctcgtcaaagaaaaagaaaaagggggcagggcagtggctcatacgtataatcccagcactttgggaggcctaggtgggcggaccacctgaggtcaagagttcgagaccagcctgaccaacatggtgaaaccccgtctctactaaaaatataaaattagctgggtgtagtggcgcatgcctgtaatcctagctacccaggaggctgaggcatgggaatcacttgaactctggaggtggaggttgcagtgagccaagatcgcgccattgcacttcagcctgggcaacaagagcgaaactccatctcaaaaaaaaaaaaaaaaaggaattatgcaatagggtacatttcatctgatggaagtaaagcagtcatcaaggctccatgttggggggttaggtgtggatatgtttcctttcttctaggttttcatgcctcttggaaagtgaagtgagctaacaccttgttctctgaatagtaattcataggcctgtctttgttgacattagccttttcacttttcagaccaactttgggtgtgtgttggggatactagcaattatttgtatctatgtcttggtaatagttgctaaggtagttgctaagtaggctctctctttcccttttgaagtgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggtcagcgctagggctggggtccccatgtgattgggtactccctcccttccttctgagcctttatcttgtctggccaggacctctgctcccatttctatccaggaagcctagctgctacatatttttccttgtatttactgtaccccatcttctctatcttttttccaggcgttcaccttggtcgtcctgatgttttacctcagactccacctttggaggaaatcagtgagggctcgcctattcctgaccccagtttctcacctctagttggagagactttgcaaatgctaactacaaggttggtttattggcccctttctccatataatcttatctctcttttcaagtccttggaaacctctataatttgattgcatcataataaattaccccaaagattagtggcttaaaataacaaacatatatcatactttctgtgggtcaggaatccaggcccagcttagctgggtcctctggctcaagatttctcatgaggtggcatttaagctgttggccagggctggggtctcatctgaaggctcaaacaggaagatctgcttttaagcttatttatgtggttactggtaggattctgttccttgtgggttgctgaactgagggccttagttccttgctggctgttgtctgggggcttccctcagttctttgctacatggacttctccataggacagctcagaacatggcacctgggctatctgacaagtgaacaagagagcatgtgcctatgcagaaaccatggcctcttataacttaatctcagaattgacattctacttgtgctacattctgttcactaaatgcagcccacactcaagaggaaggaattacccatgggtgtgaataccaggaggtgcagggatcattgtgagccatcttagaaactgcctgtcatagtctgctctctggtctccagtaatttacatacctccatgtcgaaaatacactgaccccctcccagggtctcatcccattgtagcgttagctcagagtccagagttttattacctaaattaggtccggttggatgagccccccaggtatagttccttaagcacagctcctcaagtacagttcttctcaatctgtgaacttgtggaaccaaagagacaagttatcctttccccatgtacctagcatacaatggtgagacaggcattagataaccaatatacacatttctgtacataaaaggggagaatgggaggcacaaaaaggagtcattgattttatttgctgttccaaaatccaggaaatgttggagtttcttttatcaggcctcaaagcagaagaataattctccgtggttcttggctctaccctctagactcttggttttgtcttctgagtcttcctttttcatcaaagctagagtgtgtttttacctgagttcttttctcaggctgcttctttccagtagaattttaggggaactagtggtctctattttgtactgtttctgtcctttttgatccaagatggcagtgtttctactgatacagaagattttgtgggcctcctgtgattctccttgggatttactccattagacaaaagccacactcataaatatcttctttatgagacctaagcttcttacagactctgtttttcggttgaaaggatctgtgaaacataatcttctgaacagccttttgtatgactgaatagcacaatcagccctccgtatccacaggttccacatcccagattcaaccaactgtggactgaaaatacttgagagcctggtgtggtggctcatgcctgtaatcccaccactttgggaggctgaggtgggaggattgcttgaggcagtttgagaccagcctggtcaatataacgagaccccatccctttgaaaaaaaaaaagaaagaaacgaaaaaatactgaaaaaaaaaaaaaaagtcgtgaaaatgttatgttgttgctgatatgtactgtacagttaggcctgtacttaacatgtacagacttttcttgtcattattccctgaacaatatagtataacaactatttacatagcatttacattgtattagttatcataaataatctaggaatgatttaaagtatatggagggccaggcgtgatggctcacgcctgtaatcccaacacttgtgagaggtagaggcggccagattacttgagcctaggagtttaagatcagcctgagcaacatggcgaaaccccatctctaccaaaaatacaaaaaaattagccaggcgtggtggtatgttcctgtagtccaagttactcaggaggctgaggcaggaggatcgctcgaaccccggaggcagtggttgcagtgagccgaaatcgcgccactggactctagcctgggtgacagagcgagaccctgtctcaaaagaaaaataaataaaaataaagtatatggaggatgtgtgtgagttatatgcaaataccatagcattgtatataagggacttgtgcattgtggattttgatattcaaggaggggtcctggaaccagtcccccacagatattgagggatgactatactctgaaccaataccttttgtttttctgaggtcttaataagatgtttcacagtcatatgtttgccttcatctttagaccacattttcttggcagtgctctggagcttatccttgctcaaaagcctttttttttttttttttggtagagatgtctcattgtgttaaccaggctggtcttaaacaatcctcctccctctgcctcctgaagtgagccaccgtatgtggcctgccatttcttaattttagcatcgtttgctctctggagaggcttagaattttcaaaacttatcaagttctggcatttttgtttaatagtccttcccataatttctttatcttctcctatattttattataagcatcaagagaaaaccaggtggcaccttcaggactttgcttggaaatctccgtagctagattgtccaattcattaggcacatattctacttctcacataatcacaaatcacattgttgctaaactttgtgctgctgccttactaggatctcctttccttcaagttccaataaaatttttctcactttaagccctcactggtaaccccctttaagtccaaaattctataaacagcatattcaggacactaccttttcactaaaatgctcctccaagccacccccaatgttttgttttgttttgattttgtttttcgagatggagtctcactctgttgcccaggctggagtacagtggcacgatcttggttcactgcagtctctgccaacagggtctccctctgtcacccaggctagaatggtagtggcactatcttggttcattgcaacttccgcctcccaggttcaagcgattctcctacctcagcctcccgaggagctgggattacaagcgtgcaccatcacgcctggctaatttttgtatttttggtagagacgtggttttgccatgttgctgaggctggtcttgaactcctggcttcagatgatctgcctgcctcaggctcccaaagtgctgggattataggcatgagccactgcaccaggccaccacccccaaattttagatttttgttatagcagcacctcaattccaggtacaaaagtctgtattatctattattgtgtaacaaattacccccaaacttagctgttgaaaacaaacatttgttatctcagtctgggtgtggtggctcacacctataatcctggcactttgggaggccgaggagggcggatcacctgaggccagaagttcgagaccagcctggccaacatgatgaaaccccatctgtactaaaaatagaaaaattagccaggtgtggtgatttgtgcctataatcccaggtactcaggaggccgaggcgagagaattgcttgaacccgggaggcagaggttgcagtgagccaagatagtgccactgcacttcagcctgggcgacagagcgagatctgtctcaaaaagaaaacaaaaatttgttatcccagtttctgtaccttagctggatgcctttggctcgggttctctcgagattacagtcaagctattagtccaaaagcttatctgagggaagatcagcttctcagctcacttatatggttgttggcagtattcggttccttgtcacatcgccctatccatagccagctcatagcataggagctggctttcctcagagcaggcaagcaggggctagagcatgagtccaagaagaagatacagtatttttgtaatctaatctcagaatggacattccatctcctgtgctgcattctgttcatgagaagagaatcactaaatgcagcccacacttgagagagaattacacaatggcatggatctcaggaggcagggattattgggggcaatcttagagggtacctacgacacctggagattgaaacagaagagggcagggtactgggaaatattttatagtattcaagaagctaaatatggttaattaaaacagtgtgcttctaaatctagtagcttctcagcctcttctttccaaattctaaattgattccaaagtgaaaattagagaagcagtatgagatttaaaaggagagtcctttgttgttgtcttctaattctttttctctctgcttccattttttttctcctgttagtacaaccttggaaaagcttgaagttgcagagtcagagttcacccatgtgagtatctgggatgtgtgggaggtgaacgttttgcaaggtataaagaggatcactgatggcctggagcaggaagttaattgtcaagattagaggatctgggtacctcctaaatcttgttttttattttttattatttttttattttgtacttatttatttatttatttatttatttttgagatggcgtctcactctgttgcccaggctggagtgcagtggtgcaatctcagctcacctgcaacctctgcctcctgggttcaagcagttctcctgtctcagcctctggagtagctgggactacaggtgcgtgccaccacgcccggctaattttttattttttagtaggcgcagggtttcatcatattggacaggctggtcttgaactcctgacgtcgtgatctgcccaccttggcctctcaaagtgctgggattacagccgtgagccattgcacccagccatcgtgtttgtgtttttgagacggagtcttgctctgtcacccaggctggagtgcagtggcgcgatctcggctcactgcaagctacgcctcccaggttcacgccattctgctgcctcagccccttgagtagttgggactacaggcgcccaccaccatgcccggctaattttttgtatttttagtagagcagggtttcaccgtgttagccaggatggcctcgatctcctgacctcgtgatccacctgcctgggcctcccaaagtgctgggattacaggtgtgagccaccatgcgcggccgccatcttgttttttaaaaaatatttttggtacctcatacttggaggctgaggctgaaatagaaatttcttaacgcttgaattccatttctgcttaatctcatactccacatccttaactttacactctcccttttcagtaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttagacctcttattttttctgattctttttcatataccatctgctcaccctcctactccaccacccaggctcagttttgttcatgttgccctaaacaaaggctgcatactttccagcttgcaacactccagcttcactcttaaggctttatgtccttatatcctcttcctcagcaaccccattatcttcacgaggaaaagcagtgaatgaatatgaggggagttactgtaggtctcttgcctaggttgcaacccaatttaacagggatttgaggttcaaaactcactttactcagttaagtgaggaaaggagagggacagtgggaaaagtaagtttgaggttagctggccctagtgattccctccctttcgttctcttgacctggccctagggcgtcactcttagaagatcatagagattgctttctttagctgttttcttttgtgaggttgagctaaggctcctttgataggaaactagacaaaaaagtaggggcgggccaggcgcggtggctcacacctgtaatcccagcactttgggaggtggaggcaggtggatcacctgaggtcaggagttcgagaccagcccagccaacatggcaaaaccccgtttattgaaaattagcaggggatggtggcatgcgcctgtagtcccagctactttggaggtcaaggctggagaattgcttgaacctgggaagcagaggttgcagtgagcgaagattgcgccagtgcactccagcctaggcgactgagactgtctaaaaaaaaaaaaaaaaaaaaggagcggtgaggttcattctgaggcatgaagatagggaacctttggagagaagcagttaagcaaacagctgcttttcataccactattccctatcttgttaagggcactccaaatatttatatagcagctaatgagcaatgcatggagtagatggagatcaaagaaataattgtccttcaaaagtttctagtttccaggaggaacacaaatcacaaaaacaatatgttatatgtgagacagctacttaagctctctgaaggtggcacagaacataaaagggggaaaaattagcagttacgtgcgaaagaagtgttaagagaatgtttcacttcagcacaaggacctagatgcatgagaatggtctgtttttgagaacaaggaagagatcatgatgagaatattggaataagtatagttagaggcaatattgggaaccctgaaatattttttgccccaataggatgtgatacaaaataattgagagactaacaaagttccatcagaattaaacagaggattggccaagtccagtggctcacacctgtaatcccagcactttgggaggccaagatgggtggatcacttgaggccaggagttcaagagcagcctggccaacaatgcgaaacaccatctctactaaaaatacaaaaattaggccaggcgcggtggctcacgctcgtaatcccggcactttgggatgacgaggcgagcagatcatctgaggttgggagttcgaccaacagggagaaccagcatgaccaacatggagaaaacccatctttactaaaaatacaaaaaattagctgggcgtggtgggcgcacgcctgtaatcccagctacttgggatgctgaggcaagacaatcgcttgaacctgagaggcagaggttgcggtgagccaagatcgagcccttgcactccagcctgggcagcaagagtgaaactccttctcaaaaaaaaaaaaaaaaaaaaaaaattaaccgggcatggtggcgggcgcctgtaatcccagctactcgggaggctgagacaggagaatcgcttgaacccaggaggcagaggttgcagtgagctgagattgcaccattcattgcactccaccctggcaacagagtgacactccatctcaaaaaaaaaaaaaaaaaaaaaaagaagaaagaaaaagcaagtactggattggaagaggaatgggggattctcaaagtttcttttcatttttct

SEQ ID NO: 17612 - DNA, 27659 bp, Human
aactcctgacctcaggtaatccgcctgcctcagcctcccaaagtgctgggattacaggcgtgagccaccgcgcccggcctttttttttttttttgagacagagtctcactctgtctccaggctggagtgcaatggcgtaatctcggctcactgcaacctccacctcccaggttcaagcaattctccggcctcagcctcctgagtagctgggattacaggcgcctgccaccacgcctggctaatttttgtatttttagtagagacggggtttcaccatgttggccaggatggtctcgatctcttgacctcgtgatctgcccacctcggcctcccaaagtgctgggattacaggcgtgagccactgcgcctagccaagactttaatattaaataaagatggctgggcaaggtggttcacacctgtaatcctagtgctttgggaggctgaggcaggagaattgcttgaggccaggcgttcaaagctagcctgggcaacacagcaagacgccatctgcacaaaaaaatttttttttaattagctgagcatgatggcacacacctaaagtcctagctactcgggaggctgaggcaggaggatgccttgagcctaggagttcaaggttacagtgagctatgatcatgccactgcactccagcctgggcaacagagcaagacttgtctctaaaaaataaaaataaaggtgagatgcacaggacctgtgtgtagaatgttatatgagtaaggaaatatagtctaaagtggaaaataaaaaggttatagcaggcatttaaagggagacaggaagagcaagtggatagaaaagtatttgaagagttagggaacaagggagtaacacctgacttgcttctcagtctacccgaagaatctgtaaatcaccaggcatggtggctcatgcctgtaattccaacactttacgaggctgaggagggaggattgcttgagctcagttcaagaccaggctgggcaacatggtgagaccttgtctctacagaaaaatttaaaaaattaaccaggcatggaggcacatgcgtgtagtcctggatacttgggaagctgaggtaggaggattgcttgagcccagaaaatcaaggctacagtgagttctgatcgcgccactgcactccagcctgggcaacagagcaagaccctgtctcaaaaataataagattaaaaatttaaaaataagccaggcatggtggtgtgcacctgtggtcccagctacttgggaggctgaggtgggaggcttgcttgagcccaggaggtcaaggttgcaatgagcccagattgttcaactgcacttcagcctgggtaacagagcaagaccttgtctcaaaaaaaaaaaaaaaaaagaatttgtaaatgtaggccaggtgcagtggctcacgcctgtaatcccagcactttgggaggccgaggtgggtggatcatgaggttgggagatggagaccatcctggctaacatggtgaaaccgtgtgtctactaaaaatacaaaacaaaattagctggacgttgtggtgggcgcctatagtcccagctacttgggaggctgaggcaggagaatggtgtgaacccgggaggcggaacttacagtgagctgagattgcgccactgcactccagcctgggtgacagagcgagactccgtctcaacaacaacaacaacaacaacaacaaaaagaatttgtaaatctatataaatacaacatatacaaaacaacatttcacatatataagctaagaacagaggctaagctgagtaactacaggaggaatgacgagtaatgtaatcagaagtggaggtagtcaggaaagcttcctaggatatgtcttcttatctgattttgaaggagtccaggaagacaaaaagaggaggtgcctgggaaggtgtcatagcaaagggaagatctgaggatggcaccactaaccaatgtgtgtatgtgtctccctttctgttcttttctccctccctcttcctgtagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggacgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggtaaaattctggggagggccagagacaaaaggtggtagagggctgcatggagacaggatgcctcctatatacacacagggttacgctgttctttctgtcctccctgtttcatttcactgataaaagcatggaatgttagaatggaaaggccttagaattcatgtattttgcctgccttagtttacaaaggaagaactcagacccagagagataaagtgagttgcctcaggtcatataggtcatggcaaggctgacgctcctgactgtgtcccaaatcatttttattaaactgcactggccaggcgcggtggctcacgcttgtaatcccagcactttgggaggctgaggcaggcagatcacgaggtcaggagtttgagaccagcctggccaacatggcaaaatcccatctctactaaaaatacaaaaattagccaggcgtggtggtgggcgcgtgtaatcccagctacttgggaggctgagacaggagaatcacttgaacctgggaggcagaggttgcagtgaccagagatcgcgccactgcactccagcttgggcgacagagtgagactccgtctctaaataaataaataaataaataaactgccattccattaacatctactatgttaatgagaactgtggcagaagccctccacaccctgacctgagacttgagatagctaccagagcctctcagagcagcatctgtgggaaaggaaaaggtactattgtctttctgtgtgctggggtaggggagatgttagaacatcggcttcattctcctggccactcctcctcataatctaatcccttttcactaccctctgaagatcctaccttttgttgacataagtgtaaggtttatttcttatcactgaggcatctggagaatgccttcattgcctgcctttccttagggggaagagtgccttgctggtatctttcccataccatttgggagaagcacaaagggaagagaaagcactcttagtatagagtaaatatagtgcctagtcaaggacctggaggctgggaagaagaggaagctacagcagcagttggaggtataacttaggatatagagcagggaagaggtggccacatgaataggttatacccactcttcactccacatctggacagatagcagggaaagctgcccagtggactaccaagtgtcagtgacctggtgtcccagccagacaatggtgctccagtcctcccctctgactcaccattggccaggctcccatcctggcttccaacccagcctagaaaagagggagaaaaaaaggaggaatttgcactttttgaaaaatgcggatagctatggtcttggcatctgcctctgtggggcatataacccacccacgtttttgatacaatgggacttctttcaaatagagggaagtcagagtgactagagaaaaggaagagggagggagactatagagcctgctctctggaaatttggaattttgttaggatagtttaataatggtaaagctaaaagtgctaacatttattcagcacttatgtgccaggcatcttgccaagtactttacatttaatcctcacaaccatgctgagagacaggtattattttgccagcaaggaaactgaggcttagaaagattagatgttttgcccaaggtccctcaactagtgaatgtcagaccaggactcaaatctccagctggtgctcataatcattcagctgaactaccttggttatttctcaatatctacttcccaaggtccccagctgtcagaagccatgtggggaagaacggcccaggctatggccatctgagcttccacatccatgcacaggcaaagccaaaactgttgtcagaactagaatgaaccgttttcatatctggttgagcttggcagcagagccctgggtcatgaagagaagttgctgcagaacaagaagagtcatccagattctagtggaacatgaagggttggatagctgtctcatcttggagtcaaacctgtagcagagggtgagcagctggaagtgaattccttggtgcctcttgtcaggcttggcttttctctttatccattttgtagtgctcatcttaggaccagaaaagctgaggcctcagggcttttcttactctgctgatccttggtccctctttccttacatctaactcccactccaggataagattatggatggcactgagaggcaggtattaggtgaatacttacatcatttagggtgggttctgtagctgccgttcttccaacctgactccttatcttgggtcactagatccaggagaggaaggagatactatgttcccaggcactcctgcgttatctgatactgacagaatgaaatacctgaattcattatggctccacagaaaatgggagagcaagaaagagacagaaacatgaatatcactaggtttctaagcattagagtcgtcagcacaggggtctctcccagcccttttccttccatccgtccttccttccttccttccttccttccttccgcccacccgtctgtctgtccgtccgccctttttcttgcaacagggtcttgctctgttgcccaggctggcgtgcagtggcacagtcatagctcactgtagcctttaactcctgggctcaagcaatcctcccatcttagcctcccaagtacctggggctacagctatgtaccaccacacctggctaatttttaaaaaatttttttgtaaagatgaggtcgtgctctattgcccaagctagtctcaaactcctggcttcaagtcatcctctcgcctcagcctcccaagtcactgggattacaggcatgagtgactagacccagcccctttggcattttgaggatgcgtctgtcaaggcttttgtcccctaaataccaaaggaattggttttccttttactcatccttcttccctttcatgtaacattcattcactcaacatgtagttattgactttgtacaatgtccaaagccgtgagctgtgctgtggaggacgggggataaaatgttatccttccctctaggaacatgtgaagtaataatgaaaaccccagtatctatggaactgtttagtttgtgactctcttgaaaaagttgttttctgccataagcaggaagtatacagcttactaaaatgaggcacataattatctaagacctaagcagagatactctaggagaatctctaggtagaccctaacactctgctcccagtctcttgcttttcttttaggttctgagtttaatactatgctcctaccaccagtagaggggctcccaaggatgaggtcgggcctcaaagaagaggctcaggggcagcatgtacagttctcttcctgcccatggtctccctgcagagttgttctctgctcagctctcacagtgttctctttcttactatgaggaatcctttacactctctcccacagtcagaaggctttgtgctgatttttcacattttccaccactgctcctcaaagcctgccgcttcaaagccattttatcagcctagtcggggaactctgcccaggcagtttgtcctcccatttgtaaccaaatggcaaatattttggtatagaatgggggagctaaaaggagagagtgatttaggtatcacaccctccccgatatgatgacactgttagtagattagctttgtcttttcaggactgcaacctttgtacagagaaatctgccgcatgtcacactggaagccccagtaggccttctagcttgatatggtgtgatgtcagcttcttgcttcatctttactccccggagctgactcagtgtgagtgactcaagcccagggagtaggagaggagcaggtcatgatatacctcccttcccccagggctgtcaatgagtcagacaggacctgtctgtgacagaatcagctggagcgttgctcagggagccaatatcttgcctgctgttccttctccaaccagctcataggtagaaatagaaccactaattcataatagactctgacatcctcactgccttaattctcccaccaccttctacccaaaatggaagagttgttgccttaggggcatgtttccaaatgtggcttctccctcaaagtgctccagtccccagattcttcaaggaaggacctgactataggacctccagctagaatagaactgaaaccatggaattgagttcaagtggatgcttgaatctactcagcagatttcagagtagaaactcaccactgccctcctgccctgggagctcttaggactttgtcttttaagtctaacctcccccaccccgacctcaacgtcccccacaacctagatttgtgcacacgtgctgctctgttccctgccctggtagaccatgttggacagaacccaggatgagccctgtgcatgagtgttgcctcagagctgctgagtgagagtttgacaccatctctttcccctgtttttgcacacggacacatatgacacagcaatggggtgatgtttagataaatcctctgggctgggactaggacagctgctatccagctagtcagctttctagatggatatagctaactccccaacttatatcaaaaattgtagtatattgattgtcatgtggatagcctgataggaagcctaaggaggtttggtagataggagattgatttatccttcactcccatcagcatccagcccagagattttgggcttattggtctaggatgctctttgtcacagaggttcaaggttgggattcagcttcccagggtgataatgaggctaattagagaagaggtatacctgccactgaaagtttagcttttcttcctccctgaggtttccaaaaagctggaggaacatggggtttccagtatgggagccatgcagcttattaagttcagtcctgtggtggtccccatggagaaggatttggttgagagcatgtgagtgggtaaaaaaaaagagcagggaagcttggcagtgcagttactgccctagggacccagctttagagctttggcctagaaggaagatccattcagttgagaatagaagtgaataaagtgaaaagcagaggctgctttgtctcttcagtccttctgaccttaaagtctgagctgcccttccagcatctcctacaagtggtcaagcatctgggcaagtagcatttctgagttgactttcttttattaaagcagaaaggtagaacttcactagagaagcagttacgatccaagttggagctaaattctttacctttgtctctctcccctcccttcccaccccctccttctccctttgccctctggccctttcccaggagctctcctccagcaccgagagtattgataattcattcagttccgtaagtggggccaggctgggacggggtggcaggctcccccagtggccgcatttcctctccgtccccaggtcttctgagcccccaggccaaggctggagttaaaatgccccttttcttactgggagatcagctcctccctcccagacctcccagatctgctggagttcccctgacctttgcggtggaaatcctgagcccaggctgagatgagctcagctgatccttctctcagagacagctggagtacagtgctgctcagcccccagctcctgagtgtctggagcaaacagctgggagagaggtagaattcactcctggattagagccaaaaactgcctggcagaaacccccaggatcctgtttctcccacccagaaccctttccccatggcttctgccgtcagattatcaaatatttattcataatcttctaaatgctaggccctgtgctggtgagctgactccaaaaacaaataggacttggcctgaaggaaagttttgcctctccacaactggttttcttttttaacttcaaccacattttttccaggtctgagttcttcccttttcccagctcactgcccaggatgttccttaatcccctctcctttcttgttccctctggactaacccctgaccctttggtcccacagggtcttggaccttgttgctgggcaaagacgtgagaggaaatgcaggacctctgggagtttggctgattttttttatattttctatttgatttgtctatcaaatcagttttctctgttctgtgctaatcccctttcagtcatgattcctatctcctctcatgtggcagagcctctctcttgaggcctggggtcacatttctaacatgctcacgtaacttaggggcccctaacccaaatgctgatttgagaatgggaaggaattctgccttttctaatctgagatgattatgaattgggtggggtagagggtccttgggacagagatcagttgccatctgagtggattcagatgaaggaagaagtgagtcttcaaatttcctcttattttctttctctattagacccccaggatatttccagggaccttagaaacccaattccattgttttccttttctttatctcttttcaacaatgtcacttaaagcattcctgaaggattcagacaccctctttcagtccctatgtggcactctgaaccatctcccaagaggcagaggctggaatgagcttttcctttgaatcctggcactgttgcacatgtagaggtaggcctgatactccccagttttcaaaagaagctcttttagagttcgagggagcaaggatagaaattctctcaatccagaaactaagcaagacacacggaaagggagagaaaggcttggtgagtcaaatgctgtttctacaaaggaggggagatgggatggggagttgggtggctgtcttgataaaatgccccttacggtagaagggcttagactgggaagagagcctttcttcgtgtctagctgagtccctctttttccccacctgcaccttaattccaagaccaactttgctctttctgaggatgactgaattgcccagcacaaggagccaaactcacagcagggaattaatatgaggaacctagtcactgagaggtaggggaagaggacccaaagaggagtcactaaaagagacaggccttcagggccatcatcaagggctaaaaggagctgttgctttctccatctacctacctccttccatctgctttttctttctccttgattaatgcaaagtctgctcatcggctcatcctctttccatcccctgcatgtgcattgacgcctggtaagagattgtgggacggacagggggataccatggaaatcaacagaagtaatttgaatgacgagcatcttccctctttgaaagtggaaatgatgtggggctcccttctctagccttgcgggacttgacggagcccctcggcagagatctagcccaaggatccagatggggagaaggacaaccctgttcttgaaaagggtgaaacaattcaggtgtaagcagctcttctctctgtggccctggctaacctatccagatgtccccctgctcactctgaagccttggtacagtccttaaggaacccaagtccaggagaagaggagtgcatcccagttacctggactcatggcctcccttaccctcaagggatagcctatagggaaggaatgtgctggctattctcaattcaagttgtgaagggtgggtggaagctcctactaagactaaaaagcagctcctttcctggagttctccagatagtggggtccccggcctgcatggccaggagtgactgagtgggtgtgccattgtattctatggtttcttcaccatcttttgtcttaccccaaacccctgtagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggtagatgggttctggcccaaacccctaccctggacgtgactcttcacccatggttgttcagagtttgcgtgtatgaccagtgaggccctcaccaacatcctagactcccttcatagttcatgatgcatatgtcaaccatgactctgtctcagtgcgattgtgattttgagagcccccctgtatccctttttgggctttgtttttctggaccaaagaaacctaatctttttagcttccttcttgctgtatcttaggagaattgctcttcaccccaccttatggtcattttggtagcttttctccagcctttctataactcttgggctttccagatacagcaaccataaggatagagaaatattttgtttctaagaccttttctgatcagaatgagccgacaaaaggagagaaggatgcccaattcacactggagagaattagctgaatttgtgtgctgactggaatgagtattcatggttcagattcttcttttttttttgagatggagtctcactctattgcggaggctggagtgcagtggcacaatcttggcttactgcaacctccgcaacccaggttcaagcgattctcctgccttagcctcctgagtagctgggattacaggcgcctgccaccacacccggctaatttttgtagttttagtagcgacggggtttcgccatcttggccaggctggtcttgaactcctgacctcatgatccacccgcctcggccccccaaagtgctaggattacaggcgtgagccaccgcgcccggcccatattcttctttcaaaggaaatactgaagtttgggacactccttgggacagtgcccagctttgtcccagtctttttgtccactgtagctccctgggccctgtcttcaggacgagcccacagaggcatctaggcctcccttacagcctgtaattgatagtctagagtggtttggcccaagcacatcatctgtacattttggagctcagttgaaatattttgaagacttaaggattctgtcacacaaattctttacataggtgatcataggacaagtatctgccctaaatatagtgttcatagtttcagaggactattggatgaaggctggagctaggagaaaggacagcaggaagaaccttgctaacagagttgagatttgggggttagtggtggaagtaagttgcaaatactgtctcactcttcccccaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggaggtgagagggcttcagggaggtaatgctgggtcacaggagctttctccaggagctttcactatattggaaacaagacagcatatcccaaggcagggtaaggcaagtaccctaatgagtggtgtaggtagtgaggggtaatatggggaaagctctgaacaactctagcctggaatagattcaggtggagttcattttccaggtgaaggattcagatttaaatgtaaagaggagcttctaggccaaggggagtgagggaaatttaatgaaaatatttattgaacacctacataaagttgtcatagaatagcagaggatgagaagtcatacattaattcattcaagaaatttttattgagggccttctatgtgccagacctgagtgctgtatgctagtgaacaagacttggcccctgcctacaagggatttatgacctaactggaaagagaacaaggccagtaagcaagtagttgtagtgtggtgagagtcaagtcatgggggaaaggataggacattataagagcaccagacttggggcgggcatcacaagagatttcctggaggaagtaatctctcagctgaggctggaagcatgggtaggaattagctggacaaagagtgctggacagagggaacactgcatgcaaaggccagaagacaagagggagcttgggccattataggaattgaaagaaattttgcctggctgtgatgtgcaggtgtgaggtaagaagtggtgaagaataagactggacacgtgggcatggaccagactataggaaggaccctgtaagctggggaaagaaacttgaactttattctggggcatgaagagccagagcagaattttgtgtagagctattaacacagctggccaggcgcagtggctcacacctgtaatcccaacactttgggaggccgaggtgggtggatcgcttgaagtcaggatttcgagaccagcctggccaacaaggtgaaactccatctccactaaaactagaaaaattatgccgggtgcggtggcgcacgcctgtaatcccagcactttgggaggacagggcgagcagatcacctgaggtcaggagttcgagaccagcctggccaacatggtgaaaccccgtctccactaaaaatacaaaaattagccgggcgtggtggcatgtgcctgtaatcccagctaatcgggaggctgaggcagtagaattattcgaacccaggaggcggaggttgcagtgaaccaagatcacgccactgcacttcagcctgggtgacaagcaaaattccgtctcaaaagaaaaaaaaaaaaaagccaggtgtggtggaacatgcctgtaatcccagctactcgggaggcgagtgattcttgaagcacaagaatcacttgaacctgggaggcggaggctgcagggagctgagatcacagcactgcactccagcctgggtgacagagtgagactctgtcttaaaacaaaacaaaacaaaaacacagccagggccaggcgcggtggctcacgcctgcaatcccagcacttcgggaggctgaggtgggcagatcacctgaggtcaggagttcaagaacagcctgactaacatggtgaaaccccgttcctactaaaaatacaaaaaattagccaggcatggtggcgcgcgcctgtaatcccagctactcagaaggctgaggcaggagaatcgcttgaacctgggaggcggaggtcgcagtgagccgagatcacaccattgcactccagcgtgggcaacaagagcgaaactccgtctaaaaaaaaaaaaaaaaaacacacagccaggtttcactttgccaaaaggcagaatctctgtctttgagcttatagtccaattgcagaaattagacatttaagaaaaaaaaatttagatatacaacaaagcagtgtgtactaggtgacaaatggagttgagaagaaatgctctggtatgaaggacagaagagacttgacatgggccttggggtctggtagaatattctgtatttagagagagatgagaagataagattgaatgacttagattgaagaaactgtcagaagctagtctgcaaagagtctgctttggaccctaggggagaacgcatccctatccttgggggactctcagtgaggctgaaattttgagctcctgtaatggtcatggcagtggtttgcaaactttagtgcattggaagtcttctggagaacttgttaaaaattcagactttcagatcccattcctagtaattataattcagattgatggtggggcctgggaatctgcattctgggtaattctactgcaggtagttcacatgttgagaaatgctgctctgggcagcctggggtcccagtaaccaacatggtgtgtaagcagagtttgaaagagagggatgagcatgctgcagtgatagcaagcaagcaggaggggaaagacgggagacctatactttagcacttctgaccagcactcccctttctccagctccccgaagtgcataccaacagctgtgacaacatctcccagttctctgtggacagcatcaccagccaggagagcaaggagcctgtgttcattgcagcaggggacatccggtatggccagatcacattgcccctcatttttcatccctctttcaggaacttcccatctctttgttaccttcctctccatctcaatcatctgttgttggcctgtgtctttccctctttcattctgtccttgtttggggccaccaaacttgaggcaatgaaggtgtaggttgagaaattacttgggctaccaaagaaggaaattaaattttaaaaagactccaaagggatgaaagcaccagaggggccgggcatagtggctcacacctgtaaccccatcactttgggaggccgaggcgggcagatcacgaggtcaggagatcgagaccatcctggctaacacggtgaaactccgtctctattaaaaatacaaaaaaattagccaggcgtggtggcggatgcctgtagtcccagctacttgggaggctgaggcaggagaatgacgtgaacccgggaggcggagcttgcagtgagccgagatcgcaccactgcactccagcctgggcgacagaacgagactccgtctcaaaaaaaaaaaaaaaaaaaaacaagaaagcaccagaggaaggagtttgagcagtgtgtctcaaggtggggtctcaaagcgactgtgtcagaatccagggggaggaaggaggacttgttgaaaatgcagattctaggctgggtgcggtggctcacgcctgtaatcccaacactttgggaggctgaggcgggtagatcataaggtcaggagatcgagaccatcctggctaacacgatgaaaccccatctctaccaaaaaaatacaaaaaaaaaattagctgggcgtggtggtgggcgcctgtagtcccagctactcgggaggctgaggcaggagaatggcgtggacccaggaggcggagcttgcagtgagccgagatctcgccactgcactccagcctgggagacacagcgagattcttatctcaaaaaaaaaaaaaaaaagaaaagaaaagaaaaatgcaaattctagagacacacccattctgaatcagccttggtagaggaatatggagggcctggtaatcttaattttaacatgattacaatcagttagcaaaaaggtgtcattggttatgttttcttccatgagtccctttcagcctgggttcctatctttgtgtgtccagaatccaggagacagtgcaggaaatgtcagtatagactgggcatggggcttgggggtagcttctccaagcaaatgatgtattttcttcctgccagccggcgcctttcggaacagctggctcataccccgacagccttcaaacgagacccagaagatccttctgcagttgctctcaaagagccctggcaggagaaagtacggtgagttgggtgtgggtctctgaacccctctcaaagctcagaggcagttgtaagtgctcactgcaccaactttattgtccatcagcctccaaaaaaatctgtcaggcttccaggctgtctgggtccttgccctatggggcgtttgcttgggattttttgtggaagccatgtctcttgtcctcaccctggcatcaacctttgacaccctttacttctgtcttcacaggcggatcagagagggctccccctacggccatctccccaattggcggctcctgtcagtcattgtcaagtgtggggatgaccttcggcaagagcttctggcctttcaggtgttgaagcaactgcaggtaagagaagagaaggagaggccaggcacagtggctgtaatcccagcactctgggaggccgaggcgggtggattacaaagtcgggagttcaagatcagcctggccaagatggtgaaaccctgtctctactaaaaatacaaaaattatggccgggtgtggtggttcatgcctgtaatcccagcactttgggaggccgaggcgggtggatcacgaggtcaggagatcgagaccatcctggctaacacggtgaaaccctgtctccactaaaaatacaaaaaattagccgggtgtggtggcgggcgcctgtagtcccagctactccggaggctgaggcaggagaatggcgtgagcccgggaggcggagcttgcagtgagcggagattgcaccactgcactccagcctgggcgacagaacgagactccgtctcaaaaaaaaaaaaataaaaataaaaatacaaaaattagctgggtgcagtgatgggcacctgtaatcccagctacttgggaggctgaggcaggagaatagcttgaacccaggaggcagaggttgcagtgagctgagattgtgccactgcagtctagcctgggcgacagagcaagactctgtctcaaaaaaaaaggagagaaagggaaactcagcccaactccagccaaccggaggtgactacacagattattctgccggggaccaccttcctgccaaggtctaaaacaaaagcagagtaaagagaagctagtgcaactttcccctgggaagaacagccataggaacagctccacagcggcctcttttggcccttttgtgacctgcacctgtcctgttccaagtctgaactttagagtgctaggtttgccttttagatcaaaacttccaaaatgtcctggcaccctggcatgggcctgtagtctcagctagtcaggaggctgaggtgggaggatgtcttgagcccaggagttctgggctgcagtccactatgccaattgggtgtccgcgctaagttcggcatcaatatggtgacctcctaggaataggggaccatcaggttgcctaagggaggggtgaactggcccaggtcggaaatggagcaggtcagaactcccgtgctcatcagtaacaggatcgagactgtgaatagccactgcactccagcctgagcaacatagcaagaccctgtctctgagaaaaatatgcatttgaagaaatcagcgtttttttttccttattttattttttttgagatggagttctgctcttgtttcccaggctggagtgcaatggcgcaatctcggctcaccacaacctccgcctcccaggttcaagcgattctcctgcctcagccttcccaagtagctgggattataggcatgcgccaccacgcccggctaattttgtatttttagtagagatagggtttctccatgtgagccaggctggtctcgaactcccgacctcaggtgatccgcccacctccacctcccaaagtgctggaattacaggcatgagccaccgctcctggctgaagaaatcagcatttctaactgaagtgagccaaaaagaaaattttgcggaggcaaagtttagtgacccaccttttcctagtgttaagtgtgtgctaaggcacatggaagaccaatttatttatacaaggcactgagattttttcaagaaatagctgtcaaatctcaaggtgaagatctaaatgtgaacagtttactaatgcactactgaagtttaaatctgtggcacaatcattgtaaacatggggttcatttctctaaattgatttctaatctgaaattactggaaaacttccttgcccgtttttgccaaactcaatttttggtttttggcatatatccattattcaaacttaatgcctctaattttaatgccaacacaattggttgtaatcaaatttttaaataataataatttggtcctcccccctttaaaaaacaacataaaaacttcccaaattggtctgtagcaggtaggttatagtgtgctgaaatattgatcttctgatacccctgggttggtcacctgcaagccacttaattgtttaatactgttctttataccatataaatattttcattttccagagaagtcttctctggacctaaatcctttccttttttcttttttttcgtcggagagagtctcgctctgtcgcccaggctggagtgcagtggtgcaatcttggctcactgcaacctccacctcctgggttcaagcgattctcctgccttagcctcctgagtaactgggattacaggcatacaccaccacgcctggctaatttctgtatttttagtaaagacgaggtttcactctctactgaggttggccaggctggtcttgaactcctgacctcaggtgatccgccctccttggtctcccagagtgctgggattacaagcataagccaccgcacctggcctcttttttcttattatttgaacttacagctcccattctccctgcttgagaggggatagtgaagtttcctgttctccctgcctgtcttgggctttctacttaggtgataccttttcccacatacctgagtgtagtttctgactttgtcaggccctagacttcctttccaaactccctggtcctcactgggttaagtgagtcttactcatttgatggcttagaattcaatgctaccaaggagagaggctggagaaagggaagagttttagccttcttctctagtttggagaaagataagagtcctgtatcctccatgtctcctcacagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacaggtaggtgacttctgctgctcatcctaacatttctccagggttctctctgtcccttcgtgtgtagttctcaattacttattactgccctccatggcaaagatgtgaaaaatgaaacaatgtattttaagcagagacagatgtgttcccatgacattaagtcaggaggcagactaataagaactagggtaaaagggcaaagaaatgaaggatttatgggaggactaagggtttgagtgagcagggtcttcaaggacaagggaaaatgatgacagaggaagctgcaggggaggtacatcccagctagaagaaataattgaatgtgattaaagcacagactgcactgcatggcagtggagtaggaggtggtaccatgaggcaggtaaattgaggccagttgaagaagggccttcattgtgaagcttaggtgttttattttgcaggcagaggaatgacatgatccagtctgtgttgattaaatgccctgtggcactgtgggtgaaggtggatgtaattgggtgtttagcaacaaagcaagagataatagggcctggcactaagggtagtggttagtgactgagagcagaaaggagaaacatgatggagatgaagtggaaactctcagccatgaactctcctcacttcttattccagcatatgatttccacagcttttaagtatctgttgttttgcccagagctgtcattttttttcaatatgacatgaccttgatgaaaactaactacacatataggtgaggcacataatgtacaaaaataattacaccatctaggccctgccttctaagagtatctcccaacagtgacccagggtctctgccctgaatgctcctatgagttccagctctagaccctcggcacagggcagctgtcctggaaaggtggaaatgcaatggccagtgctgctggggcttccagtaacatggtggcccattaagatctagctaataatggctgggtgtggtggctcatgcctataatcccagtactttgggaggctgacacgggtggatcacctgaggtcaggagtttgaaaccagcctggccaacatggtgaaaccccatctctactaaaatacaaaaagaaaattagctgggcctggtggcaggcgcctaatcccagctatttgggaggctgagcaggagaatcacttgaacccgggaggcagaggttgcagtgggccaagatggcaccattgcactccagactggacgacaagggtgaaattccaactcaaaaaaaaaaaaaaatttatatatatacatacacatacatacatacattagctgggcttggtgatgcacacctgtaatcccagctactcgggaggtaaggcaggagaattgcttgaacccaggaggtggagattgcagtgagccaagatcatgccacagtactttagtctgggcaacaaagcgagtctcaaaaaaaaaaaaaaaaaatctagccaacaaggccgaggcaggaggatcgcttgagcccaggagttcgagactagcctaggcaacatagttagatcccgtctctacaaaaaataaaaattagccaagcatggtggtatacagctgtggtcccagctactttggaggctgaggtgggaggatcacttgagcaggaggttaagggcaacagagtgagaccctgtctaaacaaaacaaaacaactagctagctagctagctaacagagcagcttattagaaatgtagcatctaggctggatgcagtggctcacgcctgtaatcccaacactttgggagcctgaggcaggtgaatcacctgaggtcagtagttcaagaccagcctgaccaacatggcaaaaccccatatctactaaaaataccaaaaattcaccaggcgtggtggcgcatgcctgtaatcccagccactcaggaggctgaggcaggacaattgctggaacccgggaggtggaggttgcagtgagatgagatcgcgcgactgcacaccagcctgggtgacactgagactccatctcaaaaaaaaaaataaaaattagtcttaggctgggtgtggtggctcacgcctgtaatcccagcactttgggaggccgaggtgggcaaatcgcctgaggtcaggagtttgagaccagcatgaccaacacggtgaaaccccatctctactaaaaataaaaaattagctgggtgtggtggcgggcgcctgtattcccagctacttgggaggctgaggcaggagaatcacttgaacccaggaggcagaagttgcagtgagccaagatcgcaccattgcacaccagcctgggtgacagagtgagacttcatctcaaaaaaaaaaaaaagaaatctagcatctattaagttctgccatggcctgacattcttatatttaaaccagatgaaaaccctgtcagacacgtgtttcctcatgagggaaataacagtcaggtagcttttagaccctgtgctcattccaccctgcgctcattccaccctgccagccctacaaatggacccaggctctgcatttgagagctgtaggagaatgtaatatttttgtgtgtgtgtgtgagacagagtcttgctctgttgtccaggctggagtgcagtggcgtgatctcggctcactgtaacctctgcctcccagagttcaagtgattctcccacctcagcctcctgattagctgggattacaggcatgcgccaccacgcccagctaatttttgtatttttagtagagacggggtttcaccatcttggccaggctggtctcaaactcctgacctcaggtgatcctcctgcctcagcctcccaaagtgctgggattacaggcgtgagccactgcatccggccgagaatgcaattatttataaggaatttgattgcaagcttcagactatctcaaagtgtcaggattttgaactcagggcccagggagcctagagctcagtcctgggattgagtaaatgggtggcagggaagctggcactagtcaggccccagggctttcctttagggaattagtatgtttggaagatgagagtccatcctctaaaaaagaagggatagaggagggcaggtagctgataagccgttcatagtacctcaaaaaagaatagatatagtcgagccatgaatggaatcaaccaatggaaagaagtggcaacaatgaatgaggccccatactggagtcaggttttaggatctctttaactgcttcaaaagtagtcctaagcagctttccagctggagctaactctggtagtgaaaagagaggctatggcaccttgggcaagtaaatcacttcctctctcagggcctctgttttcttcacctgtaaaatgtgaggttgaaccatgacaactcctagaaccattctggctcacaagattgtgcctggattgctaaatctttagtgttttccctgagtggggaagaactcaggttggactaggttctccttttgtccctcctcttttggccaaaccaaccccagagaaggtggccctcagaccatcagctcttagcctaacaaagcctctattgacactgagtaggccagttatgctgaataggccaggcctcacatgcttagcatgttaattgttccttctgctactggccattcatgtgggaatcacaaagacctgggatttatctccctttaactcttctacagctgccctgtagtactgcctcatcctgagactttttaagtaagtgatttaaaacttaccccttgaagcccccacgctattttacatttcagctccactcagcctgcttgcttctgttgttgttcccttccagtgaggcctctgatctgcagtgggctgacaggagttacaaataacccacaggtaaacaggctcagaatagagcctcccctgagtagagcgcttggcctctgtgacagctggctggagcctcagaggccctctttccttgcttctggattctctactagattgggatagtttgggtgccagaagtgcaatttctgggaaattgggagaatcttaaactatttttattaaattattaatagcaatttcagaccccatagcctttgttagcagttttctgatttcctttctttccactgatagctttaggtcctaggaaactggacaggagattggagttacgggcagcaggaaacatggcaggggacccccctccctggtgtcatgtggccagtgtattgctgcttaaggttccagcctcagtcagactgactactgcctcttcctctcctctattccccctcctcagacacaatgggaatatccttttggacgcagaaggccacatcatccacatcgactttggcttcatcctctccagctcaccccgaaatctgggctttgagacgtcagcctttaagctgaccacagagtttgtggatgtgagtcaagaaggagaggtgcctctcgggggtcattgtattctttctctgtcatgggagagggagctgatgggctccctgcaaattagggatgaacagaacaggcagtaattaggggtgaggcaggagttcctgggagcttcctgcccaataaggaagggggaaataacagggccccaagaggaggaggagttctggtaggccagtcaggacagggaccatccccggtgtaagaccccttgtgcacacaacgctctcttccctttccaggtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttcccctctcatcattatctccttccactacagtcttgccatctacagtcttttgcccaggacccccttctgtcctcatccccctcctcaaggctccaggtgtataccaggtctgaactgccagtctccccctcctccccattcctgcccctaccccacaggttgtcgccgttgctcaggatcatccccatctggccccatgatgacggtggcccaggtcatctgtgagtgtcagacgtagcataggcagaggtctgcaaccagataagtgcccagctcagggcccactccctccagcctcctcccagcctgccctctgggcccctccacccttactgagggagatgtggtgttggtccccttccttcctctgcccacatgccctcacctacagaagggcttaggcgtggggtgatgaggggttcctgccggttccttctctctgcccaagcagaactgcacccacatcatcaaggacctgaggtgggaggaaaagggcacttcagatgccccagctctgtatttgctatggctgacaccactgcccctcccgtccatccatgaccctgaactccgactgcttcccccaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcaccacatagaagtttgctttttccctgcctgtcttggtcactaccacctcttccctgagaagggcgggccttccatgttctctcacccgcttcaactccacattgtccaagtcacagaaaaagagaggcctgaatggagattcgaccacaaacagttttaatggtctggttttctccctagttccccaactgtttgttagtattattattactacaagaataaaggattcctgagagcctgtcccctcctctcctgtggcccccttgacaggactcatccctaccaaccccccacccccccgccccggatttctggggaaaaaaagaagtgaaaggcactgcaggggtagggggcttgagtgccagtgagttggggttgggcgggggcgggggcgggggtgggcactagggcagggcccggcctagaggaggaaagttccagtccatgcctgaaggaattgtggagaggtgtgtccatccatgacacccccatcagtccttccctgaacctgtctagcaggcatacctaagtcccatcctcccacccccaggcccacactgggggttctgcagcaggagcataaaattaattagtgttgggctcagaaaggaggaatggagggtccactctactaggactccagggccaaacccaaagggaggttgcaaataactagaataatcctcaaatgctcttcttcttcaggttggagagacaggaattaacaaaatattaatgttaatgaaaactccccagccgagggatcaggcagcagtagggaaaaccaggctccaagaggaaggggctggtcagtcccaggccttggagactagttgtccccaacagccccctgccgagccctgatgaacgccatgccatgcgtgcggaagtgggtcttgaggtttagagggctgtcgcagctcttgccacagaccttacaggtcagtgggcctccagaagcaggcaggggtgagtctccaccatcggggtcagaccttgatggaggggcctcttcctccccatcccccagccccagggcactggctttacccacaccccgtctcttcttgtggctgatgaaacggtgtcggctcagggagccaggggaggcaaagcacaagccacagtcgaggcactgctgggcaccatcctccaccctcaaccccatcatgaggctctgttctgtgg

SEQ ID NO: 17613 - DNA, 33044 bp, Human
  misc_feature (1)...(33044): n = A,T,C or G
tttatgtgtggttttcataagagattgaaacagaaaccaaatccgttatcgtttgatcttttcctttttacagtgttgtgatgtttcaagttatgggtgcacaggagagagataagaactggatatggaaagaatgctgttaagatttaaaatgaataggatttgagtcattggtgctcatgggtgttgtgtacatactgttgccagcacatattgtggttagagttttgtttctggagtcagtctgcctggatttaaattctgacagttccacttacgcttaacctctctgattaattttcctcatcaataaagttgaattaataatagtgcctaccttatagggtttaattgacagttaattgagatatcatatgtaaattgtttagcacaatgcctgggcactaaagtattatctaaggctgttgctaatggagtgctctgaggctaactacttctggtggtagctcccagaatccagataaactgttctacatctaaaattaactagttttctcttttacataactgacataaaaagtagaaataaaattagccggttttcagaattcttgaagtaacctgccatctatgtcttaagcaaaacaaactctggaggtacccccccccccccaattatttcagttacacaagcataagtgggttgaataggataatagtcggtttttcactgaatttagaaatgagttatctttatgagccattgaaaattaattaaatagcacattagcctgttgctttcttctctggtctgttattgtctcatgataaagtttttgaatagaagggtgtttaaagtgcaaaacaaaaataatttgagaaaatagaaatgaaaaaagaatagtaacagctatttttcgctctccttgaaagtacagggacagttcataccttactaagagaatgccagccttgaaatgtcagtacttgagatgatatagaatgcagagtttaaaagtactgggattttaaaaagaaatgataacttatagtgaatttaatttagctaatgataaatttagtgaataagaagtgttatcttgttagacttacggaagtatagagtagaatggttggtaaccagatatgggtggtgggggtaggaggagggtgtagggaagggggagatgttagtcaaagagtacaaagttctggttacacaagaggagtaagttctagtgacctattgcatagcatgatgactgtagttaataataatgtatatttcaaaattcctaaaagaccatttaaaatgttctcaccacaaagagagataggtatatgaggtgatggatatattaattagcctgatctaatcatttcacaatatatacatgtatcataatatcacattgtaccccataaatatatataatcattatttgtcgattcaaaataaataatgaaataaaaatgttatctctttttagtatgacgtgctgtaaaaatagtatacatagtttctttttatagtaaatatttgagatttgaggaaagggtttattttaaaatattgcttaaatatttcaaatttattattttcaagattcaactatttgtatatagtaaaatcatagattcttaagatacgtataaagtcttatagttcaaagaaatagcctgtccactttaagtaataatagccacttcctattaggtgattagtgtgggctaggtactttactaagtatttaaaatacactatttaattgtgttaatatcacccatacacctggtcctataaagctgcactttatttacagccatttcaactaatataagttattttccttgtattataaccattagtatcttcattatacaaatgttgtgcttaaatattatgtgggacaattgattgcaaaatttctctgatttggggatatttacatatgtattttctttttcccagagtttaagaatctaaagtattacattgataattgtttcctttgttgcagaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggtcagtgtttatgaacattgctatatttggtgaggtggggggactaattaacatggagcccttaaaatatctggaaatcggggagacaataagtagtcaagtcaaattacttcagctgaactgaattatattcatttgttttcacttgagatgttttaaaatttcttaaatattgatataaatttagcagaattatgttttgtccactataggtacctagattagtctttttattattttagttctttgtttctagtttctgtagtgttcctataactatcagcatttgattctttattcaatatgataatctctgccttataatcaaagtatagaccatttaaattaatgaaattgatatggttgggtttaaatctatcaccttgctatttatttgattttcttttccacttttcctgccttttgtgggatgaggtgttcttcacttttggttttggtgttttggtgcttttttttttttttttttttttttgggagacagtctcgatctgtcacccagcctggagtacagtggcgcgatctctgctcactgcaacctccgtctcctgggttccagcgattcttaatgcctcagcatccagaatagctgggactacaggtgtgtgccaccacgccctgctaattttcgtatttttaatagagatggggttttgccatgttgtccagactggtcttggaactcctgacctcaagtaccacccaccttgacctcccaaagtgttgggattacaagtgtgagccactgtgcccagccgaggtgttgtgtgtgtgtgtgtgtgtgtgtgtgttttatgcttcaattttatctctactattgcctgattatttatgtattttagtggttgctatatggttttcagtatacatctttaatttatcattggtccaccttcaaataatattataccatttcacgtaactggctctttacagaaaaagttgcttggcacctgatgccctattggattaattccttttgcctggagaagtttatttaaaatttctcattattcagttttgctggcaatggttattttaaacttttttgtggggtgcaggtttagaattctaggttgacatttttttcttctatgtattttaaagatgatttattgtcttctggctcccatagtttctggtgagaagtctgctgtcattattcctctttatgtaatgtctctttttttaattgctgtcttcagtattttttctttctctctttatcactgtttttcagcagtttgactatagagggcctagatgtgttattctttatttttatcttgctttgggttctcagtggttcttaaatatatggtttattgcctttcattaaatttaggaaatttttgctcattatctcttcaaatatttcttctgcctcactcctacttttaggactccaagtaaaaatatattagaccatttgctatttgtcttacctcttgattgctttgcctttcctccactctttctctcttagtttggataatttttattgatttttctataggttcaccgtttttctttgttgtgttcattctgctgataagccccaatgaaggacttcttcatgtttttaatttctaatgttttcattttccttttaaaaaagtttctgtctctgctaaaattccccactagatccataaacatattaattatagttattatataatgtctgtcagtttcaatatctggtccatctctggatctggttttgctgactgttttaatctcttgtttttgtatgtattttataattttggattgaatatcagacattgcaaaagaatggcagggacggaagtatgtaatatttctacccagaaataggcatgcctctactctgttaggctgttagtgtgaacaggtattggtcagtctagttagtaattgagaagagttttgagtgtttgtggttgcagtaattaccatcagtacaccacactcttcagactcctacagagatggactgccaatactttgtgtttaaagtgaggcctggagcaatagatgacttttttgtctcagcattactgctacaacttcatcttctagcttgtgccacatttgaggttgggagagaggtaagatagctctctctgttgcccttcctacagcactagattgctattgcttgttacttggagcaaggcttttggatggggcagagtaggatccttgattcttctccagcattagtcttaaacaggttctgcatgcctgtgcttcaggtgtgagtctttctgtgcctcccccaggagcagacagtctctccatctactcaatatagagtctagagctgcatttttcagtagcaaaatgtactctttaatgccaggaaccatctcaccactgcattccagcctgggagatagagggagactctgtctcacaaaacaaaacgaaaaacattggattcaactttggctgagtgcagtggctcacacctgtaatcccagcactttgggaggctgagacaggtggatcgcttgagcccaggagttagagaccagcctgggcaacatggcaaaaccctgtctctactaaaattagaaaaaattagctgggcgtggtggtacatgtagtcccagctactcaggaaatggaggtaggaggattgtttgaaccctcggaggttgcagtgggccgagattgtgccagtgcactccagtctggatgacaaagtgagaccctgtctcaaaataaaaaaataagctggacgtggtggctcatacctgtaatcccagccctttgggaagctcaggttggcggttcacctgaggttgggagttcaagaccagcctgaccaacatggagaagccctgtctctacgaaaaatacaacaaattagccagacatggtggcatatgcctgtaatcccagctactcgggaggctgaagcaggagaattgcttgaacctgtggtgagcctagatcgtgccattgcactccaacctgggcaacaagagtgaaactccgtctcaaaaaataaataaataaaatgtgacagggtccatcctgtgacgtgagatgtaacatatgaactcttacctttgacannnnnnnnnnnnnnnnnnnncatccactagctaggtctttttccactggcctccatctggtgctccaggaggaagactgcaggcaggccaggaagcctaagagaaacccttatgaatgaagacagatgtacagaatctgccaagatttaggcaaagatagacctagagctgcattcttcagttgccatttatccacatgtggctagtggttggcatattgaacagctataggatatttctgtcatcataaacagtccttttagacagtgctgttttagagttcaagccagttttctgctcattcccattatggtggagaaactcagcctagtcttagtgggaggtcttggacaaaagtgagtgaccactccctttcccagtggcagcagttctctgtatcatcagcagatttgagcatgagcagattttctgcctttcttctagtggcacatggcacattgccttgttaaatatggggatagctaggttttatacttctcttttagcaacagccatcctttgcctgggactagagtgggcaaagtattttgcctcttcctcagtggcagacagcttttgctttgttttagagaagagtccaggatataggcaggtttgtgtctgtcctacaccactatctgatcttcaccttttgcttgttcagggtctagaacatggatgatctttgcctaaaccttggcagattctgtacatctgtcttcattcataagggtttctctctcaggcttcctggcctgcctgcagtcttcctctggagcaccagatggaggccagtggaaaaagacctagcctagtggaggcagactcttcttctgggaatgtcagggattctaagctgtcatgctagctaacatttggtctttaataaatgttttaaaatttgggtgttgtttttttcttacattcttttacgactgccatctctgtgctctgccaaaagtaagagttcatatgttacatctcacctcacaggatggactctgttacaatttattttattttttttattttgagatagggtctcactttgtcatccaggctggagtgcagtggctcaatctcggcccactgcaacctccgagggttcaagcaatcctgttacctccgtttcctgagtagctgggactgtaggcatgtaccaccacacccagctaattttttctaattttagtagagacagggttttgccatgctgcccaggctggtctctaactcctgggctcaagcgatccacctgtctcagcctcccaaagtgctgggattacaggtgtgagccactgcactcggccaaagttgaatccaatgtttttcgttttgttttgtgagacagagtctccctctatcgcccaggctggagtgcagtggtgagatggttcctggcgtgaaggagtttaagttttaaaaagtaagaaggcaaacagttaatcataatacgatatagaaagaaatatcataatagcaacatgaacagagtcagagagaagttgattaattattacctagcacagtggtccccaaacttttgacgctagggactggttttgtggaagacagtttttctgctacctgaggtggggacatgggatatggttttgggatgaaactgttccacctcagatcatcaggcattagattctcataaggagcgcacagcctagatcccctcacatgcacagttcacaatagggtttgagctcctgtgagaatctaatgcatgggctgatcggacaggaggcagagctcaggtggtaatgcttctcaacttccactctcctcctgctctgtgacctgtttcctaagaggccatggacctgtaccggtctccagcttgggggttggggacccctaaactaaaagatttgggaaatttttatggaaaagtttgccattgaagtgtgctttgaaaaaagagaacaggttttagaagggtaacatatgccaaagggcaatagtatattctgctgggagtttggggcagtaggcatattctctgttggtgaggaatgtacgagagcagggtggaaaagcagagtgatccagaatagaagtgtgatgaatatcatgcttggacttcagttttgggcttcagttgtttggacttcagttttgagagcaaaccagtgagagtttttaagccaggagcatgatggagtttctctgtatttgacttgtgacagtgtgaatgatagggcaatatattaccttaaacaatatctgaattcatttgccaaaggaatgttacagttagtagtaccatgcaaacagagatagtttcagtgaagatgtgggatttgaacactttgtaatcattgccctccttatgtctaaatccactgacttcttttctgtcttactcaacctaaaactgcattatatgacatgattagctctgggaattcatcttttctttgatttgtataacactgtgcttaattctttgtttacctgtgtggactctccatctttttcttttgccacttgccatttaaactttagtgttcactattttgtcttttttgttgatttagtattttcttaatctcattaattcccatggcttaatatgtcgtctgtgatcttatgacttctagatctttctcctaaagcccagacgtaaatttgcaactaattattagatctggaggtatctcaaattcagtgtgtccgaaattggactttattcctctctcttctccaaggatctatttgggtctcagctagaaatctgagtcatcttgggtacctgctctttgcaatgcctaagttatttgaatgtcaaatttgaaaggaatatagacattatcctgatgaacttccttattttataaccaaaaaagtgagatacgtggtattaattgatcctggtctagaaagcctgtcaaagccaggggttagattcaagaaaaagcagtatctagtagcacctataaatacctacaagttgctttttgattctggccatttcttttagtttctaccataacattggccttagttcaggtcttcccctcatttctcatcaaattgaactattatataagttgaggagtcagcatgaaggattggattcaggtatgttcctagatccagatagatgtgtgacttggtaaagttagactctctgagcctcatttttacttcagtttttgtaactagtaacctttagtaaatatgacttactaaataaaagccaaacttgttaacatnnnnnnnnnnnnnnnnnnnnttcctgcttttttgtactcattttgtgtttttatagcattctgtttgttacctttataacatacatatcccagttatgtatagatttgcttctcccactagggaagatatgagagctctctgaggtcaaggccttagtagaatagtcacttaagactgtgtgtgtgtgtgtgtgtgtgtgtgtgtgtgtgtgtgtgtgtgtgtgaaagagaaaggggggagtgatattattcaataaccttttaaaagctcagcatcttttttcatcttaatgcataattctctttaattgtgatgtggatgaacatttgggtttctaattttttgttataaacactgctacagtgaaaatcatctccctatccttccttctctttgccttctttgaaattgatctccctttattctttttcctctgttgtgttggtattgttatcctctgtcttttttttttaaacactgtacatatttcataattattttatgtagtctccgtttaaatttacccttatagttaacagtgtcattgtttgctattgtttatgcatttagaatttccttagtgattttattcttgaattgtgtcacttaattcttttatacttttagaactattgtgtttatacttatgatggtacataaaaggtaaccatctactaggtacttagaaatataggcaggaatagaggtgatgtggtgagattacagctcttaagtttggaatttatcagcattgcttctgagtggaataatctaggaaaagtatggtgtaatgaagccaaggaagctaagctgaagtgtgaatggccaacagtgtcaaatgttgcagaacacttgaaaatgattggctaagaagaagttgttgagaaagtagcagccaaaagattaggattcaaaatatataataagtgctgtgctggctgggcgcggtggctcacacctgtaatcccagcacttttggaggccgaggtgggcggatcacgaggtcaagaggtcaagtccagcctggccaacagagtgaaaccccatctctactaaaaatacaaaaattagctgggtgtggtggcgtgtgcctgtaatcccagctacttgggaggctgaggcaggagaatcacttgaacccaggaggcagaggttgcagtgagccgagactgtgccactgcactccagcctggcaacagagcgagacttcgtctcaaaaacaaaaaaaagtgctgtgctgataaatgtttaacaactggctagggacaggctgtttagcttttgctaaatgtggagttgagaagcaatgtttactatcaacagtataccattatagaagaaactcatataatttaataagaaaatgaaaatctaatagaaaaatgggcaagtatatgaataggcagttcacagaggaggaaacacaaataggcaataaacataaacaaagatgtttatcttactagtaatgtgtgtgagggacattcaaattaaaagaacaaaaaatgcttttttatctattagaattcaaaaattttaaatatttgaggacatgagtaaatattgatactttcacatcattgataggagtacattaatatgaccattcttgagggcagtagttactagaattagaaatgggctcttctttgatctagcagatcatattctgatttctcccctagagtaacattcatagttgcatacaagaagatgtatgtgaaaatattcacagtggtattatttttagtaaaagttacaaaaccatatgtccaatagtatgatttgtgataatactcaaaagggagttggtcacatctataatttttaaatgtatacatttttaatgtaattaatctgagtgttttgaatgttcagagaaaggaagaaattaaggaagtgagagctagagaatgggaaaggatgcagtccagagtataggtagaatttgataacgaaaaggagagaaatcatcttacaattttaaaaaagggataaatatagaaatggtaatatattggcataaaaattagcaagctatcaccacgagtcagggtgggagggaaggaacttgtaaatcgtctcataaaaatcagttaactattttgcctaaatgtctgagatttagacagaaagagatacattcaagtagatttgggaatgcatgtggattttttttttttaatttatgaaatgtttcttgggtcagtgacagaatgacagtatttttcttccaatctgtggaagccaaatatacttagttgcactaaatgttagcattgcatttggcaaccttgacagcacttttctgatgaatggcggttatctagagatgataatcccaataggaggcagaatggcaaggtctagatcaaactatgaagggataatgatagccagctgatacagctgctgattaagatgtttttctccctatcatcataccatttttactactctgaaaagacaggtctaacaatcctggtttggtatttatttgtctctggattttaaatttgttaaaattatatatggttgtcttttggttcagcttgctttggtttgggctttatgttttaaatgttaacatctggctgggcacagtggcacttacacctgtaattccagcactctggtaggttgagacacgacaatcacttgaacccggaggcagaggttgcagtgagccaagatcgtgccactgcattccatcctggatgacagagcaagactctgtctccaatttaaaaaataaataaaaataaaaataaaaattggccaggcgtggtggctcacgcctgtaatcccaacactttgggagccgaggcaggtggatcacttgaggtcaggagttcgagatcaggctggccaacatggtggaaccctgtctctactaaaaatacaaaaattagccgggcatggtggtgcacacctgtaatcccagctacttgggaggctgaggcaagggaatcgtccgaacctgggaggcggaggttgcagtgagccgagatcgcgccactgcactccagcctgattgacacagcgagactgtctcaaaaaaaaaaaagttaatatccaagtcttgtatgtacttttctaaatttttataaagcccatcttaaacattattactatgagactttagctgggaaacatggaattaaattttttcctagtgtggtaaaattttaatcagttaattatttttaattcagaggttctaaaagccactgaaaatcattaccactttatagttttatctaggccttgccattttgccttctttttggtagtagacaaggtgagcaactctattaaaatatacaggacaagttcataaaaacattttaggaataatgaacgttgccttttctcccaatctagtctttaccacttctgttaagacaattctttttaaagttcaccttttagtatattcaaaatttcttcaaaacctttagcagttctctaccaagtaagttcagaagccttagagttctaaaacgcaaaataataaaatgagagaatgctcatttcctgtttccgtagcacagaaggctattttgttataggcaaatttagttttaaacagttattatttgtattctctcatctaagcccaataatataggaccaaagcttttaagtggaaaattagttacaaataagtttctttttgctgtagactttaaaatgtagattagcaaatacagagttttatctcttgttcatgatagttcatgaacagacccagtgaaaggaagtgctgccatggtaacgtaaaccagactgttacttgagaccatactcaagatacttaactgccctgaaactgcacgttttcaataccagtttttccaatttgctatttcaaggaaatagcaactctactgtgatcaaaacaatttgcagtcccctcacaatagaatttgaaaagtagacttgaactaaacaatttctaggagcgtaatctcaggaattccaaggtagagcatggctagcattattaaaataattgtcttggtctgtgtatgaaaagtaatgctgcgtatcttttctatatgaaactgaattggctttggggcaaaagatgttgtaggtgctaacattttaattcttcctttttttttttttgagacagcgtttcactctgtcacccaggctggcctcagcctcctgaatagctgagactataggcgcgcaccaccacaccaggctaattttttctatttttgtagagacagagttttgctatgttgcttaagctgctcttgaactcctgagcacaagcaatcaccttcgccggcttcccaaagtgctaggattacagacgtgagccaccgcacctggcctggtgctaacatttttttccttgtcatcaaaacacatttatcatttggtccaggtgactgaacatatagctaagttaagaagtttcatttaatccaaaaatacatttgtaaaacttgtcttttattgaaaaaaaaaaaaaaaaaaagaaaatgtcaaatacttttttagtatagttaatgtgatatcttgctgctaaacaccaggaaaatgtttctcctgataatccagtgcatttctttctttatgatagtgtgatatgacaaccatggtttttctatttatataaattgccagcatagtaaaaaactgccttacactcaattgctacaccttttcacaggcaaaaggttttattctctcctaaattaattttatcccgtttttttttaccacctaacttttgccttttattcagaactaatgtatttttttcttattgtcgtttttttttcaaaattccctcctcggtggaaagtaaaggagtaggaacatactattattcaaccaacatgcagcaacccttacgtacgtcagtttcagaatggccccttaatattcacctattttgcagctatgtctcttgcatataaatcctcttatttgaatctcattacaattcagtgaagtggcctgcattgttgttttactttacgggtaaaatgtaaatgagaagtctgactctcaaaaattaaatgatttgcccaatatcacatagccagtcaataagtagtgatcgggaccttggtttttgaacctatagaacggtgttctttcattttgccattctgctataaaaattatgaaatgatattcagagataaaagagcgtcaataatagactagtagtaccttgaaaaagagtgtgggaaatggaaggactctggagatcatcacattaaatcttaatagcaatcataatagcttatatcatagaagatttgatacacgcaaaaaggagtatgagaatgggaaacaagtaaattttgttgttatctaaataattgttaatgtagtcgtaaaggtaattcaaattttaagaaagagtttttgaagtagaaaaggcataatataaaaccagaagctaataacatttgaacctcactaatcttgtgaattagaggaagttttgtacatcataggatgaatcccttttagtcactacagtgcacacatagcaagctcacttcaaccttagtttcatactcaaaaggtgctagagattatttacccctgcacatttatttaaaacatttagacgctgactgtttatgtataaaagttcctagttattcttgtgcattttattctaggttaatggaaaaggttccttatggtgtgttgatccggaatataaacccaatcttatccaggcactgaagaagcaacctttttcttcagcatcttcacaaaagtaaggatcttccatataactgtcagtggtgatttataggatttcactgtgtgagatggagaaacttaaaggtccagggtattatgtttctgttttattgtataaagaagtatttatgttttatttagtttttagtttttagtttttgtttttgttttgttttgtggacacagtcttactctgtcacctaggctggagtgcagtagcgagatctcggctcactgcaacctccctctcctgggttcaggtgatcctcccacctcggcctccctagtagctaggactacaggcaagcaccaccactcccagctaatctttgtctttttagtagagacacggtttcaccatgttggcctgggtggtctctaactcctgacttcaagtgatcctcccacctctgcctcccaaagtgctgggattacaggcgtgagccaccatcctcggcctgttttttcttttcttttcttttcttttctttttttaagaagtatttatggataagacattagcctaagttagttttccttatggtctaatttgtgtttctagaatacaggaaattggtgacttgagaacatacactctgggaaatatagtcaatactgagtataagtaaaccctaaagaaagttgtaatataatttcagttacaaacaggtcagatcattttaattgtctgcaatactaatgctaacctaaaaatgaaggaaattaaaaatacatttaaaattttttaacaagattattaagtttgtcattataacattttatatacatatgtaggtttctttttctgttttaggtttttttcgtagtacttaatatttgaaaagtatgttcaagtctaaaatttttaaatgtttggcaaataaaataatgctttgaactttgtttttattttttctggtaaatatagttgtactgtatttgcttataattttccttgtctttgttttcaatcccagtaacccctgttgatcttctagcttcctcattttaagttaaatcggaaaataatatgaccttcttaaatctgatttttgtttcctttttctaaagaagactttagagtcttctccaatttattatataccttcatttgaattgaaaatcccagatttggttaaaatactttaagggtagtttataatggctaacttgttttttgaaaaatttaaaaagatttttaataaagtaataaatggaaatttttaaacatggaaaaaagtagagagaaagttataatgaactcccagctgcagcaatcatcaacgtttcatatagtggttaatttgaattcttaaagtattgttagataacttgtagaggagtggttgtagctggaatacagtaaatagctgggaaggctaaagttgaaatatcagtaatatattcactcactgagattttaagcttctttaccatattatagattagatggatcattataaaaagaataactgagtggtttatctttatgaaatgaaacctagaaaagaagttaccagattttatattcttacttggaaattgatatctttattaattaattttggttattatgaggcattttaaataataatttagaaactaatggtgagttctactgatgttcacctatgtgttttacttagctgtgttgggtttttttttttttttgctgaagattaagcctggacaacatggagaaaccctgtctctaccaaaaatacaaaaattagctgggcatgggtagtgcacgcctgtggtcccagctactcaggagggtgaggtgggaggatcgtttgagcctgggaggcagatgttgcaatgagccaagatggtgctactgcactccagcctgggtgacagactgagaccccatctcaaaaaaaaaaaaaagattatatgaaagaattggcaccattttttgtaaaccatcacaaatatattttgctgtctttgatatattgtattttcatgtttctatcttttagccttaatcataagtttaaatgttaaaagtgatcttgtggctttaaaagaagataaaaactatggtcaggtgaggtggctcaagcttgtaatcccagcactttggtaggccgaggccagtggatcacctgaggtcgggagtttgagactagcctggccaacatgttgaaacccgtctctaccaaaaatacaaaagtcagctgggtgtggtggcacgcgcctgtaaccccagctactcgggaggctgaggcaagagaatcatcttgaacccaggaggcagaggttgcagtgagccgagattgcgccactgctctccagcctgggcgacagagcgagactgtgtctcaaaaaaaaaaaaaaaagattaaactacaacataagggttatatataaccttttgactttaaacccttaatataaaatgaaacattttgccctttatgttgtttggcaaaataacagttccatctgacatgcttttgtgtagcccttgcatataagaatttgtaagtctgaggaaaagagtgagatacagtatatgtaaaactatgaataggaaataaacttttaagttcgttaacaaatagatttttttttcatgctatcataaattccaaagaagagaagtagtttttcccaaaaatattttaattcctggattaaaaaaagaactgttggtgtctttccatgaatatagaaagtttaattttatgtttattaataaaatcaggaacatacctgtttgctatcactaccaagtgttccttaaccatgaattttggtaaatgcttttatttttgtggtaatacctatattagtattatatcaaacttaagaatccaatgcaaaaccaaacagtaactatcatgtattatctatagttccaggcattttaaatgcattattattatttaattatcacaacagcctatgtgggagatttaattattcctattttacagatgaagaagctaagagattaattattttgcctaagaacatccaaatagttgtgatttacctcttttggctcctatgctctttctgctttggcagactttctaaattgagtagtattagcaaagaaaacaaggtaaaaatagtttgtttttggtggtacaaattagctgtatttgtgactaagttctataaaaagtgaaatagttgggtgcaagtggctcacgcctgtaattccagcactgtaggaggccaaggcaggtagactgcttgagcccaggagtttgagactagcttgtacaacatggtaaaaccctttctctaccaaaaaaaattaaaaaattagccacacatggtagtgcatgcttgtggtcccagccactcaggcagctaaggtgggaggatcacctgagctcagaaagtcaaggctgcagtaggctgaaatcatgccactgcactccagcctgggcggccagcagagtgagagagaacctgtcaaaaattagggggaaaaagtgaagtaaacatttttataagcatatttgcttttctgtttgtttttcagtggttctttatcacctcactatttaagctctgtaatcaagcagaaccaggtgcgaaacctcaaaggtatgtgtgaatatcagtacagtcatgcaccacacaacaatcttttggtcaacaacaggcagtgcataacaatggtggtcccctaagattataatggagctgaaaaatttctattgcctggtgccctggtagcttgttgtaacattgtggcacaacgcatttactgaagtttgtggtgatgctggtgcaagcggactcactgcactgctagtcctgtaaaagtatagcacgtagttatgtacatatgttaatacttgataatggtaataaactatgtcactagtttatgtatttactatactttttactgttatttttgagtatactccttccaccaattaaaaaaagttaactgtaaaagagcctcacacaggtcctttaggaggtattctagaaggcattgttacagtaagatgacagctccctgtgtttattgtccctaaagaccttccagtgggacaaaaatgtagaggcagaagacagtgatattgatcttgaccctgtgtatgctcaggttaatgtgtgtatttgtatctttgtttttaactaaaaagtttaaaaaaagttaatttaaaaatagaaaaaagcttataggttataaataaaatatttttatacagctgtattatgtattttatgctgttattacaaaagagtaaaaatttaaaaaattaaaaagtttataaagtaaaagtttacagtaaactaaggttaatgtattattgaagaaagaaaaaattaaaaaatcaatttagtgcagcctaagtgtacactgtttataaagtctacagtagtgtacagtaatatcctaggcctctacattcactcaccactaacactctctggctcacccagagcaattccggtccttcaagcttcattcatggtaagtaccctatacaggtgtaccattttaaatatttgtatagtgtttttattgtacccccttttttgttccctggcagaaactaatagatcatttactgtaccttttctgtgtttagatacacaaataccatttgtgatacaattacctatagtattcagtacagtaacatggtgtacagatttgtagctcaggagcaatcctaggtgtgtagtaggctataccatttaggtttaagcacactctatgatgttcacacagtgacaaaatcacctaacagtacatttctcagaacatattcccgtcattaaacaaagtatgactgcatttttatttatttgttttatttttaagagatggcgtcttgccatgttgcccacactgatcttctgaatgcctgggctcaagtgatctcctacctcagcttcccaaataggtgggactacaggtgcacatgactgtattttaattcataaaaaattcagataaaaatttgggatattttgttgttgctgtttaacatttttctattttaacaagtattatgtatttattataggaaatttgggcaataaaaacatttattaaagagaaagtaaagtcatttatcccattgttaatattttatttttatttatttatttatttatttgagacaggttctcactctgtcacccaggccagagggcaatggcacagtcatgactcaccatagcctcacaatcctgggcttaagccatcttcccaccttagcctcccaagtagctaggactacaggtgccattacacctggctaattttgttgttaacattttgatataattcctttggggtttttttaatgccacatatgtgaatagatacacttgcatgcgtgtatgtacagggacacatacataaacacacacatactttttctccagatactagattcacactgtgtatacagttttatatcccttttccatttatttttatgggtatttttcattgaaaataggattgaattttttagtaatatcagtagagttattaccttttcaggtctatcttagactagaaaaggggttggcaaactatggcccatggccatttctggcctgacatctgtttttgggtgtcccatgagctaaggatggttttacatttgtaaaatggttggagaaaacaaaatcaaataacaataaaatttcaagactgtgaaaattcattgcaacagagacctacatattatatcctgggttttgcctcttagcatgcaaagcctaaaatatttaccttctgaccctttactgaagaagtttgtcatccctcaaattagaatatgcttgaagatatttctcctgtaggttatttaatctgaagaactttaattttaaaagataataagttgactttttaaaagtatatcaaaattctgaattagtgggtttttttcttgtagattagtagtatattaaaatcagttttcctagcgttgctttggagcctggagacattttcataacctttaaaaatagaaaatttcagatgaaaacctttctgtgtatcagaaatattttggctctttggaactatactaaactgagcctcagaagcagtgtgctgatatctttaaaaataaaggaggaaaagaatatgaaaaagttctagagaaccctgcaaagaagttaaatggataggggatctgtttcaaataatgttctgccttaacataagacaaatatccgtgttcctgttacctacatcagtcaaatgtggtttctctttacatttaggtattgccaaaatgcctttatctttgtattgcctcaataaagtctgacacttattctctaaagctcagttcgtatacatatcttgagaacattttctttgtgaattctggagtttacttaaatcttttcttgctcttgttctgttctatccaaattctttctttctttggggaacagacatttccacaagtttttgctgctagtttcacctgcatgtttttcatttactagggcacaggtacttcttcttcatctaatgacttgtacgtattatgcatcatctgtctagtgctaccagcaccttacctccattcctatatgcatgagtcttaggcctgttcctctagtaataattaacttagtggggaggtcgttggcattctaggttaaaacaaatgcacatctgtcctggaatataatacaaaattctccatgaattttaagggaagaaaacataaaacctcacaaaaatttagggaattttatttttgaacttggttgttttggggtatatttctgaggaaattttctcttgcctctttatattatttctagagagaagtttaaaaaacaccaagtggattagacattcattacaactaatactgttgagccagactccttgtgccagacactgttggaggttccttgggatatgcatagatgagagacccaggccctgctcttagaaaatatatactttggctgggcacagtggctcacgcctataatcccagcactttgggaggccgaggtaggtggatcacatgagatcaagagttcaagaccagcctggccaacatggtgaaaccccatctctactaaaaatacaaaaattagctgggtgtgtgttggcacacgcctgtaattccagctactcaggaggctgaggcaggagaatcacttgaacttgggaggtggagattgcagtgagccgagatcgcgccactgcactccagcctaggtgacagagtgagactccaaaaaaaaaaaaaaaaaatgatggagaacacctgattatcaacgatttgtccaaggtacaacctcaaactttgtggaacaaaagttctccctggcagagagaatcataacaatagagagagttgtctggcagttgctaggaatctgtctggcatgttgatatagaccaggtagatgtggtcatttgcgtgggcaaggcaaatgtagcagaagtttaagagcttatttagcataataaggactttgaacatcctcctctgcctagaacaattaataagccttaagttgcttacttgatgctttgcatgcattatctaatttaatccttaaaacaaccctctgaggtattgctgcccctcttttacagataagcaaactgaagtttggggagattaagtaacttctcaaggtcacacaactagtaagtggcaaagaaggattcagattgaataattctaatttcaaagcctgactcctactagataagtggcactgggagacctgctgaagaactttaaatagtgaagtgacatcgtcagttttatgttttataaagatcacttaggtattatcattggcctccaatattaaaacttacatattcatctaacacttcatagaatcatctttactgatcattatattagagctacctttagacacggaaaactaaagggagagattaggcttagaactccagaaactgttatcagcctaaacaggtgcagcagtgtgtttgttgtctcttgatcaacttacaatgacttttatgtgacagtatcaatgttatggcattgtataatagatagcaggagacacaggattcttacactgagatagcagaacgaaattttttttggtcaatagtttggtttggtgtgtatttagagtaaattcacctgtttaaaaatattactgagctgttctagacaccaaggtacatcagtgaaaaaagcagacaaaaatggaactcacattccagttagtaaattttagtagttatactaactgctaaaagcacctggtatactacaaacagatataaaattaaggtagttgatggtgatgttagggctacatgtaaagctaagatttgtgtcttactgaaatgaaactaaaccagtggtccagacagcttaaagtgttggtaatttattgaaactattcttctacttcagagaattacaagagacagcttctccatctggatgctctgcaaatgtatatattagttttgatagagacaataaatccttttgtaattactacaaagcttataccatttgaattatttctatagttctcatatcattccttacacaaatggactgagagtcaaacaacagaaatatgctcgacttataaccttactctcatatggctaaaactagtgtctgaattgtttttaattatttttaatcatttcccaacatcaaggttaaggaaataaaaaccaacaggcacaaattaacaagttttttaaattgttgtttattttttgttttttgaaatggtgtctcgctctgtcaaccaggctggaagtgcagtggcacgatcttcgctcactgtaacctccacctcctgggttcaagtgattctcctgcctcagcctcccaagtagctgggattgcagacgcgtatgacctcacccggctaatttttgtatttttagtagagacgggtttcaccatattggccaggctggtctcgagctcctgacctcaagtgatccacccacctcggcctcccaaagtgctgggattacaggtgtgagccaccacgnnnnnnnnnnnnnnnnnnnnccaaattcatggtgttgacacggttttgtttgaaccagttatgaaatcagtagcatgtttgaaactatcaaattttggttccttttgaactggatatgttagataatacagctaatagtgttattgtttttaaaaacagagccacctttaaaatagcataaagtactttatcaatgaaaaaataccattatgaagtattttcaaatgtgacaataaacaaatgagtcttcagtttaaatttcatagcaaaattggctgaacgcggtggttcatgctcgtaatcccagcactttgggaggccgagatggatccctcaggagttcaagaccagcctgggcaacatggtgaaaccccatctctagggcaacatggtgaaaccccatctctaccaaaaatatgaaaattagccgggcgtggtggtacacacctgtggttccagctacacgagaggctgaggtgggcagatcacttgaacctgggaggtgaaggttgcagtgagccatgattgcaccattgcactccagcttggacaacggagtgagaccctgttgataaataacgaacgaatcaacgaaaatagattgggtactataattaaaaattgtaatttctacccagagaatttttattgcttttgttccacaaagttcaagactgtaccttggacaaatcattgataatcaggtgttctctattatgatggtgatttggatcattcattgcttatttttaatgttgaagttaaactttttttcacagttaattggcaaggcattgcaggaagcacacttataaatgttttaaacaaataagatacaggcaaaatccttttgcaaagaagtgtttggtttcacaaagttaatttcatgttggagatttcaaattaatttggctataagttatctaccataaataaatctatttaaggtgtatttttcctaccattctactgttatagaaacagtacttaatttgttaacactttacaatattcagaaatggtattcatgtagctttcttatgttatcaggataagcctcttaccagttttaggtgttgtgtttcaaaataatgttccttgaatcataatggatgtttgttaaaagaagtgaagttaggccaggcgggggtctcacgcctgtaatcccagcactttgggaggccaaggcgggtggatcatctgaggtcaggagttcaagaccagcctgaccaacatgatgaaaccccatctctactaaaaatacaaaaattagctgactgtggttgcgagtgcctgtaatcccagctactcaggaggctgaggcagtagaatcacttgaacccaggaggcagaggtggcagtaagctgagatggtgccattgcactccagcctggacgacaagagtgaaactccatctcaaaaaaaagaagtcaagttagagatatactaattttttagtaagtatattttataggtgcttcatttataagataaagtttctgtaattggtttctcattataatgcattttcttgttagattattttaccgtcaccttcctcttttataaaattagaaacaaggtagatcctttttattaaaaagaaaatttaggctgggcacggtggctcacacctgtaatcccagcactttgggagcctgaggcgggaggatcacttgagctcaggcaacacggtaaaaccatatctctacaaaaaataaaaataaaaatgagccaggtgcggtggtacatgcctgtggtcccagctacttgggaagctaaggttgaaggatcgtttgagcctgggaggttgaggctacagtgagccataattgtgtcactacactccagcctgagtgacagagggagaccttgtatctcaaaaaaagaaaagaaaaaaaaaaagaaaaattagtttatggagaagtaatctctctgttggggcttttgcataatgccatgcaagttgtgccctctgcaagtccacctggcttaaggcagtgagtggggcctgaaattcagcccacattccattcgtctagctgtgtgccttgaatagggaaccattcacctggaggaagatttgccttttttccaactcacacagagacacaatatgggctagcggctgcaacttttcttcttcagacgtgttagaatactgaactcaaaaagaattgcctcaggcttcatcctaaaagacaggaattggagaggtcattgtttttgctagcctcttggatgtggcatgtgggcatcattgattcaaatcctttgtacttgctcttctttctgcccagtactcttttccctcagatatcattctttctctccctgaggtctttgcccaactgtagcctaccttctccttcaggatttctctgacctctatatttaaaattgtaaccactttccccaacactctatttccctttcctcttaatttttttaaatttcttgaccatttgtatgtcttcttttgagcaatgtctgttctgatcatttgcccatttttaaattagaggattttggtttgtttgttttcctgttgagatgcttgagttccttttatattgtagatgttaatcccctgtcagatgagtagtttgcatatattttattcattctgtaggttgtcatttcactgttgtttctttcctgtgcagaagctttttagtttgatataattacgtttatttttgcttttgttacctatgtttttgaggtctcattcataaaatcttttcccagaccaatgtcctgaagtgtttcatctttgttttctcctggtagttttatcgtttcagttcttacatttaggtctttgatccattttgagctgatttttgtatagggtgacaagtgggagtctcgtttcattcttctgcctgtagatatatatccaatttcttttgtatcatttattgaagaaactgtctttcccccagttagtattcttggcacctttgtcaaaaatcagtccactggcggagggggtggggcgcggtggctcatgcctataatcccaggactttgggaggccgaggcaggcagatcacttgaggccaggagtttgagaccagcctggccaacatggtgaaattccatctctactaaaaacacaaaaattagctgagtgtggtggcacgcctctgtaatcctagctgttcaggagactgagcacaagaatcgcttgaacctgggagatggaggttgcagtgacccgagaacactcctctgccttccagcctgggtggcagggcaagactgtctccaaaaaaaaaaatagttggctgtaaatatgtcaattaatgtccaggttctctattctgttccattggtctatgtgtcttatttttatgccagtaccttgcttttttggttactacagctttgtagtatattttgaggtctgtttgtattttgcctccagttttgttctttttgctcaagattcttttgcctatttggggtcttttgtagttccatacaactttcaggattattttatatttccgtgaaggatatcattggtattttgatagaatttatagattgctttggaggtagtattgtcattttaacaatactaatttttcctatccatgagtatgggatgtctgtttgtattgtcttcaatttttttgtaggtattttaattttattttttgtagctattgtgaatgagattgccatcttgatttctttttcagctagtttgttgttttgtgtgtagagatattactgacttttgtgtattaattttgtatcttgcaactttactgactatcagttctaagagttttttggtagaatctttagttttttctatatataagatcatgttgtctgcaaacagggacgtttgacttcctctcttccaacatagatgccttttatttctttctcttacctaattgctctggctagggcttccagtactatgttgactaagagtggtgcaagtgagcatccttttcttgtttcagttcttaggggaaacgctttcagcttttccccattcagtaagatattagctgtggatcatgaggtcacattttacttggggaaaaagaggtaaagtattatgtgctgtttcatagtggccagcatctgatttacttaagcctgttagtgttatcaataacaacagcatttcctaccttaagagagtttatggtctagttggagagaaaacaagtcattatcttcatggctttattatctacaataacttttaaattagacattgaaagtaaataggaaatctttatggtaataaaaatttccacctttgagatatagattagaaatttcatatctgagtcttattttaaatgtctttttgtaagctaaaatttataaacattttctaacttttctaattattaatggtgtaatttagattataccattttacttttctttagttattcagactagtatatcaccaagatgaagaacttacagcagtaaatataagtaggtatgagagcataactttatctgttgtagaacctgctgattttgccagtcttttaaagcccatttttaatggagtatccatttgacttcatgaatattatataaatttgtcgtacatgtaggcttgtgtataatcatgactaaaaacaataataattatttttgtttctgcataattattcacttagcatttataggtttacatgacctagactgacgaattacatatttttatctcctgtaactggcatgtaattaacatagtacttcataactgcagatatgcataggtaatgatagtattcaagtaaaaatgcaaaaaaaaaaaaaaggagtaacgatgtacattcttagctaatttaatctgtttaaggggaaaccttactgaaatacagtttaagttttcgttttcattgtgaataattaaagaagagaacttgcattatttctggtatctctccatctcttttacactgtattgttcacaaaactgtttcgtgattttaagtgaacaaaatcagacttcagaataatatataatatctcatttttgtttgatgtgcgtttatgctttcttagaatatacaccaaaattgtaacgctggttatcttcaggggcatgcaaatacttagaatagcctctcctttataaagaacattaatattattactttttcccttttcagaatctgatattgatgctgctgctgcaatgatgcttttaaatacttctatagaacaaggaattttagaatgtaagtaatcatgccttttttaaaaaaaaattttagtgccttttcaaatttaacctagactataaaataactattacagacaaaaattacttctttccaaccaaattgtattttgatctgagtaactcagtttctgttttattatactttcattaatttatgtgagcaattgagagattgaagttaatgcttcgatttttcttacattgaccaagaaatgaagaaaaatatatttagaaaatgaactcaaagagctaaaagtaaaaatgaaaactataaacaagaaaatataataagtaaagtatatttatgaacttggactaggaaaagctttctttaagatacaaaatgcaaaatccatgaaggaaaaaaatgggtaaatttaataaaacatcaaaattttagcattctggtcaggcatggtggctcacgtctgtaatcctagcacttttgggagaacaaggcaggtggatcacttgagaccaggagttccagatcagcctgggcaacatggcaaaactccatctctacaagaaatacaaaaattagccagatgtggtggtgcatgcctgtagtcccagctactcaggaggctgaggtgggagaattgcttgaacctgggaggtgggggttgcagtgagccatgagcactgcagtgagctggagagcactgcactccagtctgagggacagagtgagactctgtctccaaaaaaaaaaaagcattctgacaacaaaatatatctaagaaaagtgacataaaatgctggagacatgttttttccatatataacaaaggattagtatcaagtatatacataaaaaggattctgcaagtaagaaataagaaaacagttcaaccggaaagtcagcaaaatatatgactaggtggatcttagaagaggaaatatatgtgggcaatacacatgtgaaaagatgtgtaacttcgctagaaattcgggaaacacaaaatgaaataatattgaggtaacttttttgtccataaaattataaaaaatttaagtaattgagaatggtgttaagtagggagtaagttttgtcatacactgttgggagtaaattggtacaaccactttggagggcaatttgagaataccaattataattttaaatgtatatatcccttagcaattttttcatatctctttttaaaaattacttgcatatattcaagaaaaggcatccagaaggatttgtattgcagcatgatttatactaatgaaaaattggaaacagcctaaatattaacacggaagtgattagctaaacagtggtacattcatattgaggcattccttgtaagcaattcaaaatagttacatatgctatagaaaagtcaagacattgttaaatggtttttaaatgtttcaaattaatgcttgcaaaatgatgtgatctgggtaaaaaaaaataaaaaatctacaaagcatcatgaatctaaaacatttgttgctcaagagtaatgtagtagtttaaaattggtctgtttttgcaaccaaacacatttgacctattgatggaacttttattttccacaggtgagaagcctcttcctcttaaaacagcattgcaaaaaaagaggagttacggcaatgcatttcatcatcccagtgctgtacgattacaagagagtgattctttagccaccagcattgatccaaaagaagatcacaattacagtgcaagtagcatggcagcacagcgttgtgcatccaggtctagcgtgtcttccctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaatagaaatacttaaagtgtggcaatactctttcacttaattctttacaagggatatcaaagccataatggacttcattagttttagggtagggaagggatactaattacttatttctttcaaaacatttttggtttttggtttttaaaatttttattaaacaattgctgttaggatcatgcctgatcagaaatacatgatgtgaagtcctaaaagcataatttttgtgataaatgtgtccaagatttgaaaatttttatataagaaaataccccagcctctgtcttaaacttgtgggacaaaaatccttccttctgttaatatgtcagaatgtnnnnnnnnnnnnnnnnnnnnnnnnnnnnnnnnnnnnnnnnnnnnnnnnnnnnnnnnnnnnnnnnnnnnnnnttcttttccaatctgtaactatagttactgaaccagctaaaaattttgctgatgtatttttcatatacttctctcctgacacgcaatccggtaacataagattgaaatttttttactttgtcttaatttgtttctaattttttttttgttgtcgtgtgagcaaagacaaacataaattgaaaaacatcctgatgtttagaaagtttcttttggttacgtaggtagagaatacaacaaagagttctaagacttagaaaagacaattttgtggtgtcatttcatccaagaacactcccaattcctattagaatggtagctttgaagtgtttttacttcagagatcctgcatagcatttattggggccttttattctttcccaaagtgctttgcaaacattaagttttagccactagctgcctttgttgagtataagttatccagtgagaggatatagccaattaagtgtgttatggagtacacccattttgacacacttgtaataagagaatctttcatttgcctgccatgtgtactgtattatgagaatcttataatcggaatggagtgaaatgaaacattttgagtactgatggcatgttatcatacataaagtaggtcatttaggaaaaaacttctgtccaagctttgtatgaattaaattcataagtataccaaattaaatcttaatagatttaatgcaattttacagacacaataccttcatgaatttcaaaattcatataaaatttgatcttatgcaatacacctttttgaggaggcagtgtaacaacctatagtgccattgatccatgagaaaaagattttctggtactactccaaaagtgctttgactaagtatcttaactatttgaacagtctgcttatatgagacagtttttcatagtatcatttgtataatttgattagattattcagaaacaataggatgctaaactaattcattgtatcttttttttacaatggtggaagcaactttctgaaagttcagtcttatgctacatcctaagtcatagacaatgaccttgttttcattattctgatagattgtatacatatgtacacatacatatacacatatgcacagtcaaggtcatgatgttgatttgctttcagctgtttctgtgattataaagcattttttaagagacaaattttaacttttaatttttattttggcaaaactgtcaaatgagaaaaatgattttaaaaacttttttttcaattgacaagactttaagtcagggataacagtattaatgttctctgttctgtttccatgttaaatttaatttaacctggatagccacattaatgaattggtgctgtcaaaatatagtaatttttaaatttgttaataatgaaaacccttaagcatgcaggatgaggtatttgggttttttttttagatcgatcacatctacagaaaatggctaaaccaagttaacttttattatagacagtgaataaaacaccaaaaacccaaaaatgctttaaccacagtataaataatagattatacacatcatcttaataactatttttaagttatttaccatagcctctgtatagaccttaggaacagtgtttcagtgatctggcaccagtttattttgttctgctgaaattctgtatcacaaatgtgctacctggtttttgtccattagataattactctttataaggaaaggaaagagaagcag

SEQ ID NO: 17614 - DNA, 601 bp, Human
ttctaagagcagcctgtgaagtcgagctgcaggcacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttacttaccaccwccactttgaaggctttcttgcctataccaggacaaactcagctctttatcccttttccgaattttcctggtactttcactttgaatacagcgcttaattaacattctgccttgtacctaggactaacacagtataaattcccagaagacaaagtaggggaatacaataacaggatatagaattttaacagctaaattagatgaatttatgggtgacctttattgggcaaaagaaaatgttaagttagtataagatttagtataagctaccatctcaaaactcagggtctcactggaagag

SEQ ID NO: 17615 - DNA, 601 bp, Human
tcactttaaatttctctctcagtagtaagagacttgcaggagaaatctatggtggttcactgagtgacagaggatgagttagatataattgtttgggagggagattgtgaagttcaatacgggtctattccttgaaccagttgcatctggttctttatctgtaaagtggaaataatatctataacacagaatttctatgaagattaaattatatgctgtatttaaagcccctagcacttagtgactggatcaaagtagtttctcaataaataatacataatacatacttgtcatttttccttttttttttttttaagagacagggtttcactctgtcacccaagctggatgcaaccttgacctctggggctccatggattctctggcctcagcttcctgagcagttaggacaataggtccatgtcaaccacacctagctgattttttaaatttttaaatgttttgttgagacaggatcttgctatattgctcaggctggccccaaactcctggcctcaaatggttcacctgcctcagcctcccaaaattctagaattataggcatgagctaccgtgcccagactttctctaccctctatct

SEQ ID NO: 17616 - DNA, 601 bp, Human
tgttatactgaaatacagtagatgtattagttttgagctaatgatgagaattcatcttaaagaacagaaaataatatttgaaaataaatgttttttatttcagatacctaaaatttcaagcaaactgtttaataaaggaatttgtacatatttgctaggaaatttgcaattttttttaacaattgagaggttagctaaacattctcactattgtctataagaactgtgtgaaacgtctagattgttctcctgtagcatatacagtcagctctccatatccatgagggaatagtttaggacmtgttgccctccatatcaaaatttttggttgccaagtctgttatacaaaatgtacagttagccctttgtatctgtgggttttgctccacagttggttaaattccaaaattcgtggatgccaaaggcaaacttttaaaaaattaaaattttataacttttctaattataaaatactgagtatagaaaatttagaaatgttttaagtagaacaaaaatatctgtaatccctcagatatggagttaattagtattacttccttattgtagtgcctaccacatttttaaatatgtaattgtgttt

SEQ ID NO: 17617 - DNA, 601 bp, Human
gttatactgaaatacagtagatgtattagttttgagctaatgatgagaattcatcttaaagaacagaaaataatatttgaaaataaatgttttttatttcagatacctaaaatttcaagcaaactgtttaataaaggaatttgtacatatttgctaggaaatttgcaattttttttaacaattgagaggttagctaaacattctcactattgtctataagaactgtgtgaaacgtctagattgttctcctgtagcatatacagtcagctctccatatccatgagggaatagtttaggacckgttgccctccatatcaaaatttttggttgccaagtctgttatacaaaatgtacagttagccctttgtatctgtgggttttgctccacagttggttaaattccaaaattcgtggatgccaaaggcaaacttttaaaaaattaaaattttataacttttctaattataaaatactgagtatagaaaatttagaaatgttttaagtagaacaaaaatatctgtaatccctcagatatggagttaattagtattacttccttattgtagtgcctaccacatttttaaatatgtaattgtgtttt

SEQ ID NO: 17618 - DNA, 601 bp, Human
attgtctataagaactgtgtgaaacgtctagattgttctcctgtagcatatacagtcagctctccatatccatgagggaatagtttaggacctgttgccctccatatcaaaatttttggttgccaagtctgttatacaaaatgtacagttagccctttgtatctgtgggttttgctccacagttggttaaattccaaaattcgtggatgccaaaggcaaacttttaaaaaattaaaattttataacttttctaattataaaatactgagtatagaaaatttagaaatgttttaagtagaayaaaaatatctgtaatccctcagatatggagttaattagtattacttccttattgtagtgcctaccacatttttaaatatgtaattgtgtttttaacagttagcccccattatatacatgtagttttatgtacatctttatttaacaacatgaacattttcttatgccttccttctttttacatgctgtaacaatactgcataatttgctatctaatggatatgctataaattgtttcacttttctgtactgttgaatgtttaaactccttgggtttttactttggaaaataatgttatgg

SEQ ID NO: 17619 - DNA, 601 bp, Human
ttcagcattagaaacactgggtaactctgtttcttatcttagtgtcatagcatatgccattacttgtacctggaatgcatattcttcctctttttccctcctcgcaaagaagccattttcctttttgagacttaatttaaacatcctctgccctgggaaactagtttctcaagccccttgtctgactttcacacatagagttgcagtatagttatttatcttcactgttacattgtgaaaatctctaggactgaatgtcttttacctctggtttccccatatcctaatttacatcgtggtrcatagtagatattcaatacatgtttgcatgaatgaatacatgtgaaattgaatttaatgaacttgtttaaagctatctaacattttcactttttattaaatatatgatttgttgatatacctatgcctaatttgaattatatattaagtgtttttaggccaggcactgtggctcatacctgtagtcccagcactttgggaggctgaggcagaggattgcctgagcccaggaggttgagaccagcctaggcaacacagtgagatgccatgtctacaaaaaatttaaaattagctgggcatg

SEQ ID NO: 17620 - DNA, 601 bp, Human
attacttgtacctggaatgcatattcttcctctttttccctcctcgcaaagaagccattttcctttttgagacttaatttaaacatcctctgccctgggaaactagtttctcaagccccttgtctgactttcacacatagagttgcagtatagttatttatcttcactgttacattgtgaaaatctctaggactgaatgtcttttacctctggtttccccatatcctaatttacatcgtggtacatagtagatattcaatacatgtttgcatgaatgaatacatgtgaaattgaatttaaygaacttgtttaaagctatctaacattttcactttttattaaatatatgatttgttgatatacctatgcctaatttgaattatatattaagtgtttttaggccaggcactgtggctcatacctgtagtcccagcactttgggaggctgaggcagaggattgcctgagcccaggaggttgagaccagcctaggcaacacagtgagatgccatgtctacaaaaaatttaaaattagctgggcatggtgatgtgtgcttgcagtctcagctattatacacgggaggctgaggcgggaggatttc

SEQ ID NO: 17621 - DNA, 601 bp, Human
tagaaggcccacgtgggaagatcccttgagtccaagagtttgagaccagcctgggaaaggtagtgagacttcatccctacaaaaaataaacaaaaaattagctaggcatggtggcacatgcccatagtaccagtgactcagaagaggtggaaggatggcttgagctggggaagtcgagactgcagtgagccaagatcatgccactgtactccagcctgcgcaacagagtgagatcttgtctaaaaaaaaaaagttatgtaaatgtcctctttgtctttcaaaatatcatatatatactgtrctgcgggtaactgaaaccacagaaagtgaaaccccatggaatgggggagggcctactgtgttattaagacatagacctcaaatactagctcttccatatactaggtacgtgactaggcaagtttttaaacctgattatttatttcctcatttgtaaaatgtaggtaataataattgggattgttaagagaattaactgagagagcaatcaccatgtgttatttgccgatattatcaccattatccggtatgtgtatctcttaggtattttttattggcacgttctgatccagatcctaaa

SEQ ID NO: 17622 - DNA, 601 bp, Human
acagataaaaacaatgtgacataactgagattttactaggtcatacaacactaagaaaaaagtctatgcctgaaaagagtgtagaaaatagcaaatagccttgaatatggaaaggcaagaaaatcttacttaaataagaaaaggtaatttaacatatttgaaaaggtttgtattctgaatatgtggagataaatttggcatttaaagtagactaaagagaaaagagtttaaaattttataaatcacaatttaaaattataaattttataaagaaggaaagaaatgaagtcaataaagtaattttttttttttttttttgagacagcgtctcgctctgttgcccaggctggagtgcagtggcaggatctcagctcactgcaacctctgcctcctgggctcaaacaatcatcccacctcagcctcctgagtggctaggattattggcatgcaccaccacacctggctaatttttgtattttttgtagagacagggttgtgctgtgttgcccaggctggtctcagactcctgggctcaagcaatcctcccaccttggccccctaaagtgctgggattacaggcatgagccactgcgcccaacca

SEQ ID NO: 17623 - DNA, 601 bp, Human
ctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaarccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagta

SEQ ID NO: 17624 - DNA, 601 bp, Human
ttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtrttgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattata

SEQ ID NO: 17625 - DNA, 601 bp, Human
gtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacacttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttacta

SEQ ID NO: 17626 - DNA, 601 bp, Human
acgaggttttgccatgttggccaggctggtctcaaactcctgacctcaagtgatctgcctgcctcagcctcccagagtgctgggattacaggcttgagccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattayagctcactgtagcttcaaaagcctgggctcaagcagtcctcctgtctcagcctcccgagtagataagactacaggcacaggttggtgttgacctcctagcctcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatatt

SEQ ID NO: 17627 - DNA, 601 bp, Human
tcactctgtctcccaggctggagtgaagtggcacgattatagctcactgtagcttcaaaagcctgggctcaagcagtcctcctgtctcagcctcccgagtagataagactacaggcacaggttggtgttgacctcctagcctcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcytaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctt

SEQ ID NO: 17628 - DNA, 601 bp, Human
agatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaat

SEQ ID NO: 17629 - DNA, 601 bp, Human
gtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatgrtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttt

SEQ ID NO: 17630 - DNA, 601 bp, Human
tagcgtgatctcgactcactgcaagctccacctccccgggttcacgccattctcctgcctcagcctcccgagtagctgggactctaggcgcccgccaccatgcctggctaattttttgtatttttagtagagacggggtttcaccgtgttagccaggattgtctcgatctcttgacctcgtaatctgccctcctcggcctcccaaagtgctgggattacaggcgtgagccaccgtgcccagcctatcatatataatatttttaaaactcaacgtctgtgctcgctttagcagcacataatrgtaaaattggaatgatacagatgatttgcatgtatttttttaaaagttctcaagtctatttaataaccacagaatatgagacattctgagatgttttagaaacagttcaacatatgtgggaaaataggagtataaacccttacctcctgtgtagatcaggtaggttcaagattgcatctgttcttttgtaatactaaatgtctggtgaagatttgaggattttatataaatcattgagtttgagaggtttttttgtttttgtttttgagatggagtttcactcttgttgcccaggctgaa

SEQ ID NO: 17631 - DNA, 601 bp, Human
caagaccaccctagactacattaaaaaacatatttttttgtatttattttttattttatttttttgagacagagtttcgctctcattgcccaggctggagtgcaatggcacgatctcggctcaccacagcctccgcctcctggattcaagcaattctcctgcctcagcctcccgagtcgccgggattatagacatgcaccaccacaccgggctaattttgtatttttagtagagacagggtttctccatgttggtcaggctggtcttgaactcctgacctcaggtgatccacccacctccractcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaagg

SEQ ID NO: 17632 - DNA, 601 bp, Human
ttttagtagagacagggtttctccatgttggtcaggctggtcttgaactcctgacctcaggtgatccacccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatrtggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcat

SEQ ID NO: 17633 - DNA, 601 bp, Human
ccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcatgcctgtaatcctagcactttgggaggctgaggcgggaggattgcttgagcccaggagtttgagtctggc

SEQ ID NO: 17634 - DNA, 601 bp, Human
gcgtggtggctcacgcctgtaatcccagcactttgggaggctgaggcgggcggatcacgaggtcaggagatcgagaccatcctggctaacacagtgaaaccccacctctactaaaaaaaatacaaaaaattagccaggcatggtggcgggcgcctgtagtcccagctactcgggaggctgaggcaggagaatggcgtgaacccaggagacagagcttgcagtgagccgagatcatgccactgtactccagcctgggtgacagagcaagactctgtctcaaaaaaaaaaaaaaaaaaaaaaattactgtgaccagattggactcagcttgctgctggcatttggttcccaccataacctcatatgtcatgtgtttgcttatatgtacttttgtgttattgttggtgtatcttcaggataagttccaaaatgtaatattgctgggttaaaggattaatgcacatgtagttttattagatgttaccaaatttccctccagtggggattataccatttttcattcctgcctgaaatatatgagagaagcaccattttaaagttttcacaatgtctctgaactaaaatgtggtagagatgcacatg

SEQ ID NO: 17635 - DNA, 601 bp, Human
ccggccaggtcatgacagcacccagcctcagccacaactttgctctgaaatcggagcctgcagacgcaaggggcttcctggacccctgagagcacagggatgcccaggtctacagccacagctgggaagctgcagctgtgggagtgcgggacttctgccccaccaactcagaagggggcaggactcccgcctgttcctggctcctgccagctcacagagcatgctgccccagctgcacctcccctgctgcagctgccatctttgcagcagccactccagatgggccgctgctgccatcaaraccactagtaaacctgatagaaaagtaagaaatatactggaaagaattgccacaagcctggctcttgtgttaacctgtgttaagctaaagaaaatcaaatgattgtctgtgagcatgtaggtatatatgtatgtgagtgagtgatacaacagaatttcattcattttacagatgttgactgagcacctgactatgtgctaggccctggggatatagcactgaacaagatttcccctgcccttgtggagcttatagtctatttggagagatagatggtcaacaaattattacataaataat

SEQ ID NO: 17636 - DNA, 601 bp, Human
ataatgaaatgactggcccataaagacattcactccccgctcctttcccaatccaccctccagaatgaagccacttttataattttgtcaccaaatccagggatgagtgccaacagttaggaagctttcagttgcaaaagataaaaagcccaactcagttgccttaaacaaagaagaaatttattctttcacgtgacaggaaggcctgaggtgtaggcatttgaaatttgtagggttggttaatttggtggctcagggatgttttcaagtagcccaacttcctactctaccatcactagtktataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggg

SEQ ID NO: 17637 - DNA, 601 bp, Human
caagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctatatatagttgtacagctctattaattttccacaatcattgaatcatstcttccagttttatgaggtaaatcatagtccaatgaagcttttttaaaaataagatgataggccatgcgtggtggctcacgtctgtaatcccagcactttgggaggccaaggtgggtggatcatgaggtcaggagttcgagaccagcctgaccaacatggtgaaaccctgtctccatcaaaaataaaaaaattagccaggcatggtggcatgcgcctgtaatcccacctactcaggaggctgagacaggaaagtcgcttgaacctgggcggcagagtctgcagtgagccgagatcatgct

SEQ ID NO: 17638 - DNA, 601 bp, Human
tatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgatttttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagac

SEQ ID NO: 17639 - DNA, 601 bp, Human
ttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcrtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgctacacagtagctcagaatttgaacaaatagccaaaagctggtggttgatgaattatgaactagttgtatcaacacaaagcaagagttggggaaagccatat

SEQ ID NO: 17640 - DNA, 601 bp, Human
tgtcatcctgttctccacccagcagttggggcaatcttttaagaaggtaaatcaaagcatatcacttctcccctcgaagccccagtagcttcctgccacggagagtgacatcgcaactcccaggtcctgcccacaaggcctgcatcctccaggccttgccagcctccccagcaccttccttctccctcattccctgaggccaccggagaagacacaggcctgctcttccccgatactgtcctacactgcgtctctcccgctcccctggtttagagccagctgaagcttcacctcctcagasaggccttccctgaccaccttatcttttttttttttttttgagacagaatcttgctctgtcgcccaggctggagtgcagtggcgccatctcagctcactgcagcctctgcctcctgggttcaagtgattcgtctgcctcagcctcccaagtagctgggattacaggcgcatgccaccacgcccggctaattttttgtatttttagtagagacagcgtttcgctgtgttagccaggatggtctcgatctcctgacctcatgatccgcccacctcagcctcccaaagtgctggggatacaggc

SEQ ID NO: 17641 - DNA, 601 bp, Human
ccatgcgcagatgaggaaacggaggaccgtttaacacgtcatctaaaatagaactcacactagtattgggaagtatctcgctaatgtattaggtactcttaaccaataaagttattctgaagtgtttaagaaagaatgaatgaacacaggctttggaactagatgtccccggatacaaatccagggtttgtgccttgcaagaggctgcacctcactccacctcagtttcctcatctgtcaaatgggactaagcaatggtagttctgctttgcaggctgctgcgaggattagaggaaatgcrtgcaggtagctctttggttcttactaatcctgagggtagaggaatgaagtaagtgtgatcatctccttgtgacagtgcacaactgaggtgtcttggtgcataaccagagcagcagtgtgacctgcccaatatcacacagtgaggctgtgcaccatgaggcacaaactctagagatctgatctgcgtcagtgacaagggagacccctcagaaatcttggaaatcagacctattcaggcccagacaggatggggcctggtccactgggtctcgagggaggactatgggctgatcagaatcta

SEQ ID NO: 17642 - DNA, 601 bp, Human
cctctggacccctcttggcccacagcattgggatctctggcctggcattcacagccacccttaggctcaggccctgctgctgagcaggctgacccagctccctccatgctcatcctgcccacatcggcccgcccaagaccaccaaattacatgccacctgctgcatgccaccagccatgggcttctttattgagcaccagattttcagtacaagttgccacagaaggagggtttcagattcaaccatgcccatgtgcaagggcgctggtccctggccagggcacataatcagagaagtgasgcggccatgccgaggtatacgtgtgtgcagaaatggacacatagggttcaggagcatcagtaactgactattgagatcatggtcttcttggaaggaataaatgtaaaaatgttgctcagccccacagagttggggtgactccacagggtgaaggcttggaggagtggcgtcttcagaggttctgccctgctcgttggttcagagaagcaaaaagatcaggcaacttgtagtacccaggatgttgtaaaaatcatagaacaccagaaccagaaaggaactccttcctatgatggcaagaag

SEQ ID NO: 17643 - DNA, 601 bp, Human
ttactaatatctatctcttctgtgtgcgagaaacgaaatcagtatcccctcctttattttaaaaggtacaatcgaaaccactaaaaggcagttaaataaaaaatccactaaaccgcagccttcttcacacatttcttctgcatcattagattaaaatatgcataattgatatgtgtattgaggtaacacctatcccaggaagtcttaataatactgaacagcaaacaattacaacgtggacttcatatggattagttcattgagtcttcataacagcttctgtggtaggtactgtacaatsacgaccctcattttaaagaaaagtaaacagagccacaggtcaggcagttagtttaaggtcacacagctggtaagtagcagagccaggatcccatacatttgggggtgtggggggaagggtctttgatggacaatttcttttctggtaacaacagaattccttgaagagtgggtgctctggttggtaaacacttcaagcatcactacagcacctacaggcttgaaagtgtatttacgcaagttccctctttcaatacaggcaacttaaacacagaactgtcccccgcccaggctgatgcaa

SEQ ID NO: 17644 - DNA, 601 bp, Human
aagctgattttttaacacattagtttatcaagtgttacaaaggagtcagtgaagagtcaaaattatttaactagttatcagaagaactcaaaaaactggctattggtgcaagctgaaggtttttttttttttcacttactaatatctatctcttctgtgtgcgagaaacgaaatcagtatcccctcctttattttaaaaggtacaatcgaaaccactaaaaggcagttaaataaaaaatccactaaaccgcagccttcttcacacatttcttctgcatcattagattaaaatatgcataaytgatatgtgtattgaggtaacacctatcccaggaagtcttaataatactgaacagcaaacaattacaacgtggacttcatatggattagttcattgagtcttcataacagcttctgtggtaggtactgtacaatcacgaccctcattttaaagaaaagtaaacagagccacaggtcaggcagttagtttaaggtcacacagctggtaagtagcagagccaggatcccatacatttgggggtgtggggggaagggtctttgatggacaatttcttttctggtaacaacagaattccttgaa

SEQ ID NO: 17645 - DNA, 601 bp, Human
gaaggcttcaggtcaggcaaaccacagcatttgtggacagcagataaatgattgtttataaggtcagagacatagttttttagcttggcattctcccagttctaagggactacctatctctccatgtgatatttctattactctgatttttttttttcagttgagagggaaactgtgtttagaaaggtcaagtataataagctaggggttttgatctgtgtcaaaactcatgcattctttcatcttgctctcagaagaccacaactctaaatgtaactcaacataataaataggacctgamcggtgttcttacccatccatgatcatggcatctagtgtggtttctccaagttcatcaggacttcctccaaagcctacagagccgtcacactgctctctctcacacatggcacagccgctctccactgcatccagggcagagcctccagatgctaatgccctccacgctgttaatcaaatcccaataatgcttgtttatatatatatatttttttcaatgccaaatgcaacaaaccaactccaatttaacaactttttcacatttactgagttaagctgattttttaacacattagtttat

SEQ ID NO: 17646 - DNA, 601 bp, Human
cagttaggaattaaggagttttcagaggttcatagattaaaaacattgcttttctccaatcaatagtgttttgcggttaaactccaccatcttaacacagaagtgacagcacatccacgaagttcatatagattcccacaatcagacaaaattaaggaaaaaaatagaaaatcaacttgccatgtaccacaacagcactaaaattctcagtttctccaagctaattttaaatatggcttttgaaaggggcctgaaggcttcaggtcaggcaaaccacagcatttgtggacagcagataaaygattgtttataaggtcagagacatagttttttagcttggcattctcccagttctaagggactacctatctctccatgtgatatttctattactctgatttttttttttcagttgagagggaaactgtgtttagaaaggtcaagtataataagctaggggttttgatctgtgtcaaaactcatgcattctttcatcttgctctcagaagaccacaactctaaatgtaactcaacataataaataggacctgaacggtgttcttacccatccatgatcatggcatctagtgtggtttctcca

SEQ ID NO: 17647 - DNA, 601 bp, Human
gtgtgtgttgtatgttccagtactttccgtgccacaccaatagcatttttaattcgtctgagatctcctactgctcctacatccatagtagtgctgcaagaaaatagaatgcagttaggaattaaggagttttcagaggttcatagattaaaaacattgcttttctccaatcaatagtgttttgcggttaaactccaccatcttaacacagaagtgacagcacatccacgaagttcatatagattcccacaatcagacaaaattaaggaaaaaaatagaaaatcaacttgccatgtaccamaacagcactaaaattctcagtttctccaagctaattttaaatatggcttttgaaaggggcctgaaggcttcaggtcaggcaaaccacagcatttgtggacagcagataaatgattgtttataaggtcagagacatagttttttagcttggcattctcccagttctaagggactacctatctctccatgtgatatttctattactctgatttttttttttcagttgagagggaaactgtgtttagaaaggtcaagtataataagctaggggttttgatctgtgtcaaaactcatgcattct

SEQ ID NO: 17648 - DNA, 601 bp, Human
gtcccggccaggcgcggtggctcacacctgtaatcccagcactttgggaggctgaggcgggtggatcacgaagtcaagagattgagaccatcctggccaacatggtgaaaccccgtctctactaaaaatataaaaattagctgggcatggtggcacgtgcctgtaatcccagctacttggaaggctgaggtaggagaatcacttgaacccaggaggcagaggttgtagggagctgagatcgcgccattgcactccagcctgggtgacaagagcgaaactccgtctcaaaacttccattgcyttcttcttagagatgaagaagtaaagagatttaaaagttacttatccagttcaatagatgttaagtaaaacagctggaatttgaacttagatctggttttatccatgattttgtactatttttcagtgaaaactatagtcaaaagactagaaaaaatttcagtgtagttaaaaaaatacctgactctcctactaaaagtgtgtgtgttgtatgttccagtactttccgtgccacaccaatagcatttttaattcgtctgagatctcctactgctcctacatccatagtagtgctgcaaga

SEQ ID NO: 17649 - DNA, 601 bp, Human
agataagtcttcattgataaaccccatactttgagcaaatgtggtggctggagattggaaaaaaggaaagtataaattattcaagtattgtcttttcaacaaaaatatatgtactagagacattctgggtcagcagcatcttaagtgagctacacaaagactttcaaaggaatattcacacatgaacagttttaagagactcaatttttagaccttcgatttccttatgcccttcctaaaacagatccacttaaaacctttggggcatgcattataagagttctcgtcccggccaggcgcrgtggctcacacctgtaatcccagcactttgggaggctgaggcgggtggatcacgaagtcaagagattgagaccatcctggccaacatggtgaaaccccgtctctactaaaaatataaaaattagctgggcatggtggcacgtgcctgtaatcccagctacttggaaggctgaggtaggagaatcacttgaacccaggaggcagaggttgtagggagctgagatcgcgccattgcactccagcctgggtgacaagagcgaaactccgtctcaaaacttccattgccttcttcttagagatg

SEQ ID NO: 17650 - DNA, 601 bp, Human
gtacggcaaaggcaaactgatttatgccaaaagtctcattaaagaaaaattattccactggtaacatactagacatgtaatattacatgtcctcaagtcaagaacaagatactggatacactgcacgtaaaatctaagaaatattttagactcatagtttccaaactgattttttagacttagttagaaagaaatacaagcagagcagccctgattgaggcagccacctccacatggcagaaacttcagtttgaaaactactgtgagagaccagtagctctccatgctggatatgcacccratgcagctagaggtgtttcaggaacatccatacctggagagtcaactaaaaccactagttctaatgtacagccaggatgctaaccagtaccctggacaacaggcaggcaacactgagcagaaaggatgtcactgaatattttcaattaacttatttttttaaattaaatgtgtgcataccctccaataatttggctggcaattccgagcaagccaatctgaatgaagagcttgagaagcactggtagataagtcttcattgataaaccccatactttgagcaaatgtggtggctggagat

SEQ ID NO: 17651 - DNA, 601 bp, Human
gaaatagatgagagactaagatatcccacagaaggaccctgtacggcaaaggcaaactgatttatgccaaaagtctcattaaagaaaaattattccactggtaacatactagacatgtaatattacatgtcctcaagtcaagaacaagatactggatacactgcacgtaaaatctaagaaatattttagactcatagtttccaaactgattttttagacttagttagaaagaaatacaagcagagcagccctgattgaggcagccacctccacatggcagaaacttcagtttgaaaactaytgtgagagaccagtagctctccatgctggatatgcacccaatgcagctagaggtgtttcaggaacatccatacctggagagtcaactaaaaccactagttctaatgtacagccaggatgctaaccagtaccctggacaacaggcaggcaacactgagcagaaaggatgtcactgaatattttcaattaacttatttttttaaattaaatgtgtgcataccctccaataatttggctggcaattccgagcaagccaatctgaatgaagagcttgagaagcactggtagataagtcttcatt

SEQ ID NO: 17652 - DNA, 601 bp, Human
tccctctcctgtggcactcagcagagagtactgcattttctttcacactcattcatcgcagctgtgagactagggctgtgctttgcaacccccatagcacccggcatatattgctctgcattcagtgtatatttgagagctctgttcttttggaaacactaacccatgtattttgaattttataccatttgtagatgtaccagcagcaatatgtcctgtcttatggattacaaccatgcctagaagttaaaaaaaaaaaatcactgtaggtgtataaagtttacctcaaatataaccaaataattgagcaactggtaataactgctgtgctctgaatgtttgtgttcccccaaattcatgtcaacatcctattccacaaggtgatggtatcaagaggtgaggcctttgggagctcattaggtcatgaggacagagcccccatgaatggaattcatcccttataaatgaggccccagagagcttcctcgccccttccaccacgtgacgacacagcaagaagacgccatccatgagccaggaaaacaagctgtctccaaactctgaacctgccagcgccttgaccttgaacttcccagcctcc

SEQ ID NO: 17653 - DNA, 601 bp, Human
actccctctcctgtggcactcagcagagagtactgcattttctttcacactcattcatcgcagctgtgagactagggctgtgctttgcaacccccatagcacccggcatatattgctctgcattcagtgtatatttgagagctctgttcttttggaaacactaacccatgtattttgaattttataccatttgtagatgtaccagcagcaatatgtcctgtcttatggattacaaccatgcctagaagttaaaaaaaaaaaatcactgtaggtgtataaagtttacctcaaatataaccatataattgagcaactggtaataactgctgtgctctgaatgtttgtgttcccccaaattcatgtcaacatcctattccacaaggtgatggtatcaagaggtgaggcctttgggagctcattaggtcatgaggacagagcccccatgaatggaattcatcccttataaatgaggccccagagagcttcctcgccccttccaccacgtgacgacacagcaagaagacgccatccatgagccaggaaaacaagctgtctccaaactctgaacctgccagcgccttgaccttgaacttcccagcct

SEQ ID NO: 17654 - DNA, 601 bp, Human
gactccctctcctgtggcactcagcagagagtactgcattttctttcacactcattcatcgcagctgtgagactagggctgtgctttgcaacccccatagcacccggcatatattgctctgcattcagtgtatatttgagagctctgttcttttggaaacactaacccatgtattttgaattttataccatttgtagatgtaccagcagcaatatgtcctgtcttatggattacaaccatgcctagaagttaaaaaaaaaaaatcactgtaggtgtataaagtttacctcaaatataaccaaataattgagcaactggtaataactgctgtgctctgaatgtttgtgttcccccaaattcatgtcaacatcctattccacaaggtgatggtatcaagaggtgaggcctttgggagctcattaggtcatgaggacagagcccccatgaatggaattcatcccttataaatgaggccccagagagcttcctcgccccttccaccacgtgacgacacagcaagaagacgccatccatgagccaggaaaacaagctgtctccaaactctgaacctgccagcgccttgaccttgaacttcccagcc

SEQ ID NO: 17655 - DNA, 601 bp, Human
tttttttctagtaagaaatgtttaatgcttttctatttcaaaattaaatccagaatgccttcaactgacttaagactccttaaatctggccccagtcttcccttgtagtcttatcttccaataccacttcccctaccccaaaatacacacacacccccacaccccttcttccctagccagtgggagccctgaatacacacacacacacccacaccagtgggagccctgagcgtgcacgcacacgcacacatacacacacacaccccttctttccaagccagtagttctgcgtgcacgcgcrcacacacacacacaccccttctttccaagccagtgggagttctgaacacatgcacacatacacacaccccagtgggagccctgaacacacacacacatatacacacacaactttcctagccagtaggagcgctgaacctcaactaccatgactcagggctgagctccaagcatcactttactggtgttcctaactaccccagcttaaagagatcacctctgccacccctaaaccctatagcactggctgtgactccctctcctgtggcactcagcagagagtactgcattttctttcaca

SEQ ID NO: 17656 - DNA, 601 bp, Human
ctccctgcctcagcctcctgagtagctgggactacagacacgaaccaccaagctcagctaattttttgtatttttttttttttcagtagagactgggtttcaccatgttggccaggctggtctcgaactcctgacctcaggtgatctgcctgccttggcctcccaaagagctgggattacaggcgtgagccactgcacccagctgaaaactgctaagtagattttaagtgttctcaccataataaaataggtctgtgagataataagttaaatagcttgatttagccattctacaacatayacatatatcaaagtatcatgttgtacaccacaaatacacataattttcattgtcattaaaattaattttttaaaagaacttgttatcagccaggtatataccaggatggcacagatttacagtgactattctattattaccatcctttatcatctaatttccagatgattgcaacatgttcaaaattggtttccctcatctataatctatttccgcttcctatgtaatgtgccaaacttttaccagatttttttctagtaagaaatgtttaatgcttttctatttcaaaattaaatccag

SEQ ID NO: 17657 - DNA, 601 bp, Human
ttcttcatcggaacaaagacagaacaggtcttcattagttttttaactaaggttttcacaaacctgcattaattatgtaagaatttgttatcagacgtggagtgtacaacagctgaactcatagaaacagagactaaaatggtggttactggaggctggggggagggggacctggcgagatgcgggtcaaaggacacacaattccagttaggcaggagggtaagttccagaggcctactgcggatcatgctgactaaggttaataacaatagagtgcacatttgaaaactgcgaagtagattttttttttttgagacaggagtcttgctctgtcacccagctggagtgcaatggcattgatcttggctcactgcaacctccgcctcctgggttcaagcgattctccctgcctcagcctcctgagtagctgggactacagacacgaaccaccaagctcagctaattttttgtatttttttttttttcagtagagactgggtttcaccatgttggccaggctggtctcgaactcctgacctcaggtgatctgcctgccttggcctcccaaagagctgggattacaggcgtgagccactgcacc

SEQ ID NO: 17658 - DNA, 601 bp, Human
ccgtaacttccagtcacattggcacatataacagccccaaagaattctggaaaatgcttctggattcttgaaatcactttttggcaagctatggttggatcttctcctcttctcatgtattctacagcttggtagctgattgaaacagaggtgaaaccttagtgtctcagaataaatactaactccaaattgggttacttgaagttagaaattaaaaccaccaaaattgccacatgtgatagaatacacataaatgaacaagagtcggttacttctgttaaagcatccacaaagcaagtcmactttgatacagtgtctatcttttcaactaatccacccatgaatttcagatgtggaatattatttttggctttggctgaataactgtcagtaatgataccgacagtcaaatgtaatggccagaactcaaaaagaatacagattttcaatgagaaaaacagctacaatcaaaggggaaagtagtgtgcatgggcacaacatctagctagggtggttaaaggtacacgatgactgcacttcctacttttaccatcaattatcacagctcctttactcagtagctttacatcaattactaaat

SEQ ID NO: 17659 - DNA, 601 bp, Human
ttcattctgttaaatccaactttgagctttctaataaggtttatttcttaagagggaatcaatagaactgccttatttgatacataaagcttttccccttcataatttttattgacttttgtgtcttagtgcttaaaaaagaataaagcattcctcaaacaagtttttcaaatatagaactgtgggaagtaaaagatcaaagaacaataataagcagtccaacctaataagtcatattgatcagtaagctgtgtatcttccccatctgaaaattcactaatgagaatcagcagtggctgaycttaaaatgctttgaaactgtgataggctcatatggaaagtaaatgaagtgaaagacaagcctcaaacagtgcaaaaataattctgctaacctcttcggtttactaattagtaatacattttgttctttggagccccgagaagatctaaatggctgaggcatttaaataatgaatagaaaagaaatagggaagataatttatccttgtctatttttaattagtataaacatttgactagattagcctatgtcaacgtgtactggagctgaagctaaacttcatttaagacacatgtgaaa

SEQ ID NO: 17660 - DNA, 601 bp, Human
cagaaaactggctggtttttgttgttgttgttgatctatacacatgctgtcactgctacgattatttaactgttcttacgtgtttttcttagaaaaaactattcaggcacatctcccacattttatttctctagccactagaacattctcatcattcattcataaccccataccccaccattgctccctattcttctactctcacaggaagagtcaagagtaatttgtcaagatgctttgtctaatcaagttcatcttctcatgctcaaacacctgggggagggtcctctttggtcattamatagaagaaactagtcacctgtaaattcatccacaattatataattatcatttttttcattctgttaaatccaactttgagctttctaataaggtttatttcttaagagggaatcaatagaactgccttatttgatacataaagcttttccccttcataatttttattgacttttgtgtcttagtgcttaaaaaagaataaagcattcctcaaacaagtttttcaaatatagaactgtgggaagtaaaagatcaaagaacaataataagcagtccaacctaataagtcatattgatcagt

SEQ ID NO: 17661 - DNA, 601 bp, Human
tttattttacaaaaagactttagaacacatgaggaacactagatgatgagagtgagcagccttttcagcctttgtttctttcttctttaaatacagatgttgacagtaaagatggattagatgcagtccactttttcctcagttggctgatttttttcggaattataaaccatgaaactaaactgagtaaatgttgaaagtttattgcaagcagcacctggggccaaaaatgagaaagaagtttggtgaactataggatgcacatatttataaccaatacagatactgcttatttgactasacactggctactgtataccttatgtctaagccacatggaaatacactagtgtcatcctcctcagaactgagcagtgaacagtccatgaaaggaatgaggtagctggtaaactatctctttgaacttcagaaaactggctggtttttgttgttgttgttgatctatacacatgctgtcactgctacgattatttaactgttcttacgtgtttttcttagaaaaaactattcaggcacatctcccacattttatttctctagccactagaacattctcatcattcattcataaccccatacc

SEQ ID NO: 17662 - DNA, 601 bp, Human
atgttctatcatcttccttcctcaagtttttagggaatattaagtaaaaccaataatcagtgctaagacatgcatcactgtgacataatgaaattcaatcaggactgatcatgctgagactctgctgtttttttctttgggtctaaaaaacttgtatactctattttaagcatccaaatatgatgattccttttgggtttaatatatcactgtggaaataaatctcaaagtagcaattttttgcaacactgatcagaaatccaagtgtcacttaaaacttaaatatatacaaaatacagcsacatacatattcatcttcagataatataagaaaggttaaataaaaatagataatacaatttcagatatagaaagtgccaattcaacataaatttatttttgtgtttattttacaaaaagactttagaacacatgaggaacactagatgatgagagtgagcagccttttcagcctttgtttctttcttctttaaatacagatgttgacagtaaagatggattagatgcagtccactttttcctcagttggctgatttttttcggaattataaaccatgaaactaaactgagtaaatgttga

SEQ ID NO: 17663 - DNA, 601 bp, Human
gtttcattttatttttaattgctggctgcatcttgtttgataaataagatgcatgtcaggtaaaaaatgaaacttattttgcaatctatagatgtatcaatttcatgactctgggattttgaagttgagtcactggtatttataatctactgaaatggagtgaaatacgttactgtggatgcctggcgtcgccccatgccaaacgcctcctcatgaaacagaatgctgttccagatcgttagcgaggagaggaaatcagtttggggctgaacaaggaagacttgctggagaaggagaaatraaagaaatctggattcttctctacaaccttcagtaacaacatggtcactagtatttattgattccttactacaggaatcagtaatcaattaatatatccaataatcaataaatgcatccaataagtagtaaatgcatccatccaataaatacatccaggcatttgatgtatgccatctcacttacttttcataccaaccctgcaactaagtattattatctccattttacagacaaagaagctgaggcttcacagtggccaagtaactcgtcccaggtcacagagcgtgaagtatgtctg

SEQ ID NO: 17664 - DNA, 601 bp, Human
ctcactgagatggaagggagcagcctggggcctagccgtgtggccccccagccgctgctgaccccgcttccccgggtcagggaggcagccccatgaggccgccctgggggctgggaagcagctcagttctgtttcttgtactctgcctggtaattcaagcataaagcctggggctgggtgcagcagctcacattggtaatcctggcactttgggaggccaaggcgggaggattgcttgagtccaggagttcaagaccagcctgggaaacagtgagacccagtctgtctgtcttttctttcttttttttttttttttaaaggcataaagcctgtttatgttttgttttgtttaaaggcaggcacttcccatctgttgcctcctgaagttgtctttttgatttctcctcaagttctatttgatgaagaaaaaggtttttcctcaggtatccattggagaataaatgccagatatgaaagtctggaagctcattaataatttttcatagaagtccaaagagcctccattgagaggcttggcacctgctgtaccaaatggagcagcactgctggcaccagaaacttttctagacaccaggacgct

SEQ ID NO: 17665 - DNA, 601 bp, Human
catgcttctgtcaaatagggcgagtggagaaaataggtccatggtcggacccatctgtccctgcactacttaaggagcagagatctcaaacaacctcatttttagagtttagacagtatgtagttctttttactaaactacataatcattaactaatccatttcaagaaacttaagaactgacaagcagggactttggactctgaccttgcccagtggctcctgtcacctggaggaaaagcttcctcactgagatggaagggagcagcctggggcctagccgtgtggccccccagccgctrctgaccccgcttccccgggtcagggaggcagccccatgaggccgccctgggggctgggaagcagctcagttctgtttcttgtactctgcctggtaattcaagcataaagcctggggctgggtgcagcagctcacattggtaatcctggcactttgggaggccaaggcgggaggattgcttgagtccaggagttcaagaccagcctgggaaacagtgagacccagtctgtctgtcttttctttcttttttttttttttttaaaggcataaagcctgtttatgttttgttttgtttaaaggc

SEQ ID NO: 17666 - DNA, 601 bp, Human
ccatcccagggatacccacagaccacaagctgcagtggagcggacaaagagatgggaggcaggagagtgaggaaagcattatacagaaaaggaaagggtaagatcaactctatgatgtatgtagggaagagaagaaaaatcagaaaataaatggggggtaataaatggaatacaatctggccaagaaaaatacaaagaatatgcaacatactagtaagcaaaatgtaatgagtaagggttcaccaaatccaagaggagagaaaaactggagagaataaacactggaggaaaaccaggcacktaattgttttaaactttgtaaaagataagaaccaatagcagagactgagaaataaggcaggttctgagaaagtgagtttttgttttgttttattttgtttttagaattggaggtctcgctctaacacccaggcaggagcacagtggcaccatcataactcactgcagcctccaactcctgggctcaagcgatcctcccacctcagcctcccaagtaggtggggactaaggcgtgtgccaccgtgcccagccaatttttaaatttttttgtagagatgggctctcactttgttgtccaggc

SEQ ID NO: 17667 - DNA, 601 bp, Human
ctcataccccctcaatctataaaaagaaaaacatttaaaaagaagaccaccagcactggctggtgtgattggagtggcgcaggaagggggcaggtgacactgagatgtgcggttgaaggagagtgcggccatgtcaaaggaactcctttttttctattatgtatccataataattaaaaataaaaaatttttataaaagaaaaataatactgaaagaaaaaaacaccccccgccaacacacaacttctgaacatctaatctgctgtgtgcgtgcagcgtcctgtccccagcagacagcgcrttggcgtccctcaggacacacactggaaggcttgtcagcgagctggccttccgcggacctgcagctccgctcagcctgcaattctgcaaggcaacaagccctctgagaggcctgggagcgccaggaaaggaggccagcaggtccctcaggcccatacctttgacgccatcccagggatacccacagaccacaagctgcagtggagcggacaaagagatgggaggcaggagagtgaggaaagcattatacagaaaaggaaagggtaagatcaactctatgatgtatgtagggaagagaaga

SEQ ID NO: 17668 - DNA, 601 bp, Human
caccactgctcagagacatgctcctgagaaatctaggccctgccccacagtagtgtgtgtgttaacacggctgccaatggacccacgagggagcagcaaagaggaaccacctgtggaaaggcaacaccctctagtccagaccagagagccattacctgtgactgggcgttgacgttggctccatagttgacaagctcccggaccacctcatcctgcccggctagagcagcgatgtgcagggccgtgttccccttctgaaacacatgggggaagggaacagaggcggtttcccactgggccygctacgggaccagcaaaggtctgtggacaggtgctgcttgagggacccgggggctttcttcatggccaaaaggggtagaaaggacacacgtgtgtgcttgacccattgcacatcctgaaatcatactgaaagtacagggaggaagatccagcctgttctctatgacaaacaatgctgcaagagccataaaaaagaaggaaatcaggtcttccgtagcaactcagctggaactggaggccagtaacttacatgaagcaactcagaagcagaaagtcaaatactgcatgttctcactcgtaa

SEQ ID NO: 17669 - DNA, 601 bp, Human
ttcccccagtcctcagtttctctctccacctaggctacaactggacatactatttggcttaggtccaaaacaattcaaccccgtcatgcttaggacacgcggtctatgcatgcgaaataataaaggacaccttcaccactgctcagagacatgctcctgagaaatctaggccctgccccacagtagtgtgtgtgttaacacggctgccaatggacccacgagggagcagcaaagaggaaccacctgtggaaaggcaacaccctctagtccagaccagagagccattacctgtgactgggcrttgacgttggctccatagttgacaagctcccggaccacctcatcctgcccggctagagcagcgatgtgcagggccgtgttccccttctgaaacacatgggggaagggaacagaggcggtttcccactgggcccgctacgggaccagcaaaggtctgtggacaggtgctgcttgagggacccgggggctttcttcatggccaaaaggggtagaaaggacacacgtgtgtgcttgacccattgcacatcctgaaatcatactgaaagtacagggaggaagatccagcctgttctctatgaca

SEQ ID NO: 17670 - DNA, 601 bp, Human
tctgtcactcaggttggagtatggtggtgcaatcatggctcactgcagccttaacctcttgggctcaagtgatcctcccacttcagcttcccaagtagctaagaataaggcacacaccaccacacccagctaattttctttttctgtagagacggggtcttgctgtgttgcccaggctggtcttgaattcctggcctcaagtgatcctcccacctcagcctcccaaagcggttggattataggcatgagccactgcgcttggccatgagctactattattaattccctcagttgtggacayactaaagggcacaggaccgcaggaactgataaaacggaatgacaacaaagtcatgtcattgagccatccaaagttaagagtcaagagactccttggctctatctagtccaatttcatcatttcaccaatgacaagactcaggaccatagctaatgagacttgtccaagggtgcatggtggttttgtggcaagagcctttctcattaaggcccaatgcaaacttgccaaccatacacatgcatgcttcgcctgccccctccagtcacaagtattggccacagcgggaaggacaccctcaag

SEQ ID NO: 17671 - DNA, 601 bp, Human
ggttccagggtgacccgccctgcccgcctggacacatttccagatgacctggagcaacaggaaccacccccgctgctcaccaagagcacgtttctgggcatctgccagggatttagagcggggctgtccaggggcccctctgcgtcctggggtgagggcgctcagtgcgcactgcccgccctgcacgctcggttctcctgcctgggaagtcgctgggcgtgcgcggtgccccctgagcccacgggcgtccgcggcccaaggctcctccctcctcctcgccctcaccttggaaagcacgtcygggttggggtcgttctgcagcagcaccgcagccgtgcgcgtgtcgtcgttgcgggccgcgatgtgcagggccgggaggcgcaccttccccttggtgccgtagttgatgaggtgcgcgacgacgttctcatggccctgctgcagggctaccgccagaggcgtgaagccgtcctggccagaggaggaaaatgctttgctctgactcgtctgacgccagccgcccttcacacgggacacacccttgcccctcgggcttatgctcccagcagccccagcctgagggacctacctccaccaaagc

SEQ ID NO: 17672 - DNA, 601 bp, Human
gtcagggcgcgtcatccttccctggaatgcagctgctgtgcacccgctccccttgtccccagcccccagtccccaggcctgcaacagcgttgtcagggcatttctggcctaagatattttatttttttttattttttatttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctaagacattttaaaacctgaaaggacctgccaacaggatgggtcatcccaccacaccacccaagcccatgcctcccagagtcaacataacagactgcaggaaagtcagttatatggaaatcactctctgccctccaggtttcccatttttaggatgggcaaatggagt

SEQ ID NO: 17673 - DNA, 601 bp, Human
agggaggaagcaggacggtcagggcgcgtcatccttccctggaatgcagctgctgtgcacccgctccccttgtccccagcccccagtccccaggcctgcaacagcgttgtcagggcatttctggcctaagatattttatttttttttattttttatttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgmgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctaagacattttaaaacctgaaaggacctgccaacaggatgggtcatcccaccacaccacccaagcccatgcctcccagagtcaacataacagactgcaggaaagtcagttatatggaaatcactctctgccctccaggtttcccattttta

SEQ ID NO: 17674 - DNA, 601 bp, Human
ccctccccctgcctggctacagcacctgctggcacccaccttggtcttggtttctatctgggctccccgatccagcagcagccgcaccatgatcacgttgcccctgcgggaggcgatgtgcagtggcgtgatgccgttctgaagggaggaagcaggacggtcagggcgcgtcatccttccctggaatgcagctgctgtgcacccgctccccttgtccccagcccccagtccccaggcctgcaacagcgttgtcagggcatttctggcctaagatattttatttttttttattttttatttwtttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctaagacatt

SEQ ID NO: 17675 - DNA, 601 bp, Human
ctgggtgaggcttgtgaggggggacctccctccccctgcctggctacagcacctgctggcacccaccttggtcttggtttctatctgggctccccgatccagcagcagccgcaccatgatcacgttgcccctgcgggaggcgatgtgcagtggcgtgatgccgttctgaagggaggaagcaggacggtcagggcgcgtcatccttccctggaatgcagctgctgtgcacccgctccccttgtccccagcccccagtccccaggcctgcaacagcgttgtcagggcatttctggcctaagayattttatttttttttattttttatttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgt

SEQ ID NO: 17676 - DNA, 601 bp, Human
atttaactgatagtagcaattctactttcatttagctgaggagttttacttttagatagcttttgaagacattatctcacatggtcatcccaataatcctaggagagagggtgggggctctccagatgaggaaactgaaacacagagagggcaagacacacgttcatagtcacacggcaaatcagccaaggatggagggctaaatgagaaactgctttagtagaggacaccctcatgcaacagcacacacagacacacccaagaaccagtgtggggactatgaatcatgacccaaattaaygacagctctacagaacagaacatgataatgtgtcgggaataaatcagctttcactgtatggtctaagccatcattttatgacagaactgctcgtgggaaacctcctgggtagctgtgagtgggcctggcttttgccttgctctgctctgacacagctcaattcacggggcagagggcccagagcaggcacaggcagcagtgtggctgacagctttcaccccttgaagactcgagtccttatgtcagagccacgtaacgggccttttctctggcccgtaatggaacctgagaagaactgtg

SEQ ID NO: 17677 - DNA, 601 bp, Human
tgtagctcacccctgtaattcccgcactttgggaagcaaaggtgggcagatcacttgaggccaggagttcgagaccagcctggctaacatggtgaatccccatctctactaaaaatacaaaaataggccaggcgtggtggcatttgcctgcaatcccagctactcgggaagctgaggcacgagaatcgattgaacctgtgaggcggaggttgcagtgagtagagatcacactgctgcactccagcctgggtgactgagtgagacttcatctcaaaaaaaaaaaaaaaaaaaaaaaaaaaargaaccaaccctgctgacaccttgatcttgaccctccagcttctggaagtgtgagacagtaagtttctgttgtttaagccactcagcatgtggttctttgttaaggtggactgagctaactcagttagttacacttgcatttcagaaaggttgtacgatagttcccaattgaaaagtcacatattctcagtaaggaattttcataagcattcttttcagccccattctaatgatctggataataaaacaaaaaatcttaacttctggccatgtattatgtttaaatacagcactcctggaa

SEQ ID NO: 17678 - DNA, 601 bp, Human
tgcgccaagaaaggctaggagctcaggacctgggacttcagcttttagaaagtggaaatgagaggattttcatcaaggaagatgcaaatcaggttccatgacagcagatgttagtgttacaggctgaattaggtcccacaaaattcacatgctgcagtcttaacccccaggacctcagaatgtgaccttgtttggaaacaggatcttcggggatataataagctaaaatgaggtcattagtgtgagttctaatctatgactggcgtccttagaaacagggagatttgggcacctgcacagsaggaaaatgtcacatgaagatgaaggcagaggtcagcatgatgccctataagccaaggaaaccaaagattgtgcccaaaccaccagaagctcggggagagacctggaaaagatgttccctcacagcctcagaaggaatcaaccctgccaggcactgtagctcacccctgtaattcccgcactttgggaagcaaaggtgggcagatcacttgaggccaggagttcgagaccagcctggctaacatggtgaatccccatctctactaaaaatacaaaaataggccaggcgtggtggcatttg

SEQ ID NO: 17679 - DNA, 601 bp, Human
agattcaggacgattccaacgtcactccctacttcttccctacacaatgtttccacaagtctctggagggagcttggctcaccctggcctccacgctcctgccggtctctgaccacagacattctcctttccacctggccaaaccttcaaagccatgtccagcagacccacctcttccagaaagccttccctgaccactctagactcctgtgggctttccttatctgcaccatgcgctcagaccttattctcatatttgcccaattatatccatagctaactttttaggggagtgtatctyttctctttacttatacgcctcttaagatcagtgacttagcctaatatttctccttaaatgccccacagtgccaaatacatgcatgtaacacacatcatggtccctaaattatgtgattttgaatgaatgaatgaatgaatgaattatgataaaatagaacttggatctaaatccctctgttccttgtccctatcaaatgcagttcagttaaagaaaattctgttaaggatactcatttctcaaacagcaatttgtttaaaaaacataaaagagagaggagactcattcattcacttagac

SEQ ID NO: 17680 - DNA, 601 bp, Human
gagcttccctttacacgagtgccatgagaactacaagcccctctgtggacgaaggatgctcagctctggccatctcattcatccccaaagcagctcagaaagccacgcagcctctaaggaatcactcagctccaggcctggctccactggagagatgccccaagcccgcatacctaccatgcaggatgcttcctgagtccggtctcctgggcccaaactcatccctgacctcggcctggtcaccggggcaggggtcgatacccaggtgggtgtgcagtggagggtgcaggaggggtgcacrccaggcccccaccatccagtgctgtcacaccccactgctcaggcctcgaatctggggagctccgggcacctgccgcccttcccacaggcccagccatgcctctctgctcctgcccccagcctgccctgccactctgcaccttctccagcagcacccccactcaccagggctctggagttgggtttggcccctttatccagaaggaccttagccaccctgtggtgtccacagtgggcagccacgtggagtggggtcaggtggtccagggtgatgtcgtctatctctgcgtcgtattgcaac

SEQ ID NO: 17681 - DNA, 601 bp, Human
gcccctcagttctgctgccttgggaagaggcagagaggagatgtggttacaggcatgcttagtgcaaagctacagccctgctggatccccagactccctgggagcccctgtcctgggaaggaggcagaggaaccacaggagggatttgctctgggcctgagcttccctttacacgagtgccatgagaactacaagcccctctgtggacgaaggatgctcagctctggccatctcattcatccccaaagcagctcagaaagccacgcagcctctaaggaatcactcagctccaggcctggcwccactggagagatgccccaagcccgcatacctaccatgcaggatgcttcctgagtccggtctcctgggcccaaactcatccctgacctcggcctggtcaccggggcaggggtcgatacccaggtgggtgtgcagtggagggtgcaggaggggtgcacaccaggcccccaccatccagtgctgtcacaccccactgctcaggcctcgaatctggggagctccgggcacctgccgcccttcccacaggcccagccatgcctctctgctcctgcccccagcctgccctgccactctgcacctt

SEQ ID NO: 17682 - DNA, 601 bp, Human
gatcattctcattttaaagaggtctcttgtttccaggttccagcaagctcgccagcagccctgaggatttctcaaagtacggtcgctgtggccccagccttggaaccatgcagagagtaggttaaaaatgaggcttccaggccacactgcacagtcccacggagtcagaatctagcaatgctagaaacgggctcaccactccccagggatttttatccacactgacctctgacagtcagtttacaaaacccagctgacgtgcaactgcttggggacacatttgttgtataaaacaagttcygcctctgcgaggtaacccctggctgggaattgttacccacttcccatcccactcctgggccctgaatagcgtgattacagggcaggtaacatgtgggaaagtgaggcgtgatttctgaggtaaaaatagcaacagaacgcaaaacccttgggctgctgtggaaacccccctccctgagggactggaaggtagcaggtgacctgctctccaggggcagctggggagaggggcgggccttacccaggcagggctgtgcggggagccgccccggggaagcagcagcttgacgatgtccaggtt

SEQ ID NO: 17683 - DNA, 601 bp, Human
ggaaatgagaaatgtggtccaggcaggcagacccggatctcccctggcttgtacctaacatacctcaggggcagaggtatacagtcaagagttcgagcttagcctggcaatagtttctaatgtgaatcttcctcaacaattttttttttttgagatggagtttcgctcttgttgcccaggctggagtgcagtggcgcgatcttggctcactacaacctccgcctcccgggttcaagcaattctcctgcctcagcctcccgagtagctgggactacagatgcgtgctgccacgctcagctattttttttgtatttttagtagggacagggtttcaccatgttggtcaggctggtcacgaactcctgacctcaggtgatcctcctgcctcagtctcccaaagtactgggattacaggtgtgagccaccgcacccggccatcttcttcaacttttggatgagaagttgagtgtggataagagggagagggggtgtggatataaggctgtgaatgaggggagcctgggagaggatgggagcctgggtgggagaggaggggagcctggaagaggagcagagaggcgtccaggcagcacggtgtgag

SEQ ID NO: 17684 - DNA, 601 bp, Human
agcactcccccgctctccctcctggttctgtgctaactgggttcatgcgtccgagtccactctttctggttgggccccggctcccaggaggcaggtgtccagccctcctgcctgagcctgtccggggtgcacagcaggaatccagtaaacatctgctggctggagttcctaccctaggccaagagttgaagacagtgggctggtcaaggacccactggtttctcactgctgctgtcctgggctgcatccaaggactgcgccaccacaggaaagggccccatctgaccatctctcccagacrccgcccacccagcgccaccaatgttgcaccattatgaggcgtccaagcgtggaatgccagttggacagtgagtggcatgtgagctattagtgcctattgcgctacgtacaggccacccctcaacaatcactgtcccagggttttcatgccctccatgtggggaaaccacagagaaggagcttctcacctgctcctgctcttctgacctgatcaccactgtctcaggcatggcacagggaatcctggggatggctggagattccaccctgcgtgccaagaacaccagaacatcacagggct

SEQ ID NO: 17685 - DNA, 601 bp, Human
gaactcctggcctcaagcgatgctctcacctcagcctcccaaagcactgagattacaggcgtgagctatcgtgcccgacctgagatctgagagttgtaagccctctcagggctatggacaccttcgtgtgtcaggaaaagtcagggaaaggggaggggcacccagttctgtttccccatcaggacagatggaaatggcgtggcctccgtggcacagggacaggggagaacacgggctgcccgcgcaagctcacctcaggaactgtgcccccgtgggccccagtgctatgatcctgctggcsaggccctcctcctcggccagtgggggcggcgtgctgagcttctggggcttgaccaggcggcaggtgatgcgggtgggcgctgcgcacgtccgtggcgggatcaccactcgcaggccgttgtggcgacttcctctcatggaaccaccccgggcgtcaaccatgaagctcaccagaaacctaggagtggggcagatgcacgttgggcttctgcatcccctctcggagatggagacaggagtccccgagccctgcgcccgccactcaccctgtatgcaccgggctggccaccgggctgatgtt

SEQ ID NO: 17686 - DNA, 601 bp, Human
ctagtgtcacacaatatttaagagttgtttttttggttttgctttttattttttacaacgacggggtcttgctatgttttccaggctggtctcgaactcctggcctcaagcgatgctctcacctcagcctcccaaagcactgagattacaggcgtgagctatcgtgcccgacctgagatctgagagttgtaagccctctcagggctatggacaccttcgtgtgtcaggaaaagtcagggaaaggggaggggcacccagttctgtttccccatcaggacagatggaaatggcgtggcctccrtggcacagggacaggggagaacacgggctgcccgcgcaagctcacctcaggaactgtgcccccgtgggccccagtgctatgatcctgctggccaggccctcctcctcggccagtgggggcggcgtgctgagcttctggggcttgaccaggcggcaggtgatgcgggtgggcgctgcgcacgtccgtggcgggatcaccactcgcaggccgttgtggcgacttcctctcatggaaccaccccgggcgtcaaccatgaagctcaccagaaacctaggagtggggcagatgcacgttgggctt

SEQ ID NO: 17687 - DNA, 601 bp, Human
gggtgacctcatctatcaactggccataatgacatttccttcagagggacactttgaggacaaagaaacgtcaacgagaaaacttgctgctttgcaaatggtggtgaccgctctgaggggccaggagggcggacagaggtagaaggcagggcctcctggtcaggcctgtccccacatcacacccatggtgcctgaggggcagcaaagctccaggaggagcccaggctgcttcaagggagtggagcacaggcctctggagccgggtacttccctcgtcctcaggggaaacggccagggaggccgtcttactgggaactctcagtgcataaaaggtcagaccctcaggcttcagagtggccttgtctctagtgtcacacaatatttaagagttgtttttttggttttgctttttattttttacaacgacggggtcttgctatgttttccaggctggtctcgaactcctggcctcaagcgatgctctcacctcagcctcccaaagcactgagattacaggcgtgagctatcgtgcccgacctgagatctgagagttgtaagccctctcagggctatggacaccttcgtgtgtcaggaaaagtca

SEQ ID NO: 17688 - DNA, 601 bp, Human
tggtggtgaagttggcgcactcgttggcatatacaagtttggtggttcctgttatgtcttcccactgggcttggtctgttcctcctgtaacagcggcagaaatggggctggggacagtcttcaggatgtaagcatggagcttactaaaatgctaaggccgtggtgtgcaaggtgagactgggtgaagctcactttgtctgcagccctgggcaccctaccctcaccccgctgctcttcctcctagcaacctgcatgcccctcctcctagggcttggagagttcttccccaggggcatggacyttttttttttttttttttttttttgagatggcgtttcatgcttgttgcccaggctgcagtgtagtggaatgatctcggctcactgcaacctccacctcccaggttcaagcaattctcctgcctcagcctctggagtagctgggcttacaggtgcatgccaccatgcctggctaagttttgtatttttagtagagacggggtttctccatgtctcgaactcttgacctcaggcgatccacccgccttggcatcccaaagtgctgggattacaggcgtgagtcaccacatgggcatggactt

SEQ ID NO: 17689 - DNA, 601 bp, Human
tactattgccacacctgtggtcacggaggcttccacatggaggggacagtgagggagcctcagcctcaggcctggacggcagcatagagcctgaggacggcccacacaatactgggctgggctggcctcgtctcacctggcagagacattggtggtgaagttggcgcactcgttggcatatacaagtttggtggttcctgttatgtcttcccactgggcttggtctgttcctcctgtaacagcggcagaaatggggctggggacagtcttcaggatgtaagcatggagcttactaaaatgytaaggccgtggtgtgcaaggtgagactgggtgaagctcactttgtctgcagccctgggcaccctaccctcaccccgctgctcttcctcctagcaacctgcatgcccctcctcctagggcttggagagttcttccccaggggcatggactttttttttttttttttttttttttgagatggcgtttcatgcttgttgcccaggctgcagtgtagtggaatgatctcggctcactgcaacctccacctcccaggttcaagcaattctcctgcctcagcctctggagtagctgggcttacagg

SEQ ID NO: 17690 - DNA, 601 bp, Human
cctgcctgcacctggtaatggtgttctggagaaaacggcaggacggtttgtcccagaggcggtgcagggcccagccctgttacctctatgtccctgctccgggccacctccacgaagttctcatgctgctccagggtcttgtccactttatcatctgtcatgcagtagcagcgcaggcgcccctctcgggggtcattcatcttggcaaagatgacgaatttggccatgtagggcactgcagtgagctctttgtacagcagggtggcaaagttcacagcctcagcagtccgaggacagtccracagccaaaacctaaaaagtagggcgagttatgtgttcccaagtgcccaacagagagcatcctttccatccagacgggagcagcccgtgagccataccatggctactattgccacacctgtggtcacggaggcttccacatggaggggacagtgagggagcctcagcctcaggcctggacggcagcatagagcctgaggacggcccacacaatactgggctgggctggcctcgtctcacctggcagagacattggtggtgaagttggcgcactcgttggcatatacaagtttggtggttc

SEQ ID NO: 17691 - DNA, 601 bp, Human
tttttctttttggatttctttctgcttgaaagacccgtttctgtactgccttaaggccttaacatcacagccctgtggaaaagcatccgaacatttgcccaaggctgcagaaaaatattctctctctctttttttttaagagccagggtctcactctgtctctgaagctggagtgcagtgcgatggcacgatcatggctccactgcagcctcaaactcccggcctcaagtgatccttctgcctcagcctctcgagtgccaggactacaggtgcatgccaccatgcccagctaatttttcatttttttttttttgtacagacaggatctcactatgttgcccaggctagtcttgaactcctgggctcaagcaatcccttgccccagcctcccaaagcactggggttacaggcatgagcctctgcgcccagcctgaaaatcctcttttgaaaaagaagttggttcaccctcatctcatgcccaaaaagaaaagagagattgagccatggacttatgaatgtaaccttgcttctttcctagtttagcatggaaggctaatgattaaaacaacaacagcagcaaaacaacagcaacgaaaaccac

SEQ ID NO: 17692 - DNA, 601 bp, Human
ttataattaagcattcaccaagctgcgcttgggtcctcttctttgttgctcaaagccacacagtgctggatactgaccactcgcacccccattgttcctaaagacagggtttctgacattaggcttctgtttaaggatcccttaagatggttttcagattcccaattccagcaaccactttgaaggcagggatcagcacgagaacgtagcttcttgctctccctgtccatgactccaccctgcactctccaaccaatcaaccacctacacactccagccactccaaagcccttaacagccsgagccctgaactcctccttggggagacggatttgaggtttcctcctccctccttgtttggtggtcctgggattaagcctctttcaccgctgcaaccccgtgtctccgtgtgtcttgacttgccactcacattgggcaatggacctgctgtggttacacagggagaatccagttctagggtctgtggttgggcacagcacattctgagccttcactttatttgcccacctgtctcccttaaaataagatctaccctgatggttggcaggacttctgtgagatccagccacagccacagacc

SEQ ID NO: 17693 - DNA, 601 bp, Human
tggtccttgccagatgatttgagatgcaaatgtaaacactcaatttccacttagtgtttttgagtctgggaaactggttgaggaggagctgaaaagagaatgaggcaaagctccctccaggttggaggaagctcctgggagaatgagaactggttcagactggggtccagctcacccagactgtgtcctgagaggacaatactcatttgcttgggaaattcaacaggaagacctcaaagatgagtcatacaccctgcacagatgttgtcatctaggagtcctgatgcaatttttatgttattttttttagagtcaggattttgcttgttgcccaggctggagtgcagcagtgcaactgtagctcactcagccttgacctcccaggctcaagtgatcctcctgcctcagcctccagagtagttgggactacaggtgtgtgccaccacacctggctaattttgaaaggactatgttacacagtctgttctcgaactcctaggctcaagccaccctcccaccttggcctcccaaagtgtggggactacaggcatgagccactgtgccaggccttgcaatttttatcttattccaaggatgtgag

SEQ ID NO: 17694 - DNA, 601 bp, Human
ccagcatgttcacgatctcgccacggtcaatgctctgcagggctgtgtacagattctccactgtgggcgcagaagagagatgcacgttactccaggccggtgagcgaggatcacatgggctcagaaaatggggccaggatgaagatggagaaaggagataatttttttcagaaggtggaggcaccctcttttattagagtcaaaacaaacttcctctggggagaatactttttacacttcagcagatcttttccaaatgctaacagtgcgcagttattttatttattggtctctgttaccaaaaaaaaaataaattattttatttattggtctcactctgtcacccaggctggagtgcaatggggcaatctcggctcactgtccacctcccaggctcaagcaattctcgttcctcagcctcccgagtagctgggattacaggtgcatgccaccacgccctgctaatttttgtacttttagtagagacaaggttttgccatgttggccaggctggtctcgaactcctgacttcaagtgatctacctgccttggcctcccaaagtgctgggattataggcatgagccaccgtgcccaccacag

SEQ ID NO: 17695 - DNA, 601 bp, Human
tgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcaygcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataact

SEQ ID NO: 17696 - DNA, 601 bp, Human
gtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagraaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatacagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgactt

SEQ ID NO: 17697 - DNA, 601 bp, Human
tcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaaycacaaaaatctctaaagccattcatacagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgac

SEQ ID NO: 17698 - DNA, 601 bp, Human
tactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatasagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtc

SEQ ID NO: 17699 - DNA, 601 bp, Human
aaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgcctkggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattca

SEQ ID NO: 17700 - DNA, 601 bp, Human
attctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcaygttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgc

SEQ ID NO: 17701 - DNA, 601 bp, Human
tataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagarcacattacataatgctttctaatagcaatacagtgacaaactttatttttaaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatg

SEQ ID NO: 17702 - DNA, 601 bp, Human
aattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacactttgttaaagattttatagctgctcaagatttgaccaaggcttttaaaacttcaaatgytcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctg

SEQ ID NO: 17703 - DNA, 601 bp, Human
ttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgtttyatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacc

SEQ ID NO: 17704 - DNA, 601 bp, Human
gaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctargaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtga

SEQ ID NO: 17705 - DNA, 601 bp, Human
atagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcktggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagtcattccttatgatatttttcatccagccatccaaattatattaacttgtgccagctttagatactaatttagaaatatttgaaggaatacgtttgccag

SEQ ID NO: 17706 - DNA, 601 bp, Human
gtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcttggctatcacctggccattttcttggtctataggaattttttgaaattacttttgacagtttattttaagagctagtttaagctataggatttacgtgttcagtttattacyaggtttaagtttatttttgtatccacttcatctctcttgtgtgtcactattttcctatcttcctttaactcttgaaatcttaagacagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtg

SEQ ID NO: 17707 - DNA, 601 bp, Human
aatcacacatgaacctcttgagtctcctgatcaccaccggttgctaaaagtggcagcctctaagggccagctgagtaccctccctgagctacatcatgggcttggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcct

SEQ ID NO: 17708 - DNA, 601 bp, Human
aataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctgrtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagag

SEQ ID NO: 17709 - DNA, 601 bp, Human
tagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgkgtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccat

SEQ ID NO: 17710 - DNA, 601 bp, Human
tccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttrgagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgctt

SEQ ID NO: 17711 - DNA, 601 bp, Human
aactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcmacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttt

SEQ ID NO: 17712 - DNA, 601 bp, Human
cctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccycaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtatttctggttttctcttttttggtaggggcttgctttttggttttgtctt

SEQ ID NO: 17713 - DNA, 601 bp, Human
gatgtgaagttcagcctctggtgtagtgtgaagaatacataaataatctaaaaatggctttaaaataatcataaacatcatgtctgcagcttactctcaaatagttcagaaaaaaatgtatgtatgtgtgtgtgtatatatatatataaatgtatatctatctattaagagagaatgataaacgatgtaaaatattaactgtggaacctgcatgaaattggtaaacaggaattctctactatttcttgcagtttttttgtaagcttgaaattagttaaaaataaaaagtcacggctgggcrcggtggctcacgcctgtaatcccagcacttggggaggccgaggcgggtggatcacaagatcaggagatggagaccagcctggccaacatggtgaaaccccgtctctactaaaaaaaatacaaaaattagccgggcatggtggcgtgagcctgttatcccagctacttgggaggctgagacaggagaatcgcttgaacccgggaggcggaggttgcagtgagccaagattgtgccactgcactccagcctgggcgacagagcaagactccttcgcaaaacaaacaaacaaacaaaaataaa

SEQ ID NO: 17714 - DNA, 601 bp, Human
ccgagatcgtgccactgcactccagcctgggcaacagagcaagactctgtcgcaataaataaataaataaataaataaataaacaaacaaacaaacaaacatgcacatgtacctcctgaataaaaaataaaataaataaatacaacaaagtaagactttatttactttgagtaggagtctcgctctgttgcccaggctggagtacattagtgccatcatggctcactgcagctcttatcagtaacagttttacagtgttaggttaagttctcaaatacttaaatattcatccaagaattayagatctatatagaaacacagctggaaggggctttcatagatttctaggcttatgcttccataaacttcacatatgtatacatgttgttatagaaaaagaacagattcttgtcacacgaccaggaaaagattaggtctgcagacactttgaagggcgaggggaaaggaatttattggccaaaaaggaaaaaggaaaaacaactcaacaaaatgagattgagtcctgttaacaggctctccacctcaccgactgaaccccaggtaccacccaggaacaggtcagtccagactccttccctat

SEQ ID NO: 17715 - DNA, 601 bp, Human
gggatccttaacagagacccgtggatgggtttcaggatacatgtgcatctcttgaaacaaaaattttctgaggggtgggcccatagctttcatcatattcctccaaaggtctatggctcaaaaacagcttataaaacactgtaataaaaggtactggttagagagtgacacgactagatttccatgttagcaaaatcactcaggcacaaatcgggagggaggtgttggaacacttaggtgggtagatcatgttttgggggcagatagatagatcggcatggagccaaggaaacaggacttrgctaaagatatggattttagagcggtagtggaagtctgtgggtggtagactaagtgatgagcatgaataagattgtacagagagagtatgtattataaaatgagaaaaagacaaagaacaaaaccctgacgacatacgacatttgaaagcaagagaaatgaggaaccaaaggacaattaaaaggaacagccaggggtgcagtggctcacacctgtaatcccagcactttgagaggctgaggtgggtggatcacttgaggtcaggagtttgagaccatcctggctaacatggtgaaacccc

SEQ ID NO: 17716 - DNA, 601 bp, Human
gatatgcaaacccattgatatttcagtgaaatgggtttgcctttctagattaatagcaccttcatcaaaagcttcagttctctctttaagacagctgagacagaaattagatcttttctaaatctgaaagacagcatggaataaggttgtaaactttgcatgtgtatatatgaaaggataaaagagaaaaggggtaggaaaggaagaactccatcccctacccccacctgattttaagactctgctctagaaaaatgatttttttgtatttattactgacctcaaggggagaaaagaactracatttaccgagtacaaatcctatgtgccagatgttgggttagcagcagctttgcttctggtaatgggaacaaaatgttaggaatttacttatgagtcctcttcatttacatattctgcatatgaaatccatcttgcaactaacaaagaaatttaaatagtcttacaagtaccagatctctgaccagtgtattagctaccaggcactcacaagggaatttctaaatccatttggcaatgggaacaagctcctaaatttgccaaccacactaactaggcaagttcaaatgttttaaactag

SEQ ID NO: 17717 - DNA, 601 bp, Human
aacatttaccctatcagctctgtcttctagaagaaacaagttgtattataagatgggccactggaattaaaataataaataataaaactcaaactgaaagcatggaggatggcataggcattggtctaaaaaaagggcctagatatgcaaacccattgatatttcagtgaaatgggtttgcctttctagattaatagcaccttcatcaaaagcttcagttctctctttaagacagctgagacagaaattagatcttttctaaatctgaaagacagcatggaataaggttgtaaactttgcrtgtgtatatatgaaaggataaaagagaaaaggggtaggaaaggaagaactccatcccctacccccacctgattttaagactctgctctagaaaaatgatttttttgtatttattactgacctcaaggggagaaaagaactaacatttaccgagtacaaatcctatgtgccagatgttgggttagcagcagctttgcttctggtaatgggaacaaaatgttaggaatttacttatgagtcctcttcatttacatattctgcatatgaaatccatcttgcaactaacaaagaaatttaaata

SEQ ID NO: 17718 - DNA, 601 bp, Human
attgattaattttatagacttcaaagaataagaccaagaacatagttggtttacctcccctctctttcaaagctttatatttctttctaacttaagtctttctcacttaactgatgatggggtgattttaataaatcttttgtttagtctgtatttacctcaaagtcacagggataacacttttgcttttaatgtatttcttacttgttaaaaagactaagagaagactgttacctagattttttttttctgtttaaagttaggtaatacttgctcaaccaattaattttgaagcatctcstttttataacctgtctttcacaaaagcttaggtcttttgatggtaaaaatattttgagttttttatgtcttaattttttgtattatcttttctgtttctgtttactgaataagcttttcaggggatcattgtagaaacccatagatgtgtgaatccagagatgtatatttgttttttgaccacatgaattgattgtgagcatgtgtctatgttttattctttttttcttatttgttttttctaccagatcaaagttataagcttatcttagttgagtagatgttgcctgatttttgaatg

SEQ ID NO: 17719 - DNA, 601 bp, Human
aacataagataaagacattgtgtgatatggttattaatgtgttcagaggtccagaacagaaaataaaattttttatacagaaaatagtgacatttttgctgctcttttatttttaaaataaaacccttcaataaaaatggcataaaaatggctttgaaagccaaatatagtttgcctcagggaatcttaagtctttgtggtaagttcaggtttattttaataactcttcctatataatatttgtctttaaacaattataatcatttaaaattagacaaagtttgtgatttaagtcaacatkagatagaagttaagagcttgagctttggtatcagtgggaattgggtgagactctttgatcaagcaagtcgtgtgaccttaggcaagctacttgttctctctaaacctcagtgtctatttctaaaatgaggaacattataatagctacctagtggggttgctatgaacagatgaattaattcacagagtgcttggccaagtttacacgtgtacttcctactgtcattatcatcttccttgtcatcaccctcattctcgagaaggtcctggagccctttcctgtgagtggaagtgtggacta

SEQ ID NO: 17720 - DNA, 601 bp, Human
tttcttccttcctctcctcttggtccattttttccttaaatgttggtgatttttaccctttacttctccctctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgayatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgattta

SEQ ID NO: 17721 - DNA, 601 bp, Human
ctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaartgaaccatcatgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtctttgggttgtatgtgttctttttttttcctttagtaaaaagtttttgtttcagagtaatagcttgtgaattggttaattaaatctgaattaaagtacagtattca

SEQ ID NO: 17722 - DNA, 601 bp, Human
ttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaaatgaaccatcaygatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtctttgggttgtatgtgttctttttttttcctttagtaaaaagtttttgtttcagagtaatagcttgtgaattggttaattaaatctgaattaaagtacagtattcactatagaaatg

SEQ ID NO: 17723 - DNA, 601 bp, Human
agctagtctgccttgcattcccccatttccagactaaaacctagccatttatcgatgtggagcccaagctggtgatggttgtttattcccacagataaatcagttaacacaactactgatccctttctgtgtgcaaggcgctgtatgaggcattgtggagagaactaaagaagtacaagtatacatgtcctgcagagctcttatcccagtctctgcaaatatttctgtggctggagatagtatattggttcaggacatggagtctggggcctgaattcaaagcctgaccctgccatttacyaaccgagggcctttgggcaagttacttaacctctctgtacctcagctttcttatctgtaaaatggggatgacaagataactgcctcatatggttaatacaaagttaatatatgtaaagaacttaaagaagagcctgtatcacaataagcagtattaaagagtttgctcattttgtagccccagggctaaagcagaccccttatcttaaaatatgccaagaactgaactgtgtattgcaggatatcacctatttgtaatattcaacatagctttactatagaatattttgcaaccaactac

SEQ ID NO: 17724 - DNA, 601 bp, Human
cagcctgggtgacaagagcgaaactccatctcaaaataaataaataaataaataaataaataaataaataaataaataaatatttgttggactaaactatgactggttttgaaattagtatatgaagtgtaaagaagttaccaacttgagcatgccagtttctcccttatttctccttcagctagtctgccttgcattcccccatttccagactaaaacctagccatttatcgatgtggagcccaagctggtgatggttgtttattcccacagataaatcagttaacacaactactgatcsctttctgtgtgcaaggcgctgtatgaggcattgtggagagaactaaagaagtacaagtatacatgtcctgcagagctcttatcccagtctctgcaaatatttctgtggctggagatagtatattggttcaggacatggagtctggggcctgaattcaaagcctgaccctgccatttaccaaccgagggcctttgggcaagttacttaacctctctgtacctcagctttcttatctgtaaaatggggatgacaagataactgcctcatatggttaatacaaagttaatatatgtaaagaac

SEQ ID NO: 17725 - DNA, 601 bp, Human
ctactgagatggtacacacccatgatcaccactattctcaaccaatatctaaggcacagaaactattatcttagcacttaggactaccgccagttaaaggtaaacttcagtccctcgtcccaaacctctcttactgtaagtcatctttaagcctcagtgggttgttgtgtgaattcctagactccagcaaatagattgagagttgagtttgggctataactcacatcatgactttggcttcttcaatgaattcatcttcagacatggagccttctttgatcatcttgatggccacgtcgtactggcctctccatttcccatacttcactaccccaaattgtccagtccccagctccttcaagaaggtcaggtcctttggatcaatttcccatgatcctaacaataaagtcttggtgtgattctttggggtcatgaatgtataattcttacaatagacaaaaatccctactggggtagaaataggaaaactagtaaaagggaaatttttagaagtactaatctgtctttgcttaagtcaatctcagaaacgggattcattggttagaggaatctgggaattttaggttcaaggtggccataa

SEQ ID NO: 17726 - DNA, 601 bp, Human
tttattttatcaaaacaccctcccctcccatctttatgacaccatttcattcttgccaaattcggtccacccccacacacacacccccaagctctaccaaatgcctactcaaagagctgttggacccctttgtgcggctatttacatcctccctcctaaaaaatattttcatcgcaaattcagtctgtcttaattctctcgggaaatttcaggcacaataatttcttggcctttgctcagaagccactatcccagggaatcaaagaagaggtgcattcccagatgtagagaggggcctttktgtattgagtgggagcacaaaggctccagggctcctaagcttgggatttcctctgagaaagtgaaattggggcttgtggagaagagaagtagaaccaagaagcttattggcgagctcaggattcttcatccatgacatctagaatattgctcagaagaattttgaaagtgggacgctcatctgctttctaaaaccaaagaaaaagtaaagtgttagagtggctagaatccagaattcaagggaaatgcaatgagtaagcagcaaatgtttattaaatatatgctctatgcccagtagcat

SEQ ID NO: 17727 - DNA, 601 bp, Human
gaatactgagatagggcgcttcagggaggctgcatgattaatagagataccaaagactttcaagctttctagtaattttattttatcaaaacaccctcccctcccatctttatgacaccatttcattcttgccaaattcggtccacccccacacacacacccccaagctctaccaaatgcctactcaaagagctgttggacccctttgtgcggctatttacatcctccctcctaaaaaatattttcatcgcaaattcagtctgtcttaattctctcgggaaatttcaggcacaataatttyttggcctttgctcagaagccactatcccagggaatcaaagaagaggtgcattcccagatgtagagaggggcctttgtgtattgagtgggagcacaaaggctccagggctcctaagcttgggatttcctctgagaaagtgaaattggggcttgtggagaagagaagtagaaccaagaagcttattggcgagctcaggattcttcatccatgacatctagaatattgctcagaagaattttgaaagtgggacgctcatctgctttctaaaaccaaagaaaaagtaaagtgttagagtggcta

SEQ ID NO: 17728 - DNA, 601 bp, Human
atggagctggaagcctactactggtgactaagaagggggacaatgccactggctcagcagagggaattccctgtggggctgtccctcaggttctcatcccaacccccacccccacactgcactcacacctgcttcgaccccaagcagatcagatgtggcagtggggggtcatgtgacggagaggggtctataaatagctggaggtgggcatgctgccccagacgccttggggacagcaagagcagaggcttaaggagctacactgggggaaggacaggggcaagcaggccaaggcctggcyggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacaggtaaagtgctctaaggggagaggggagccatggatgaggggagacagtggtgccagagactggtgaaaatgaggaattgggtgaaaagagggagcagtgt

SEQ ID NO: 17729 - DNA, 601 bp, Human
aatggggatgggcacaactaaaggaaaggttgtgaaattgtcatggaaaaagataggtcatggttaataagtaagtgtgcctctccctccaaagaatgcagagaataacagaggatagaatttgtctagagggcagttggccagaacttttttttttttttttttttttgagatggagtctcgctctgtctcccaggctggagtgcagtggtgctatcttggctcactgcgacctccgcctcccgggttcaagcaattctctttcctcagcctcctgagtagctgggattacaagcacctrccaccatacctggcaaatttttgtactttcagtagagacggggttttgccatgttggccaggctgtctcgaactcctgacctcaggtaattcacccgccttggcctcccaaagtgctggaattacaggtgttaaccactgtgcccagtctggtcagaacttaaaaggcttttttttctttcttttttttttttttaacagggagccttcagttcctttaggtttaaggctgggaagctgaggcatgagctatgcaggggatctcagcactgggggtcaaaaggatctgctctcagtccct

SEQ ID NO: 17730 - DNA, 601 bp, Human
cccccatccctttgtagctcccaatccctcaccctacctcttacatacgtcccgcctgccccacccctccacccccttgtcccgcgtgcttctctgttgcagaccgtgcctgggcagcttgacctcctggtgtcggcctgtgcagtgggcgtgggatgctgctttgcagcccctgtcggaggcaagttgcacttcctccctatcccggttgcctaagcaagacttagaagggggttttgggtggctgccacaagctttggagtgggcatccagggaatgactgtggatcacagcccctgcrgtccagatacctatattttttcagcaaagggctgtgtattattttgagactgcttgctgtttggtgcaggatttattagtactgctttctggagttcttgctgtctcttttctgcttatcatttattgatttacgtgcctggcatatatttgcctaacttttatttcattttctaccttctatttcattttgacactgtgctatgaggttaattcctttttgccaaactcactgagtttctcttggcctgggaatcacaggggacatgggaccacaaggactccttttgacttaggcctc

SEQ ID NO: 17731 - DNA, 601 bp, Human
gattctcttaacatgaagagaatttgcattttcctcgtaaaattggaatttctgagaagaatcagaaaagttcttcttggtcctgtgtcaagtatgggagaggtaaagatcacagagaagttacaggcaacagttctgaaaccactgtggtagaaaaaggaagaaaaaattcacagataaaacattgctgttgacacaagaaattgttaagtacttaaaaattaaggtgccatgtttacgctgtttgtattatgtggtaaatgacaaaggtatttgcaggtggcattacttgttttttttktttgtttgtttgtttgtttgtttagatggagtcttgctctgtcacccaggctggagtgcagtggcaccatcttggctcactgcaacctctgtctcctgggttcaagcaattctcatgcctcagtctcccaagtagctgggattacaggcctgcgccatcacgcctggctaattttttgtatttttagtagagacagggtttaaccatgttggccaggctgctctcaacctcctgacctcaagtgatccgcccaccttggcctattacttgatttttaaaaaagaataccgaataattctg

SEQ ID NO: 17732 - DNA, 601 bp, Human
gccatcacgcctggctaattttttgtatttttagtagagacagggtttaaccatgttggccaggctgctctcaacctcctgacctcaagtgatccgcccaccttggcctattacttgatttttaaaaaagaataccgaataattctgaaaggaaaattagtatcaaaatgaggtattcattatggagtcagctcttaatttcttacactaatgaaataaatggaattcagcattctactgaaatgacaagcatcttgctcccattctgtaccaggccctgtgttggatcttgcacactcarggtgctcctagttgagaggctggacaggcaggcaaacctattgtcatagctcactcgaaaaagtggcccaatggcagctggggtaaagtgcagtggggaccttatgctaacctgcctacaagagcccatgaagcttcacaaaagaggtggtgtttgacatgaggcttgaataataagtaggactggcaaggaggatggtgggcaaggtattctggacagaggaaacagcattgcaaagtcaagatgggggcagtagctgagtattaccaggggatacagaggaaggaataatagcaaatg

SEQ ID NO: 17733 - DNA, 601 bp, Human
ggtgtggtggcaggcacttgtagtcccagctacttgggaggctaaggtggaagaatcacttgaacctgggaggtggaggttgtagcaagctgagatcgcgcgccactgcactccagctcgggcaacagagtgagactccatcttaaaaaaaaaaagaaagaaaaagaaaaagaaaagttaccagaacatttgatatgctgacacacattgggaatatccaaaatgtggctctaatgcagcatttcccacagaaccctgtctcgtgggcatgggatttgtagtatctcacagacctgacttygggaaatactgtcggggtgaattaaagtcatgaaatacttgtgcacaaggaagtgatatggccagctttgagtgtccacccaatccctttgtcagatgtgtgcaggacaaaattggtctggggattaacaggattaatccaagattaacaagaagacgattgtcatagtcctgatgctaggtagtaagagactgcactggacagaggcagaagagaaagagaagaatggtagaaagtaaaattgatacaacctggtgattaattttatttttttctttttgagagagggccttgctctgt

SEQ ID NO: 17734 - DNA, 601 bp, Human
actgcactggacagaggcagaagagaaagagaagaatggtagaaagtaaaattgatacaacctggtgattaattttatttttttctttttgagagagggccttgctctgtggcccaggctggagtgcagtggcgcaatcttggctcactgcaacctctgtctcctgggttcaagcaattctcccacctcagcctcccagcagctgggactacatgcgcacgccactatgcctggctaatttttgtattttttagtagaagtgaggtttttccttgtcggccaggctggtctcaaactcccrgcctcaagtgatctacccacctcggcctcccaaagtgctggggttacaggcatgggccacctgcctagcatcccggtgattaattttgtgtggggtaaaagagaggagggatctaggctaacacccagatttcctacaagggcaattgggtcgatagtggtgttagtaaccaagattgggtatatgggaagtgaaacagatctggtggggggagctagctgatacatttcactttgagtgtattgaatttgatgttcctgtgacatatctaggtgagaccatttttgcagcggggttgac

SEQ ID NO: 17735 - DNA, 601 bp, Human
aaaatattcatcagttggatagtttacacccaggcaaatcaaagctgactgcttttgttactggtatagaaaaggagagagactcactctacctggttcctgctgtgtcaaatcctccttttaggccccagaggcagctgcttacctgatgtgatgtgaagagcagggcagaaggggtgattggccaagcaagctctgtctgccccacattgcccattgcctttctctgtttcctgaaattctgttctcttctgttctcttctttcctcatcctgtcctttcctctcctcccctgctcatycagagaatagacattcagccctgattattcaccaggcactgtactaggtgctggttttcaaggaattttctttctttttttttttttttttcaagacagagtcttgctctgtcacccaggctggagtatagaggtgcgatctcggctcactgcaacctgcgtctcccgggttcaagcaattctcctgccttagcctcccaagtagctgggattacaggcgcctgccacagcgcctgactaatttttgtatttttagtagagttagggtttcaccatgttggccaggctggcctcgaactc

SEQ ID NO: 17736 - DNA, 601 bp, Human
gttcacatggagagaaaggggacaaacctgcctagttcaaggtttcctgaggccaggcctcatctccattcatccaattatgtgcgtggttgcatttccctggttccttttcctcgtttttgataaagatgaggcttagccaggttttaggtaattttgtcatcaatttttactttgcatcagattaaagtccacccccccttattcttaatatgttgaaatatttttttctttgcctctcttgagtgttgctttttacgccctcactcgcattccttactttgtccctaccaacccttgytctttttctgtagatctaccccctcaatttctgctccagcacctacgctcagaaacagtactacttagaactactacttagctttccttttgcctcacccacctttcttaagcatgattgtttttctcttcttctagcctcttggtttttccccttgcgttggtccttttaagtcgggtttttagtattagtttattattattattatttgtatgactcctctaccttcttttcttgaactatcgaggatggtcagctcctgcaaagccccctcctatttttgttctgtcttccttataa

SEQ ID NO: 17737 - DNA, 601 bp, Human
acattcactttattaatttaatccctttaaaatgtctttcttcaaaagattttacatttttatcatgaaagaagttttcagtgtcttgttagggatttgatttttagactttcattatagagttcatcttctctaatttataaatcccaacctcctataattagttgttgagtacacaaacccatctacagtaaccaagtacaaattttggtggatctcagaattggacggtagtccaatgatgataactgtatttttctgagattcctctagactgagctatacggcaacattggcatcrtatgtacctttaaaatatcaagattttgaaaagtcctgtagaaacgaaatactgtatatttttcaacatttctgccaaacctcatcccagctctccagattcccaagtatatgtctggattccacttcgcaaattcaagcttattttgagaaacctacttagatgatatagaggactcacctgtatgccacaattattaatttctcactagattatatccttgataatgttacatcatactgtatcaggaaaagaaacatatacttcctgggctatatttcaagcctaacagtttgcagc

SEQ ID NO: 17738 - DNA, 601 bp, Human
agattttacatttttatcatgaaagaagttttcagtgtcttgttagggatttgatttttagactttcattatagagttcatcttctctaatttataaatcccaacctcctataattagttgttgagtacacaaacccatctacagtaaccaagtacaaattttggtggatctcagaattggacggtagtccaatgatgataactgtatttttctgagattcctctagactgagctatacggcaacattggcatcgtatgtacctttaaaatatcaagattttgaaaagtcctgtagaaacraaatactgtatatttttcaacatttctgccaaacctcatcccagctctccagattcccaagtatatgtctggattccacttcgcaaattcaagcttattttgagaaacctacttagatgatatagaggactcacctgtatgccacaattattaatttctcactagattatatccttgataatgttacatcatactgtatcaggaaaagaaacatatacttcctgggctatatttcaagcctaacagtttgcagcaggcctataatatcctataatatttacgaacataaaaccattcact

SEQ ID NO: 17739 - DNA, 601 bp, Human
agtaaccaagtacaaattttggtggatctcagaattggacggtagtccaatgatgataactgtatttttctgagattcctctagactgagctatacggcaacattggcatcgtatgtacctttaaaatatcaagattttgaaaagtcctgtagaaacgaaatactgtatatttttcaacatttctgccaaacctcatcccagctctccagattcccaagtatatgtctggattccacttcgcaaattcaagcttattttgagaaacctacttagatgatatagaggactcacctgtatgccacaattattaatttctcactagattatatccttgataatgttacatcatactgtatcaggaaaagaaacatatacttcctgggctatatttcaagcctaacagtttgcagcaggcctataatatcctataatatttacgaacataaaaccattcactgctacaaatctatgatattccctggttatcaccacttcccagcattttcactgtctaatcattggacacaataaccatactcttattttttagctaggtaggatacatagctaaactaaaatataaacatgactgaaacaatt

SEQ ID NO: 17740 - DNA, 601 bp, Human
gatgatatagaggactcacctgtatgccacaattattaatttctcactagattatatccttgataatgttacatcatactgtatcaggaaaagaaacatatacttcctgggctatatttcaagcctaacagtttgcagcaggcctataatatcctataatatttacgaacataaaaccattcactgctacaaatctatgatattccctggttatcaccacttcccagcattttcactgtctaatcattggacacaataaccatactcttattttttagctaggtaggatacatagctaaaytaaaatataaacatgactgaaacaatttttccagtgcctaatttgaaatgtagtctatgtggtcttctagcagcatctgtacaggcaggtaagattctcaattcagctgttttgtttttttttttttttttgattcggaatctcactctgtagcccaggctggagtgcagtggcacaatctcggctcactgcaagctccggctcccaggttcacgccattctcctgcctcagccttacctgtagctgggactacaggtgcccgccaccacgcccagctaatttttttgtatttttagtag

SEQ ID NO: 17741 - DNA, 601 bp, Human
ttgcagcaggcctataatatcctataatatttacgaacataaaaccattcactgctacaaatctatgatattccctggttatcaccacttcccagcattttcactgtctaatcattggacacaataaccatactcttattttttagctaggtaggatacatagctaaactaaaatataaacatgactgaaacaatttttccagtgcctaatttgaaatgtagtctatgtggtcttctagcagcatctgtacaggcaggtaagattctcaattcagctgttttgtttttttttttttttttkattcggaatctcactctgtagcccaggctggagtgcagtggcacaatctcggctcactgcaagctccggctcccaggttcacgccattctcctgcctcagccttacctgtagctgggactacaggtgcccgccaccacgcccagctaatttttttgtatttttagtagagacggtgtttcaccttgttagccaggatggtctcgatctccttgcctcatgatctgcccgcctcagcctcccaaagtgctgggattacaggcgtgagccaccgcacctggccaattcagctgttttataat

SEQ ID NO: 17742 - DNA, 601 bp, Human
ctgaagaaaaaaaaaaaaaagctgggtgtaatcccagcactttgggaggccaaagcaggcggatcacctgaggtcaagagtttgagaccagcctggccaacatggcaaaaccctgtctcaactaaaaatacaaaaattacctgggcgtggtggcaggcgcctgtaatcccagctcctcgggaggctgaggcaggagaattgcttgaacgcgggagccagaggtggcagtgagctgacacaccattgcactccagcctgggtgacagaacaagactctgtcaaaaaaaaaaaaaaaaaaaargaagaagaagaaaaaaaaaggaaggaaggaagggaaagaaagaaagaaagaaaaagaaagaagaaagtcttgggagttatttgtgtttcacattacttctggatcttttctttcacgtgccaatagctaaaaaagtttgttaatctcatgtgtcaacctttgtgctataggagttgataacttcaatgtcttctgattgtaatactgttcttacacatatcttggaggataatctaaaatacatcttctgaaatcagacctattggttacctgttatatgaattgctagagctttcagat

SEQ ID NO: 17743 - DNA, 601 bp, Human
ggaaaggcccgggatgctgggagtttatatttgttcttaatgcccaaggagagattggttctgaaaactgagagcaaggaacttggatctcgtaacaccttccttccttttatcttccctctaggagctgcatttggaaggctggtaggagaaatcatggccatgctctttcctgatggtattttgtttgatgacatcatctacaagatcctacctgggggctatgcagtaattggtgagaaacattcccacttccctgtaatcaaacattgagtacttcagatccccacacttaaactcycccattggatcttcattctaggctacacaatacggttttaatttagtgctacttaactcaacttttactcagataacatacccatggctctgactctcattatttcttactgaacttccgtgagccttagtttcctcatgtagaaaaggatcatagggatcaaatgagatcataagattctaggattgtgtctggatgtttgataagggttctgtctttccttcccaagaatcatggaaccaacaatgcaggtgattggctcaggttgcaggtgattgactcaacctgagacgtgttgat

SEQ ID NO: 17744 - DNA, 601 bp, Human
agattgtaccactgcactccagcctaggtgacagagtgagactctgcctcaaataataataattaataataataataataataatttaaaaaaataataaaataaaatgctcagtgaataatcatccaaacttttaaaagcaaggaatggataggacatcactatcttcatattataaatgaaaattttggcacacacaaagattttgtaacttggtgaagtttatagaatgagatcaaaatgatgatttttctaagagttcagtattctattccctactcttgacaagtcattatgagtrttggcactgaccagggtcatgtctctcattccgtgttattcccatcccatccccatatgtccttcatgctaagaacggtagccctaacctacaggcgtattcctgtgtcattctaggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctacccta

SEQ ID NO: 17745 - DNA, 601 bp, Human
ttgggaggccgaggtgggcagatcacctgaggtcaggagttcgagaccagcctgaccaacatggagaaaccctgtctctactaaaaatacaaaattagctaggtgtggtggtgcatgcctgtaattagaacccgggagacggaggttgcgatgagccgagaacgtgtcattgcactgcagcctgggcaacaagaatgaaactctgttaaaaaaaaaaaaatttcccactaaatacagtcaattctcataattcatggtagttatgttcaattaagtatgaagttcaaatactatactgaayaattgctcctaggaaaaatacagggctgtgttcctgtgagtctctggtcacatttccatcaaccaatcaatatatgaccttgttgtatgtgtgtttctggtaaagacaccttatttcacagatattgtggattaattaatattgaacttgtgccaacagcactataacccttgcctgaattaagcttacttaacacacatattttctcaataaggctcatcacagccttcttgcactaggaaaagtaaacagcactttgacattatatttggtggtcatttttagcagcaaaatcaccaa

SEQ ID NO: 17746 - DNA, 601 bp, Human
ggtgcatgcctgtaattagaacccgggagacggaggttgcgatgagccgagaacgtgtcattgcactgcagcctgggcaacaagaatgaaactctgttaaaaaaaaaaaaatttcccactaaatacagtcaattctcataattcatggtagttatgttcaattaagtatgaagttcaaatactatactgaataattgctcctaggaaaaatacagggctgtgttcctgtgagtctctggtcacatttccatcaaccaatcaatatatgaccttgttgtatgtgtgtttctggtaaagacaycttatttcacagatattgtggattaattaatattgaacttgtgccaacagcactataacccttgcctgaattaagcttacttaacacacatattttctcaataaggctcatcacagccttcttgcactaggaaaagtaaacagcactttgacattatatttggtggtcatttttagcagcaaaatcaccaacacaaagcacaaaaatgcaaaaaggatggcactaaatagactacaaaatgaacacctgtttacaatgtgaaagctgaaacaagaaggtacagcactgctttgttcaact

SEQ ID NO: 17747 - DNA, 601 bp, Human
aaatacagtcaattctcataattcatggtagttatgttcaattaagtatgaagttcaaatactatactgaataattgctcctaggaaaaatacagggctgtgttcctgtgagtctctggtcacatttccatcaaccaatcaatatatgaccttgttgtatgtgtgtttctggtaaagacaccttatttcacagatattgtggattaattaatattgaacttgtgccaacagcactataacccttgcctgaattaagcttacttaacacacatattttctcaataaggctcatcacagcctkcttgcactaggaaaagtaaacagcactttgacattatatttggtggtcatttttagcagcaaaatcaccaacacaaagcacaaaaatgcaaaaaggatggcactaaatagactacaaaatgaacacctgtttacaatgtgaaagctgaaacaagaaggtacagcactgctttgttcaacttcagctgggaacagggacatgggacaactaaaaatctttgttgctctttgcatgtttgtgaattacagtgaaagcacctctagtattggttttgtgttacaaatatattttagtgactag

SEQ ID NO: 17748 - DNA, 601 bp, Human
cagcactataacccttgcctgaattaagcttacttaacacacatattttctcaataaggctcatcacagccttcttgcactaggaaaagtaaacagcactttgacattatatttggtggtcatttttagcagcaaaatcaccaacacaaagcacaaaaatgcaaaaaggatggcactaaatagactacaaaatgaacacctgtttacaatgtgaaagctgaaacaagaaggtacagcactgctttgttcaacttcagctgggaacagggacatgggacaactaaaaatctttgttgctctwtgcatgtttgtgaattacagtgaaagcacctctagtattggttttgtgttacaaatatattttagtgactagctgaattcacaaatagggaatccatgaataatgacaattaatgtaaatcccatagcttcttacgttgttccattttgatgcttacataagtcatgcttgttctttaatgcccaacttatggaagagttggaactgttttctttcttccttcctttctttctctttctttctttccttctttttctttctttctctttctctctctctccctccctctttccctctctc

SEQ ID NO: 17749 - DNA, 601 bp, Human
gtgttcacgtctcagcttatttgaatggcttctcatgtttctttttatttggacagcattgattagcctccttaattatcagctcacctatctgaagtctatataaggcctcatcaaaataagtacaaattagcccaattagtgctctaccaattggccccgtacctgctaaatggatgaaataaaagggattgagtgaggttaatcttggaggattcttaaaatgagtttccaggaagctgagaaagatgtggggacgccgggcagggtggcgcctctcctgttccttctcaggagtgcrgagcgcggtggtgcgagagggcttggagggggcgctcaggcagggcgtgggtttccctcagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagc

SEQ ID NO: 17750 - DNA, 601 bp, Human
ccttctcaggagtgcggagcgcggtggtgcgagagggcttggagggggcgctcaggcagggcgtgggtttccctcagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagayctctctggcaagagcgaggtgaccgcgccgggaagggctagggagtgggatagatcaggagcaaagggaaaagcgtcgtctgggctgggctgggctgggctgggacaggcgtagtttccctgaaagtagtgggaagagggaggggagagtctggtaactgagaaagccagaaattctggatcaggtaccatagagaccagtgcctctgggtccagggactaaagaagataaggttgcagatgatggtatcctcgacaattcaaagggatataggaatttctgaactggggggaagaatag

SEQ ID NO: 17751 - DNA, 601 bp, Human
atcaaatgaagatattgctaatttgtttctaccttctttattgtgttgtcatgaaatagaatgtggtctggatgggaagtgttttgagaggatggaaataaggatgattatggagagagtaatgagtgtgtgatgggacatggaggtgttctcagaaggacacgtcatttcagaagagaaaaactttgagcctccatgagtaaatggggccatggtgctaagatgagccccagatcttttagagattatgggctttctggatcaggcaaagctttaatggaggtaaaatggcaccaggagrctggcactaaaacagcaacatagaagaagaacatcaaaactaaaatgggaggccgggcatggtggctcatgcctgtaattccagcactttgggaggccaaggcaggcagatcacctgaggtcaggagtttgagaccagcctggccaacgtggtgaaactccatttctactaaaaatacaaaaataagccgggcatggtggcacgcacctgtaatcccagatatttgggaggctgaggcacgaaaatcacttgaacccgggaggtgggggttgcagtgagcagagactgcaccactgcact

SEQ ID NO: 17752 - DNA, 601 bp, Human
tggatcaggcaaagctttaatggaggtaaaatggcaccaggaggctggcactaaaacagcaacatagaagaagaacatcaaaactaaaatgggaggccgggcatggtggctcatgcctgtaattccagcactttgggaggccaaggcaggcagatcacctgaggtcaggagtttgagaccagcctggccaacgtggtgaaactccatttctactaaaaatacaaaaataagccgggcatggtggcacgcacctgtaatcccagatatttgggaggctgaggcacgaaaatcacttgaaccygggaggtgggggttgcagtgagcagagactgcaccactgcactccagcctgggtaacagatccagactttgcctcaaaaaaaaaaaaaaaaaaaaaaactaaaatggagaaatctgctcctggtggagattactgtgctggattgatcagggccctgagacagtgaacaactggaaaatgctaggcattgctactgggaagaactgaaaaaggaagaaaataatgaccacggtgcctcctggggacaaacaaatgcctattttcctaaacgaggtggttatcaaatcttcaagagagaaa

SEQ ID NO: 17753 - DNA, 601 bp, Human
acagcaacatagaagaagaacatcaaaactaaaatgggaggccgggcatggtggctcatgcctgtaattccagcactttgggaggccaaggcaggcagatcacctgaggtcaggagtttgagaccagcctggccaacgtggtgaaactccatttctactaaaaatacaaaaataagccgggcatggtggcacgcacctgtaatcccagatatttgggaggctgaggcacgaaaatcacttgaacccgggaggtgggggttgcagtgagcagagactgcaccactgcactccagcctgggtracagatccagactttgcctcaaaaaaaaaaaaaaaaaaaaaaactaaaatggagaaatctgctcctggtggagattactgtgctggattgatcagggccctgagacagtgaacaactggaaaatgctaggcattgctactgggaagaactgaaaaaggaagaaaataatgaccacggtgcctcctggggacaaacaaatgcctattttcctaaacgaggtggttatcaaatcttcaagagagaaaaatcaagcattctgaatgtgcttggttgtcaggagggaacagaatgtggactagt

SEQ ID NO: 17754 - DNA, 601 bp, Human
aaacgctgaaaacgtaaagcttgtaaagtatgaagctgacaaaaaaaacacggcagatattatttttaaatgaacatcttattggatatccagaataaatatgtgctgacaatgaaaagcattacaggattggaggaggatgttgtgagtgacaagacagaagagaaaccttccccaccccctcaaaacacacacacttctgataaatgacttgtgaaaaagtcaaatcgatgatcacagagggaaaggaagaactattccttctgcccacaagcaggaatcagaaaggccataattgcarttaaggagtactttgttaggttgctaaaaccaataacaataagttttgctttttttcttttttttaatttaatgcaccaaagagagaaaaccagctagttgatcagtgtggctattgaatgaccactggaaataaagtgaagccagggattaaaaataagatagactatcatttctagcttatgtctttcccagggaagactttaaggagctaccaactcccatgtgacccactgagacattttagagggataagatctaacaggagttgaaattcaggatgttttgaacacaattttca

SEQ ID NO: 17755 - DNA, 601 bp, Human
gtgtgtgtgtgtgtgtgtgtgtgtgtgtgtgtctgtgtgtctgtgtgtctcttcccccttcattcacttttagtatacatactgtggatactaaggagtaattgcagtgaacaaattcacattaccgagttcatatttttaatgagatcttgagagtgggaggaaagagtcggctcctagagaataaaatgaaggcagacttagggaaatttgaaggtacaaaggcaacttaccttctgatcaacagccaaccacagtctggaataaatgttatcaaacacacattcttcaaaatggtccrtgtctgagtaattaaaaggcaaatttccaaaatcataaggacttccgttaatcaagtcaggcataattattcttcctactgatggacacaatgaagtaaacatatcattcttgtaatttaacagtaattctcgtaaattgcccttaaatgtcagtgctggatgtggtccaccctcctaaattgtgactgttgcaacagatgttctcacttcaaataacgcacttcttggccacctaattaaagcaatttttggggtgattcatcctactgcaagcttggccacacttgtatcctgtatta

SEQ ID NO: 17756 - DNA, 601 bp, Human
aatgatcttacctaatttaagtgaactaatttaaagcaaaattcagatgtctgaattaatccattttcatagttaataatgtgcaaattagaccttttgaaaaaggatattaagaatggtacaaactcaatgaagtactaggtaacttcaatgttttataaaaaagtaagtcagcttcaatgtttcataaaaaacaaattcaatatagaattttaaggtaacatactttcctaaattttaccttttttcgatatttaggtattaaaaatgatcaaaatcataaattatttcctcatcaatytactagtcttacattcagcgattcatctgtgcactttaccagcttaattgctaagcattcaaaatatccttcagacacattaatatttcacaacagttataaaatagtaaataattaataatttaattcaaaatacatttacatattaatattgcaaacaaatcaccctgctgatccctgccatacttttgacctgcataatttctaggtcattaaaatattcttaaaaaaatataattggtccttaattaggtaattcaattctataaacttgtttctctatttgttaattattgctat

SEQ ID NO: 17757 - DNA, 601 bp, Human
ctttgcatggtctactttctttatttgtaattgacccatccaacacatgcataatggaaatatatctacctaccaccacagtcctctttttaacacatttcatttgcttttgaactaagatcccttaggtagcttggaaataatagtgaattagtagtcagtaacatgtttctctgctcaaattcatgcatgtacaagtcaggcttacattttatttgtggcattcttaaatctccctgctatgcttatttgacatttataactatgtggttttgcattgtataacacttttgccaatatrtgaatacctatatcttatatctattaggaagaggagacttacatgtatttcactcaatttattagaaatagaattaaatcagttaattattttaacaatacaagtagttaatgatagtaaatctgcaggattttctctcctatgataaagtgaccttattaactgtcacatcagttaattcattcacatgtaacataccaaaacaattgaatcagtttgtcacagtcagagatcggcaataaaaatacgatgtaagtccttgtgcactgttaaacatatgaagcacgtggaaccatacat

SEQ ID NO: 17758 - DNA, 601 bp, Human
ttgattatatgatcctcattaagatagatcatatacttatgtccaagaaataatctttggacatagtaaccataacttgggcaaatcaatttaatttaaaacagtaatcactctgattaattttttaatattctttaacattgcttagaattttaagcaacacttagaggcatagaactatttattaagttctctgaacttgttggaaaggatcaacaagttctatctagtccagctaactcattttaaaatgggagagtttaagcccttttctcaaagtcatccaggtaactaatgacakaactagaactagatgccaggcaagatgtctaatatttgcttacatcatggtttatgtacctagtccttgaataaaccactcatttagtcaacagatattaatcagatgccttcaatgggccctaaactgtattaggaactggggaaattacaaggaatatgacagattctgatccttcctcaaggagttaacaatataggaaatgtttctttttctgaattttgaccaaaaaaatccttttttagtctattgattgtaaatctatatagaagagagtatgagtaaaaatctagcatttat

SEQ ID NO: 17759 - DNA, 601 bp, Human
gcttagaaacattccctatatgatgatgatgatgatgatgactattaacaaatgaagcttctaacaagcattagagagaagtttgaagggaaaaatgctaatacgagcatgcaaaatgtatactagcatatatgaaatagaggggaaaactgccagaagtcaaagtgttaggttgattaagcactacagaatttaatgtatacacacacacgcaatttagtgattttaattaattgtttcaaaacaaaggtatttatctgcccaaagtcaacaaggtctttaaaatgtaaattttacctgrgcagtgcacttagtgctctatcttcaaaagaagatgttctgctggagctaatggcccacagtaagctaatatactctaagggtgagataatattttctgtaaattaaaactcccacttgagaaataatgtacctttaattgacgacttctaattccctaattttttctggtagtttaaaatgttcatatctgaaatgaaaaagtagagtgtttcttttggctttgtttatattggatttttgaaattagctgtttcagctaatgctggacattagtcagttttaaagcagtacctacatc

SEQ ID NO: 17760 - DNA, 601 bp, Human
ataggcagcaataaagtattaaaataatttccatgttggaaaatcaataactataaaaccccacagggttcttctctgaattaatgagtaatcacagcctccatgaaatacactacattttatgtaaatgaaattgttgcaaatacatgaaaaaataaatataattagaaattcatgatgtcaaagaaaattattttttaatgtatgcctaaaaagctattgtgatggaaaagtgacagtttcttttaatgtcagagcaatttctaaaaccaaatgaataattcttataattaaaatgacrtacattttagataaaatccatgttatttcactctaggcattaatacagtaaggtaggtttgactgcagagtccccacagctgatgtcacgaacaaattacttgagactggtacatgaaatattttcagcattatgaggaacagaccctacggatgagcttacacaggcattgattactgcaaagaggagtcaagaaagtgtatttagcttacaaactattaacagcctgttttaccctacttttgtgctatggaaacaacaaaggggaaaacaatcttccatcatttgggccatattttc

SEQ ID NO: 17761 - DNA, 601 bp, Human
aatcacagcctccatgaaatacactacattttatgtaaatgaaattgttgcaaatacatgaaaaaataaatataattagaaattcatgatgtcaaagaaaattattttttaatgtatgcctaaaaagctattgtgatggaaaagtgacagtttcttttaatgtcagagcaatttctaaaaccaaatgaataattcttataattaaaatgacgtacattttagataaaatccatgttatttcactctaggcattaatacagtaaggtaggtttgactgcagagtccccacagctgatgtcaygaacaaattacttgagactggtacatgaaatattttcagcattatgaggaacagaccctacggatgagcttacacaggcattgattactgcaaagaggagtcaagaaagtgtatttagcttacaaactattaacagcctgttttaccctacttttgtgctatggaaacaacaaaggggaaaacaatcttccatcatttgggccatattttcaacaataatatcatataatagactcttccagaaggctgtttcaataatgttttatttttccttcacccctcattacatccacttttgtt

SEQ ID NO: 17762 - DNA, 601 bp, Human
gctgagagtaggtttcaaatgctcccaacaccctaacacaccagaggcagattatgataccccttcattgggaattggtcaaaattactgactgtgttttcttaggcaaaaaaagcatctgctttccatctgccttattaaatcagtgactctcaatttaatatgttataaaattggcctggaaacaatgttgacctacttttgcaggatgctcatctatgaattcctctaggggttgggtgaagtgttttggcttggtttgtgtctgtatctcccctgtaaggagatcatgctatttttwacaaactctaccttatcaaagccaagagatttctttaattctctctatttcatgtactttcttgcagggtagtcctggttctcgtggtcttcctggagctgatggcagagctggcgtcatggtaagctgtctatcacttacttcctagaaaggggcttgctgcttctggtggtgggtgtgtcattagctttagcatcctcctcctctatctgttttttttttttttttgaatagggccctcctggtagtcgtggtgcaagtggccctgctggagtccgaggacctaatggagatgctggt

SEQ ID NO: 17763 - DNA, 601 bp, Human
aatttaatatgttataaaattggcctggaaacaatgttgacctacttttgcaggatgctcatctatgaattcctctaggggttgggtgaagtgttttggcttggtttgtgtctgtatctcccctgtaaggagatcatgctatttttaacaaactctaccttatcaaagccaagagatttctttaattctctctatttcatgtactttcttgcagggtagtcctggttctcgtggtcttcctggagctgatggcagagctggcgtcatggtaagctgtctatcacttacttcctagaaaggrgcttgctgcttctggtggtgggtgtgtcattagctttagcatcctcctcctctatctgttttttttttttttttgaatagggccctcctggtagtcgtggtgcaagtggccctgctggagtccgaggacctaatggagatgctggtcgccctggggagcctggtctcatgggacccagagtaagtttcaaactgattctgagcaaatcacacctggcattacttccttctttaaagggttggttaatattgaagataacaataaaaacatcaaaagtaaatttgttagtagtcttgctga

SEQ ID NO: 17764 - DNA, 601 bp, Human
gcagggaaaattgaagcaggtgacaaggggatgcaagagaagggaatgagggaaattgcatacatacgagattgaattggctatgtgtgtactgacatcctagttagaaaaggaaaatggattcataatttattaacgctttatacaagaagctctatgcattcagaaaactattctgtttcatccgtggcagcatcataagcttgaggttgtgagaatatgttgacactgagtaaacttgaaataactctgctttcagggcctccctggcatcgacggcaggcctggcccaattggcccmgctggagcaagaggagagcctggcaacattggattccctggacccaaaggccccactgtaagaatcaccacaactttcttaccctcagcactttctgtagccaaattttaccaaactctagtatttatctcctgcgaatcagtccagtctcagggagtttcctttcaacacaggaaaactgcaggccacttatcacattaaaagtttacctctagtgtatccttatatccctgctaaaaatccatctcctgagccccatgcttccacagacacagggacatcttactgtacatggagctg

SEQ ID NO: 17765 - DNA, 601 bp, Human
catcagcctttctgttaaatatttttagggtgctccaggtcctgatggaaacaatggtgctcagggacctcctggaccacaggtgagtatttctcccactcttgtgctcttctgcactagaatgtatatagtcctcaaactggccatctccattttcagtccaaaagttatacagctagacaacagtggtgacatacgttgctatttatgctctctttcctgtcactttcagggtgttcaaggtggaaaaggtgaacagggtcccgctggtcctccaggcttccaggtaagtcaactcaarcatatacaatactgcctttggtcagcctattgagctgtaaatcaccataccgtacctctcttctccaccacaataaacatgatttcaggactgaagcaaagaaaggtgcatttttttcaaacaaacttttgtgtaatgcttaataacatacaatcgtgctcatgttgatatttggtagccaccacccccaaactcaattattagcaaatctcctgaacgtagccatgggattgagatttgtatttcttttcatttttagggtctgcctggcccctcaggtcccgctggtgaagttggcaa

SEQ ID NO: 17766 - DNA, 601 bp, Human
ttttcaatcaaactagatcccgaaaaattccttttgtgtttttcttggcattcagacatgacactactatacacaatcagggcatgagttctgagtcattttctctctaattgtgatgaatgtgcccctatttagttacattctgtggcctggtctcctttgtcaacagtaggacatattaaggagacagctggtcagtaataaaagagatacacttgggtatacaattaactaggcaatgtacagaatatgataatttctcttaagaagacgatctgttatacagctaaaaataggcaaygtctaatattcattattatttatcttattattgaaggaaatagtctgtcactttttaaaaagcaataaactaaataatgggaaacaaattttttgataccaagttctgggatggatacatttttgtcaccaataaaattctctctttctgtatctttccatactaaaagttgttcttattagcctgtgtacttatgcactcatgtagatactgccaggtttatttcactctttccaaatttttcaaatattttaatcataagtgaatttagagatcacacacagatttcatgctttattc

SEQ ID NO: 17767 - DNA, 601 bp, Human
acagatttcatgctttattctcatgttttgtctagggtctccatggtgagtttggtctccctggtcctgctggtccaagagtaagtgttacttcattaactttcataaactctggcaatgtgtttttaaaagtagtagtgctttctccttaaagccactgatgaccctgcaacaagtctctgatgctcttctatagtcaaatgtaatctgtagaaagcattagatttctaagttgatagtagaattttttgtttcattgctcatatttcctattcaataattacatagttataagaaacamataaatcaatatatattatagtcagtgatttatatagacaactatgctacatttgtgacagtggctcaacttgagctaaggaaaaataatatgttactaagatataaagttaattttggccatgtgtgttgatgttcaaagcctaaagccgaacttatgagtagtcatataaagaaaaaaaaacttagtttctctatgggtattagcatcactgaaatgattaatttgccctgaaagtattccatcatgtcactagttaacacatatgtaggaagctcaaagaaccaacttataacaagg

SEQ ID NO: 17768 - DNA, 601 bp, Human
atttgtgacagtggctcaacttgagctaaggaaaaataatatgttactaagatataaagttaattttggccatgtgtgttgatgttcaaagcctaaagccgaacttatgagtagtcatataaagaaaaaaaaacttagtttctctatgggtattagcatcactgaaatgattaatttgccctgaaagtattccatcatgtcactagttaacacatatgtaggaagctcaaagaaccaacttataacaaggtcctttgaaacagttacaacgtggacctatgtgataaatattttgggctayagaatgctatgctctagtgatatttagatgtaaattgggagatatttagatagacagacatatatatatatacacaaatacatatatcaaatatacatatgaatattgtaactgttatatcattattacacagggttataaaaagggggcatagataggagaatatctaatgttatctacacctgccattgctattcaactaaaatgacacaatcttttctttgaatactacacataactggcatctgtttttacctatggatttatcacagaaaagactcctcaaagaaggggaatgaa

SEQ ID NO: 17769 - DNA, 601 bp, Human
ggctcaacttgagctaaggaaaaataatatgttactaagatataaagttaattttggccatgtgtgttgatgttcaaagcctaaagccgaacttatgagtagtcatataaagaaaaaaaaacttagtttctctatgggtattagcatcactgaaatgattaatttgccctgaaagtattccatcatgtcactagttaacacatatgtaggaagctcaaagaaccaacttataacaaggtcctttgaaacagttacaacgtggacctatgtgataaatattttgggctatagaatgctatgytctagtgatatttagatgtaaattgggagatatttagatagacagacatatatatatatacacaaatacatatatcaaatatacatatgaatattgtaactgttatatcattattacacagggttataaaaagggggcatagataggagaatatctaatgttatctacacctgccattgctattcaactaaaatgacacaatcttttctttgaatactacacataactggcatctgtttttacctatggatttatcacagaaaagactcctcaaagaaggggaatgaattgcaaaaattg

SEQ ID NO: 17770 - DNA, 601 bp, Human
ttttcagatttttatttatttccagttctgtgatgacttccctctcagtaaacagcaatccgattccagtggacctgaattattctaaacaaacaaacaatagcaacaaactgtgggggaaaattcagagttcccaaaacataaatgaattagtatgggttgtcactcttttctcctcacgctgtttatgcttttgttttaatctagaaacattgtattcattggacattattttcagagaaaataactttttatcttaacatctcatcccatagagtaaaatttcaacaagtagtctgamttttaataataagagtttatgatgatgaaaattcattgggcaatacattcacccccaaaaatttgtctggaaacttgtgttccaaaatagaatctgtggtttagattttaaaatagatttaatatacattcctgaaaaagagattaccttaaccacaataaaaagaagacaacacatattattttcattcttaactctaggggaaaaaatgtaaacattagttgcaaaaagctattttagtgtatggaaggatgttcttgggaaaaaaataaaaacataaaagggagagaggaaataaag

SEQ ID NO: 17771 - DNA, 601 bp, Human
gtgagtagaattttgtttgtatgtttcttcgtacttggattttttttttatgtttgaattgagaagttttccaaattagaactacacacactttatttatcaagtttaataaaataatattcctttctctcctgggtctatgactaataatatcattttacatgttccaaaggaaaaattaaatgggatttaacctctttgaaaataatatcctgaattttctaacttccctagtgtcaatgataccaactacaaactatagaccaaaagctttaggtttaatagaatattaaatgattgyttcaagtgataacagagattaaaataaataaataaataagtctcctatgctttaggaagccgggacctctaacaagattctatagttattcaaacctactccctagaaatttatcacccaaagagcagccccaaagattagctgttaatgccatgaagatgccaaagataatcccatgacagtctaattaccttatctcgtatgtcagcctcatgggtcttctaggccacagtcggcctggattcctttattcacctctccttcagagctgaaaactgactgtagcacatctgtaatagt

SEQ ID NO: 17772 - DNA, 601 bp, Human
agttttccaaattagaactacacacactttatttatcaagtttaataaaataatattcctttctctcctgggtctatgactaataatatcattttacatgttccaaaggaaaaattaaatgggatttaacctctttgaaaataatatcctgaattttctaacttccctagtgtcaatgataccaactacaaactatagaccaaaagctttaggtttaatagaatattaaatgattgcttcaagtgataacagagattaaaataaataaataaataagtctcctatgctttaggaagccggracctctaacaagattctatagttattcaaacctactccctagaaatttatcacccaaagagcagccccaaagattagctgttaatgccatgaagatgccaaagataatcccatgacagtctaattaccttatctcgtatgtcagcctcatgggtcttctaggccacagtcggcctggattcctttattcacctctccttcagagctgaaaactgactgtagcacatctgtaatagtctttcttttgaatcacatagttctaacagtttcaaacaaggctactcatttgctgctctccagg

SEQ ID NO: 17773 - DNA, 601 bp, Human
acacacactttatttatcaagtttaataaaataatattcctttctctcctgggtctatgactaataatatcattttacatgttccaaaggaaaaattaaatgggatttaacctctttgaaaataatatcctgaattttctaacttccctagtgtcaatgataccaactacaaactatagaccaaaagctttaggtttaatagaatattaaatgattgcttcaagtgataacagagattaaaataaataaataaataagtctcctatgctttaggaagccgggacctctaacaagattctayagttattcaaacctactccctagaaatttatcacccaaagagcagccccaaagattagctgttaatgccatgaagatgccaaagataatcccatgacagtctaattaccttatctcgtatgtcagcctcatgggtcttctaggccacagtcggcctggattcctttattcacctctccttcagagctgaaaactgactgtagcacatctgtaatagtctttcttttgaatcacatagttctaacagtttcaaacaaggctactcatttgctgctctccagggaattttacaatagcggaa

SEQ ID NO: 17774 - DNA, 601 bp, Human
gattaaaataaataaataaataagtctcctatgctttaggaagccgggacctctaacaagattctatagttattcaaacctactccctagaaatttatcacccaaagagcagccccaaagattagctgttaatgccatgaagatgccaaagataatcccatgacagtctaattaccttatctcgtatgtcagcctcatgggtcttctaggccacagtcggcctggattcctttattcacctctccttcagagctgaaaactgactgtagcacatctgtaatagtctttcttttgaatcacrtagttctaacagtttcaaacaaggctactcatttgctgctctccagggaattttacaatagcggaaagttcagatctcccaaatttctgacctgctattgacttacacatttccataacctttattactggagtaccctccttctgagagtggcttctaatagtcttgttaattagaaccaaaatacatcagaggccttctagatatccaaccagagtgcagtgaaagtgttcagtcactgtataagcacagaaaaaaagaatgacaaggttcacttttgatgatacggggtgttattaa

SEQ ID NO: 17775 - DNA, 601 bp, Human
ccagctatctgatctatactctaatccctagcatttgttttaaagtctctccatgttgcgcattaacaatatcctaatgcactgaggcttctcaaagccttcaattattaccaaaaaatcaataaaatacatagtgtgcccatttcacattgaactctccacttaaaatagatcttatttattgtattgcaaagattgccacaaatagatcagccccgtgtccatctaaaaattaaaatgtcctcctcctggtattgtaggcactgatttatagtgttttctcaagtgtataacccatacyacttaacccccaaaatgaatatagcattaagtaaaaatccacttcattttactctgtgagatgtgcgtcagttatctcttccaaggcaactacagactctgtctgtccaccactgttctctctccctcccagttctttgagcatctatgtcaggcacattaacagattcatctttggtcccattatagggcgaagctggggctgctggtcctgctggtcctgctggtcctcggggaagccctgtaagtaagaacctgggtcattttgtatactcacacctcacaatgtttagacattgat

SEQ ID NO: 17776 - DNA, 601 bp, Human
cttacttagacacacactataaagacacagcttaaaattatgcagaatgatttttgttctttccacgcacttaggaacgatacaatctctaattgcgtttactcctctgcaatatgaaatgctggcatcatttatcctgtaggaagaatgaaactctggaagttctgaatcgttccattaaaccttatacgtgacaacaactagaaaccatctcatctccataaaatatatcaactttttgaattcatttcatttgggatactgaatgacacgaggctcactttttacagagcaacatccygtgattacataaagctggccatctacatgtggagaaggagggcagagatgatactaatgatacttcttaccattgtgtgacccattcacattcaatttaccttcttccttcaaactagaatctcctgagtagggttgttttggaggggaaggttagcattccatcgaataaggggaatgtcattttatcttctctgcctgtttagggtgaacctggtcctcttggcattgccggccctcctggggcccgtggtcctcctggtgctgtgggtagtcctggagtcaacggtgctcctggtga

SEQ ID NO: 17777 - DNA, 601 bp, Human
atgtctcttgacatgtgctctgaaagtgtgattttcctcttctgtctttaaagggtcaccatggtgatcaaggtgctcctggctccgtgggtcctgctggtcctagggtaggtggactcaagagaagacagttcatctctgaaatagaggctaaagcgagcagtgagccccaggctgctgctcccttggtgggattcaccagctcacatgtacctggtgtctgtcttccttagggccctgctggtccttctggccctgctggaaaagatggtcgcactggacatcctggtacagttggacmtgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaa

SEQ ID NO: 17778 - DNA, 601 bp, Human
ttaatcaaaccttttcaccaactttactgaatgcctactggaattccataaattacaaaatgacagaaaaagaaaaatgtcagaatttctacctcctcattctcttattctaaagaagaagcatatgcaaaaaggattaattgaaacagataacttttttagatgaccttgcctcagtctagtaggtcttatgttcatctaggtaactgatacttcaaagacaagtgaattaagttttctttaaaagtacccttttcctaagcttggatctgagtctactcttcctgagatctttttttttcttttttttttttttcatgtttgactcttagtatctgagtccttctccacttaactggaatttcatcctattttctgtagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttaca

SEQ ID NO: 17779 - DNA, 601 bp, Human
taaattcagatgataaattcagagtattcttatcagatagtgccttctgaaatgctgaaatgtatactatgtccatgcattgttttttctttagcatgttttttaaatggtaatgtgtgcccagaacttaaaatttcttgagacttcagtggcctaaactataatttatagttatgtgtattttattttacttattagtatggcctacatttaacttttaatgctttttctacaatatgctataaatataagaaaaattaaaattcactaacagcaagactacatacccacccaggtcccrctcccaaagacacacatagagggacatacacacaacaatcctaaaaatgactttgtagagataggtcacttggaatgtgtgttgaaatgttgttggtttttttggtttgtttgtttgtttgttttttgttagactgatagggagcccctcccactaaagacacccttgatactgttatttcaaggatgaacttatttatctgggacagacatcttcagaatgacacatgccaaacagtggttcttattaaatcaaaggttcagatattatcagattcagaaatagtgatgctttgtgtat

SEQ ID NO: 17780 - DNA, 601 bp, Human
aaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccycgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagt

SEQ ID NO: 17781 - DNA, 601 bp, Human
ctgccggttgggatttattcagctgtttctaaacaaaaccctttctctttccctcttcctagggttgtgtctgtaaagacaaaggccagtgcttctgtgacggggccaaaggggagaaggtaaaaacaaaccctaatactgcttgtttacactgtaaagctctagaaggtaaaactcaaccttcttctttcatcggtagcagaaagatccgcagtatgttgttccatttcccaaatccaatgttaaagtaattgtatataaacattaacctaaaaaaaaaaaaaagaaaaaagtcatctakgaagcttcagataccttgtatatacaatggcaattaaattacaactctctcggtctgtaaagaataagtagcaaatgagaaaaagaaaaagaaagtttatgacaagtctccatatgtatacactatttacaatgttgctaaacacaagagaagaactgaaaacgatttgattcattcactttgacagaaaataaacattgaaattcacagatttttgtcctgcagcattggttcaagttcgccccctggtggagaaatcccacagcagcacactggttgaggcaaaacttagcagaggga

SEQ ID NO: 17782 - DNA, 601 bp, Human
tgccggttgggatttattcagctgtttctaaacaaaaccctttctctttccctcttcctagggttgtgtctgtaaagacaaaggccagtgcttctgtgacggggccaaaggggagaaggtaaaaacaaaccctaatactgcttgtttacactgtaaagctctagaaggtaaaactcaaccttcttctttcatcggtagcagaaagatccgcagtatgttgttccatttcccaaatccaatgttaaagtaattgtatataaacattaacctaaaaaaaaaaaaaagaaaaaagtcatctagraagcttcagataccttgtatatacaatggcaattaaattacaactctctcggtctgtaaagaataagtagcaaatgagaaaaagaaaaagaaagtttatgacaagtctccatatgtatacactatttacaatgttgctaaacacaagagaagaactgaaaacgatttgattcattcactttgacagaaaataaacattgaaattcacagatttttgtcctgcagcattggttcaagttcgccccctggtggagaaatcccacagcagcacactggttgaggcaaaacttagcagagggaa

SEQ ID NO: 17783 - DNA, 601 bp, Human
ccccctggtggagaaatcccacagcagcacactggttgaggcaaaacttagcagagggaagtagctccattgcagaattcaagaaaaaaaggaatgccgtgaaatctcattaattcgctccattaacttgcaatttgtgataattaagatagaggcagaactaaagtttttttctttgtttaccaaaccctttcctcagagacactaattaattgtttaacaacattgaaggatgactattttaaaatattttaagaacatatttaagctctttatctaaactaatttctatataatgtgyatgctaattataataattatacttattttaaattatttcataattcacatgtagttggatttaggttttttcttgaatctgtgaatgtattctaattcaggttcccattgagaagcactttctctgtgattctccttgcattcaagaagcatttattgagtttctattatttgcaagatgctattctagggtgtataaaagtaactgagtagcgagaggggtctagcacattcttttagttctcttcttgttgagtgtgtgtgcacacacacaatgtaaaatagctgacttgttcttttt

SEQ ID NO: 17784 - DNA, 601 bp, Human
ctggtggagaaatcccacagcagcacactggttgaggcaaaacttagcagagggaagtagctccattgcagaattcaagaaaaaaaggaatgccgtgaaatctcattaattcgctccattaacttgcaatttgtgataattaagatagaggcagaactaaagtttttttctttgtttaccaaaccctttcctcagagacactaattaattgtttaacaacattgaaggatgactattttaaaatattttaagaacatatttaagctctttatctaaactaatttctatataatgtgtatgytaattataataattatacttattttaaattatttcataattcacatgtagttggatttaggttttttcttgaatctgtgaatgtattctaattcaggttcccattgagaagcactttctctgtgattctccttgcattcaagaagcatttattgagtttctattatttgcaagatgctattctagggtgtataaaagtaactgagtagcgagaggggtctagcacattcttttagttctcttcttgttgagtgtgtgtgcacacacacaatgtaaaatagctgacttgttcttttttgtt

SEQ ID NO: 17785 - DNA, 601 bp, Human
ccctttcctcagagacactaattaattgtttaacaacattgaaggatgactattttaaaatattttaagaacatatttaagctctttatctaaactaatttctatataatgtgtatgctaattataataattatacttattttaaattatttcataattcacatgtagttggatttaggttttttcttgaatctgtgaatgtattctaattcaggttcccattgagaagcactttctctgtgattctccttgcattcaagaagcatttattgagtttctattatttgcaagatgctattcyagggtgtataaaagtaactgagtagcgagaggggtctagcacattcttttagttctcttcttgttgagtgtgtgtgcacacacacaatgtaaaatagctgacttgttcttttttgttttaatttgccaattgtgtaactaaattgacccaattaaccaaatcagccggtggcctttactgttgaagagtacagtcggccctccttatccacggtttctgaatcctcagaatcaaccaatggcatactgaaaatacttctgggagggggggatataataaaaaataatacaacaattaaag

SEQ ID NO: 17786 - DNA, 601 bp, Human
taatttctatataatgtgtatgctaattataataattatacttattttaaattatttcataattcacatgtagttggatttaggttttttcttgaatctgtgaatgtattctaattcaggttcccattgagaagcactttctctgtgattctccttgcattcaagaagcatttattgagtttctattatttgcaagatgctattctagggtgtataaaagtaactgagtagcgagaggggtctagcacattcttttagttctcttcttgttgagtgtgtgtgcacacacacaatgtaaaayagctgacttgttcttttttgttttaatttgccaattgtgtaactaaattgacccaattaaccaaatcagccggtggcctttactgttgaagagtacagtcggccctccttatccacggtttctgaatcctcagaatcaaccaatggcatactgaaaatacttctgggagggggggatataataaaaaataatacaacaattaaagataatacaaataaaaaaatgcagtataacaaccatttgcaaagcatttgcattgtattaggtattataagtcacctagagatttaaggtatatgg

SEQ ID NO: 17787 - DNA, 601 bp, Human
ttcctgcctaccccctggctgctgcaaacctggagagaattccacatcttagccaactgctaggtgcatggtgaactcctggtttccggtattagtgggccacatagaaccgcaacctgctccaagactattgcaaatgatcatcattagcttcaagtctgtggctccagttcatctccctccctaacctacagtgtctacatctgcatctgttcctacctctattcctcctacagtgaaaactcagagctctttttgcttctattcaagacctgtccaaccacctgtgccccatctttgrgattccttgttccacgaggtgcctcccctctctccggacattccaacttttcttttgttattggcttttctctttcagttcttaaacatgcaaatattttccatgataatacaaaacttcctctccatcttttaggtcttgtgaccaaaggattgctatcttctccctgactttcctttctctgtcaaacttcttaaaagaatagtcaaacatgctgcctgtagttcatctactattcagtccttagcaataatttgccttctaccacctctcctctgaaaacactccagcaaagatcac

SEQ ID NO: 17788 - DNA, 601 bp, Human
caagacctgtccaaccacctgtgccccatctttgggattccttgttccacgaggtgcctcccctctctccggacattccaacttttcttttgttattggcttttctctttcagttcttaaacatgcaaatattttccatgataatacaaaacttcctctccatcttttaggtcttgtgaccaaaggattgctatcttctccctgactttcctttctctgtcaaacttcttaaaagaatagtcaaacatgctgcctgtagttcatctactattcagtccttagcaataatttgccttctacmacctctcctctgaaaacactccagcaaagatcaccaatgacctttaagtggccaatgccaatacatacttttgtgtcttaatctgacctgaactcctctgcttagtttcaaattgtgtggatcgctctcctctccttgaaacacttgtctgtctttctttctgtatttctcctgtctctctatccttcccttcctttgtgggtttctcttttccttctggtcccttaaacatcccgagtctatgacccttcacactcatcacacattcttatcctaaagtctgtgatacagcaaagggct

SEQ ID NO: 17789 - DNA, 601 bp, Human
tccacgaggtgcctcccctctctccggacattccaacttttcttttgttattggcttttctctttcagttcttaaacatgcaaatattttccatgataatacaaaacttcctctccatcttttaggtcttgtgaccaaaggattgctatcttctccctgactttcctttctctgtcaaacttcttaaaagaatagtcaaacatgctgcctgtagttcatctactattcagtccttagcaataatttgccttctaccacctctcctctgaaaacactccagcaaagatcaccaatgaccttyaagtggccaatgccaatacatacttttgtgtcttaatctgacctgaactcctctgcttagtttcaaattgtgtggatcgctctcctctccttgaaacacttgtctgtctttctttctgtatttctcctgtctctctatccttcccttcctttgtgggtttctcttttccttctggtcccttaaacatcccgagtctatgacccttcacactcatcacacattcttatcctaaagtctgtgatacagcaaagggctttgtttaaataaataccatagaggatttactaaataactgaataa

SEQ ID NO: 17790 - DNA, 601 bp, Human
aggctgcagtgagccatgatcatgctactgcactccagcctgggtaatagagcgagactccattaaaaaaatatatacatgtgtgtgtatatatatatatgtattaaaataatgtatgaaatatgtaaatgataatcaaagccaaagccaacctactgcatatgtactctgtgccaggcattgggccatctatttctccctggatctcatttactcctcacatcaatcccacaaatcatgactgtggtgatttacaatgtagttcccatcattacctccactacatggatgagaaaacagrcacagagcacttgagtaatttttcctgggtcacgcagctcacaggaagcaaaatcagagttcaaacctggtttgacactgtgtgtgggattttcctcaaaccaaacaattctccaactctctggatgccaactgggtacccctcaattcagttatgacattaaatacctggggttagtgcagaccccatagggtaagggctcagtcccacaagactgtccctgcttcaggactagtcataagtagtgggtcctcagttacccataatgccgtccaacttggctacaaataaatcaggggt

SEQ ID NO: 17791 - DNA, 601 bp, Human
agactttgctttgtaaggccgtgggaggtgtacagtggggagaggatgcacaatagcagagagggcagagcagaccgagtaggagtgtgtgcgtttgatattcctctagttgttcataggttgcttttttcctagggtgctgctggtttgaaaggacaaaaggtaagtcattggtggaatgctgtcactgaaaatctctaactgtacatatgaaaaggacgtctattaaataatgagacttaagtcattacaaataagatttcataatccagaccttaatcattcagaaacaataataatygggacatgatatttattcctattaaatagctccttctggctcttgtcataaagagtcttaaggatacaggttttgtatcactgttgaaagaaatagggtcttggagaagaaaactgacctcatgctcagggccccacattctagggcagggattgtcactatttttggtatcttgggaaatgttttattacccctgcgtctttcttctttccactgtaaattttttatttttttgagatggagtcttgctctgttgcccaggctggagtacagtggcacgatctcagctcactgcaacct

SEQ ID NO: 17792 - DNA, 601 bp, Human
aatcccattaatgagagagaaacactcatggcctaatcacctcctacagaccctacctcttacttctatcacattgataacacctgaattttggagggagcacattcaaactatagcagttcctaaatactttagtggagttgccaggaagattaaataagtattttgtgaaatcacttagcactgtgcccaacacttggtaggtgcacgcatatcattacagatttcatggtggacattattatgttatattattaatataatacttttgtgattttatatatattgcttaaccacaagrctcttgttaaataagtcaacaaagtaattgatccatctagcatatgaaaaagcaaagaggttttttttttttcaaacctttgatatttccaccttttttccttcaagataaatatactgaatgctaaatgaaatctaccttttcattacatttcagaggaattcttagcactcttcactgtatattttcttatattcaattccatataattctgtttgcagcttctactaacctcaaaagaagttccacttaggaaggaaatggttaagaacaccagcagtaggtccactgagcatgtca

SEQ ID NO: 17793 - DNA, 601 bp, Human
attgataacacctgaattttggagggagcacattcaaactatagcagttcctaaatactttagtggagttgccaggaagattaaataagtattttgtgaaatcacttagcactgtgcccaacacttggtaggtgcacgcatatcattacagatttcatggtggacattattatgttatattattaatataatacttttgtgattttatatatattgcttaaccacaaggctcttgttaaataagtcaacaaagtaattgatccatctagcatatgaaaaagcaaagaggttttttttttttcaaacctttgatatttccaccttttttccttcaagataaatatactgaatgctaaatgaaatctaccttttcattacatttcagaggaattcttagcactcttcactgtatattttcttatattcaattccatataattctgtttgcagcttctactaacctcaaaagaagttccacttaggaaggaaatggttaagaacaccagcagtaggtccactgagcatgtcagaaacaatattcctcgattcttgcaggtcaaggattccctggaatttaaagaaacaataaatacagtatttt

SEQ ID NO: 17794 - DNA, 601 bp, Human
caaaggaaaataagctgtcctctattaagtttacattatttacataagacaaatgtttcattaactgatctagaagtgtttccaggctgggttcaatggctcacgcctgtaatcccagcattttgggagaccacggcaggtggatcacctgaggtcaggagttcgagaccagcctggcaaacatggcaaaaccccgtctctactaaaaatacaaaaaaattagctgggcgtggtggcgtacgcctgtaattccagctagtcgggaggctgaggcagcagaatcacttaaacctgggatgcrgaggttgcactgagctgagatggcaccactgcactccagcctgggcaacagtgagactctatctcaaaataaaataaaacagtgttctcagcttcttaaattgtcatctttgcaatttatagtggaagaaggagtggagctgatacaaactgatacagaaatgctctttttctcttctcagcagttttaactatttgcaaaagctttattgtccgggatttttacagtgacttttggagtatgagcagggaccttgaaactcagaggaggtacagaaatagaaaacaatgtcatggtaat

SEQ ID NO: 17795 - DNA, 601 bp, Human
atggagttaggggtgaagagagattggttaatgggtacaagcatacagctagatagaaggaataaattctaatgtttgatagcacagtagggtgactatagttaacaacaatgtattgtatatttcaaattaactggaagagaggacatgaaatgtactcaacacagaaatgataaatacttgggtcaaagatactcaaaaataccctgacatgatcattacactacacatttgatacatgtaacaaaatcttacatgtatcccataaattagtacaaatctaatatgccaaagtaaaatrtgattaaaaaaatacaaaactctgaaatggatgtcaatcagaagattttatctttgtgttcaaataataggacataatcagatattaccccggctggtttctcagtcctttgctggtggcatctctcttcttaatagttaaactgtttgtgggacagagatttgagactgtcccctcctcacatcctcaccactttaagattagggtggggttcgtgccaccaggcacggctcctttcccaggagatgactatcccccatcacagccttttatgtctaagacactggcaggaataaagtc

SEQ ID NO: 17796 - DNA, 601 bp, Human
aaattttcttgtgggaatggaatgttctgcacttcactgtactgtggttatttaacaaggccacagatgaaaaaagcaaggatattcacttttttattttatatgtgttatgtacctctccattgtgcaatttttataaataaaattaaatcactcttgcaattaaaaaataaattcgtattaatcaggaaaaaatgtaaaatacaagaaatgattattttctccaaggatcatcaaggcctggcctcagaggagcccctggatggccaggcttgaaaggaagtaaaggggaacgaggccrcccaggaaaggatgccatggggactcctgggtccccaggttgtgctggttcaccaggtcttccaggatcaccgggacctccaggaccgccaggtaaagatgtggaaggggaccccttttgtgcacagtgccaaatgacagatgtgtgcaaaccacgggcaacaaaccctcctcacagcttagccatcagtctgtgtggtttttatgagttacctttccaatggtcttcatttcactaactgtctgtgaaagaaactgatgcaatgactagttaacaaatgcagcaaagtcttagcctgag

SEQ ID NO: 17797 - DNA, 601 bp, Human
taagataaaataggttgattctgtgaccaaaaaaaaaattatacaatgagctttcaaagatcaactaccttaaaaataccacatctatgtaatatgaagggaagagctggtcaccatgctttctcagttgcagataaacttctaaagactaggcttccaatacaaagatgagagagatgcattttaaataatacatatattacaatacttgctaattgaaaaaaacacaaataaaaaattgtctttggtgctgtatttttataggtgacatcgtttttcgcaagggtccacctggagatcrcggactgccaggctatctagggtctccaggaatcccaggagttgatgggcccaaaggttggttcaatcaataatgttgtattaggataagcctttttcatcgtcattattatcactgatttttccccctgagataacaatgatcccaaatagctaccagtcagtgatgacttattttccattagctaaaagtattcatttatctgtaaatcaataatttatttggcacccatgcaataaattgttggatatccctaaaatgtgagtttttgcctgcatgcaaggaaagaaacactgaaat

SEQ ID NO: 17798 - DNA, 601 bp, Human
tttaaatgtaataaatgatagtgtggttggaaaatatttgttctttctgaggactcaatgtagctttttaagtaatgctagtatgctctcattgcaggagaaccaggcctcctgtgtacacagtgcccttatatcccaggacctcccggtctcccaggattgccagggttacatggtgtaaaaggaatcccaggtacaaacaatttgcatgcaagtgtttttgcaagcacaaaagggtcaatacactggaagaaaataaaggcattggattggtggatgtcacaacgtggtttagatgaamttggagggagagtttcaaaaacatatattctattaacataaagtcagccaaaatccaagaaaagctggtatttttccctattccattttagttgctgacccctagcaaagtattgtgttaggcaggaattgtgaacacagagtcctacaagagaacagcagttaactgaaggcagtgaagcagctgcatgaaacacacaccctctttctcttccataaagaaatatgctctctccctttttttctcaaaagacacaaccctactcagtccattttttcatgttcctacttttaaaagagt

SEQ ID NO: 17799 - DNA, 601 bp, Human
aagaaaatgaaggagggaaataaggaggaaaaataataaaagataaaaaatcattattttcctatactctccttgagtctcctctttggctcaaggggagcaggtgagcagctcactgatgctgaccacttattgcattgttgcattttccatagtttctctacatttggcctatccaggtgcagctcaaagaagatatgtaagcagtaaaatggtttggatcactataaaaagatacaccccagctcaagatcttgcaaaaaatagaatctgaataaatatgtgttgattaactgaccaragacccacccagaaggtcatttaaagggatcatcttgatagagatatttaaatacctatgggaagtataaaattgtacaataaaatgcaatttggcaagagacattcaaaaccttagaaaagtttgagactatttggctctgctattacacttttaaaaatttattataaaggaaataattggataaatttggagagctaaatacccagagacatttttcaaagcattgttcacaacagctaaaagttgaaaaatgtctacctaatgtctaaatgtctaaaaacagcatttagctaaata

SEQ ID NO: 17800 - DNA, 601 bp, Human
ttcacaacagctaaaagttgaaaaatgtctacctaatgtctaaatgtctaaaaacagcatttagctaaataaatgatggctcgccaacacaataggcagcatgcagccatttaaaacgaagctataaattcatacttattgacatatgtatactataaatccaaaatagtgtgtctacgagtcctatgcacttatggatataaaaaatgtatcattaatttacattaaactttggcaaatattatcttctggtagatttataggtgatttttagtctcttctttctgcataattttcttawaatgagcatatattacttttaaaagtaatatatactcagaaaaaataaagatatattcttaaaattatgaagataaaattttaagaagctaagatctgagttactttttacatgatctcttgttctgttatttactcccattctcttattgcatttatgttttatgatagaagttgtctttctttccccacaaggaaacactctattttcttcatacattgtattaccctgtctacttagagttggcgttcaatgaggagttagttaataattcgttgatttgcaggaagacaaggcgca

SEQ ID NO: 17801 - DNA, 601 bp, Human
ttgaaatggtatcagaaacagaaagcagattagtggttgcctagggctgagagtgggaacagaggttcattgcaaataggtttgagggaatttgggagagtgatggagatgtttgaacgtgattgtggtgattgtggcataattctataaatttactaaaaatcattgaattgtactcttataaaggagaaattttatggtatgtaaattatacctcaataagtccgttaaaaattagaatcttgactgtcatagtgaatcaaaaagttatagataaatatacttagatcaaactattcaragaggcttgttaaaatttaccaatattcaaacataacctgtattatggtgattgttctatggtattaaattatattattgtctgtattgctttgaattatactatctaactgaattatttttcagttttggaagttaacaacaaagcaaaacaaacaaaatgcttgtaataatagttgtggaccaaagagtgtgttgaaaaaattcatgttaaaattgaaaagttcttgtccacactgtttttaagattgacagaagaagaattctaacaaaatacaatacagattcatttgtgtactac

SEQ ID NO: 17802 - DNA, 601 bp, Human
caactttaccctccctataaatgaagtactctgaagttaagagataaagtgatttcttttccaaaaatggttggccgctcagcacagttcatcactctaactgcagaatgaaacatcttcaaattagcaggaataacccaagcaaatagttatagtattttgacagaataaataggtagcattcagtgatttcaaccaatcaaaattctacattgataatgaccccatctcatacacaaattacagttccatatttgtatcaaatgagtctatggaaaagttcagaaaatgatgtatagtrgaaagtttagtaaatattttggggcgatgtccatatttttaaataaaaataaatgcataagaagacagcatatttaggggtatggtagtcaaataaagagattaaatgttttgtcattcatttaattttatggaaatttaatcccttttcatgagagagtttctcacatatttaattgaggtaatacctaccaagattttttttttttttttttttttgagagggagttttgctcttgttgcccaggctggagtgcaatggtgcaatctcagctcactgcaacctccatctcctgggttc

SEQ ID NO: 17803 - DNA, 601 bp, Human
tgagcacctgtcatcataatgtatttacaagaggtttgcaagggatgctgcccaaactattactatgaaataccagtttctcccagggctaatctgtgttagccaataaaacagatcttacctcaaagaggtttggagaaacttggtaaacaaatttaaagattcatttacagaccctttaatatcagaatatgaactgtgagtcttccacatgaagataagctatctggtctttcctaaatgcttctgactacaaaaccctttttggctggcagcatctatggtgccagcagttctcagwccctgccttggccaagtcccaggttgttcactttgtggtagttatgcttataaagtgacagtgccagaattctgatggtctaatattaagagaatttgtatgatgtccctacttgcatctcactgatttttctttataagttctggtaaagatgctccataaagtaaatgagagaaaaatcaaggtggtgatttgttgagtcttacaccctgtcattaaaaaaggagacagaccacttagccatctgatgatattgaacaatgaaaaattgagtcaaatttatttcagagggccatgttg

SEQ ID NO: 17804 - DNA, 601 bp, Human
ctggtctttcctaaatgcttctgactacaaaaccctttttggctggcagcatctatggtgccagcagttctcagaccctgccttggccaagtcccaggttgttcactttgtggtagttatgcttataaagtgacagtgccagaattctgatggtctaatattaagagaatttgtatgatgtccctacttgcatctcactgatttttctttataagttctggtaaagatgctccataaagtaaatgagagaaaaatcaaggtggtgatttgttgagtcttacaccctgtcattaaaaaaggrgacagaccacttagccatctgatgatattgaacaatgaaaaattgagtcaaatttatttcagagggccatgttgggaaggaagagggcttaaattattttgtcaaattcaatttcttttaaatctacaaatcattttcaaggttatagcatatgaagatttaaaaactagacagtttatgagagaaaatggaagtgggaaatcccctttgtcatgaaaatacctggtgaaaccagaaataaaggtttgctgtgctcattttatttcagaaatgtaacattatcatgaatatcaccactaa

SEQ ID NO: 17805 - DNA, 601 bp, Human
gtgggaaatcccctttgtcatgaaaatacctggtgaaaccagaaataaaggtttgctgtgctcattttatttcagaaatgtaacattatcatgaatatcaccactaaagtcatttgaactattggtcaatttgaacatagttttagtggctattaccatatgggagacccatcattgtaagatatctcaagtgggactcaagacagttccaagttcaaaaaatgttgctaaactccaaaggacacaaaacggaagaaacctgcagtgctcttactttagtaataattctcatcaaatgccmaatgcttttaattcaagatctcaatgacagcctaactggtattcatatttggaggatgattaacctgttgtaagaatatactggaatgaagcacgattcaaacacattcctgttgtcacaggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggttggttagt

SEQ ID NO: 17806 - DNA, 601 bp, Human
ttcataaaagcatctctagctggttgagagataagagagttactgctcagaatatttcaataagactaatcctacaacaatgtttattgttttttctctgtaggagaccaaggttttccaggtacaaaaggatcactgggttgtcctggaaaaatgggagagcctgggttacctggaaagccaggcctcccaggagccaaggtatgcaaaaattcaagctatcacagaagagagggtgggtgaccattaactggccagtttgtatgcacttatctggcagagcactctagatgtagaaatkatcaatatatttgtagatgatgaagatattaaattttttaaatgtttctctggatcatcttccattttagaaaggaaaacataaggtgtcagaatgcagatttcatcgtgatatcatctttaatggtttcataaataatcagagtatttaaaatgggacaactctagaaagaaatgtggttagctataagaaaaactatcaaaagtaaaaacatctagatttttctctttatagacaatcccacagtcttctgaaaaagtggaggctacatatcctgaagtattattaaacataatctta

SEQ ID NO: 17807 - DNA, 601 bp, Human
ggactccctggacttccaggtctccctggaactccaggaaatgaagggcttgatggaccacgaggtacaatagcaagtgtcattacttttctccactgtgagctctgctaaaatgcagcaaactgaatgtgaaggtgttctaggcatgaagaattctcccatccaatgttcctgccctacctttcttccttctttccttcttccttccttcttttttaatgagtgccctctagaaaaggcatattaatggcagtaaatatagatctgatttaggtggaaaaaaagttaacagaagaatgaytggtacagcaataccaagaccttaagttctagcacctgggtatatacttgtgctttcttttgcaggagatccagggcagcctggaccacctggagaacaaggacccccaggaaggtgcatagagggtcccaggggagcccaaggacttccaggcttaaatggattgaaagggcaacaaggtaggaggagggcctcaaaactggccaccagaagggcaggagacatgagactcctgctctgtgctttgctgcttaacatgggaactgtccagccacaagtcctgaccactgttcaatgaga

SEQ ID NO: 17808 - DNA, 601 bp, Human
tagctgggattacaggcacctgccaccacacctggctaattttcttgttaatacctggtttctaacttcaggattcgcaggaaatccaggtgagaaaggaaacagaggcgttccagggatgccaggtttaaagggcctcaaaggactacccggaccagcaggaccaccaggtacagctgattctcaaatagaaaaatatcacattttacactttcctacatctaaagtaataaaagttgtttctaggcttactgggtttaaatatcaattctgttctgatagtgttccagcagaaatttgytactaaattaactaaaagaaggtgttgatagttggcgtgtcattaactaacatacattaacctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccatctcagtaacaaaatatatgacatggc

SEQ ID NO: 17809 - DNA, 601 bp, Human
tcttgttaatacctggtttctaacttcaggattcgcaggaaatccaggtgagaaaggaaacagaggcgttccagggatgccaggtttaaagggcctcaaaggactacccggaccagcaggaccaccaggtacagctgattctcaaatagaaaaatatcacattttacactttcctacatctaaagtaataaaagttgtttctaggcttactgggtttaaatatcaattctgttctgatagtgttccagcagaaatttgctactaaattaactaaaagaaggtgttgatagttggcgtgtcrttaactaacatacattaacctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccatctcagtaacaaaatatatgacatggcaataacacttcaggatgcagttggaaatgtattaccatatgt

SEQ ID NO: 17810 - DNA, 601 bp, Human
ctaacttcaggattcgcaggaaatccaggtgagaaaggaaacagaggcgttccagggatgccaggtttaaagggcctcaaaggactacccggaccagcaggaccaccaggtacagctgattctcaaatagaaaaatatcacattttacactttcctacatctaaagtaataaaagttgtttctaggcttactgggtttaaatatcaattctgttctgatagtgttccagcagaaatttgctactaaattaactaaaagaaggtgttgatagttggcgtgtcattaactaacatacattaamctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccatctcagtaacaaaatatatgacatggcaataacacttcaggatgcagttggaaatgtattaccatatgtttgcaggagcccacttttt

SEQ ID NO: 17811 - DNA, 601 bp, Human
tctgatagtgttccagcagaaatttgctactaaattaactaaaagaaggtgttgatagttggcgtgtcattaactaacatacattaacctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccayctcagtaacaaaatatatgacatggcaataacacttcaggatgcagttggaaatgtattaccatatgtttgcaggagcccacttttttcccgctggtgttggtcctaggatgattttagtgtttgaaacccaggtctgctaacgagaatctaactttctttagttttccatgttccaggtccctagttccctcttatttgaaggaaaaaggacagctagacaagtgcccaaaccagccggtctggctgttctgcattcattcatgcatgcaagcaacaagtatttattaaacacatacta

SEQ ID NO: 17812 - DNA, 601 bp, Human
aatatcaacaagtacccagattcggtgtgggcagagaaaattgaaactgttactatactttcagacagttatttggatttttaaaatcctatctccacaacagaggatgcttgtctgtcacagagctgtcaacttctgagagcctctttcagtcaccaaggaatttctcacactgtctctgcaatttaggtgtgctgccagaagaaggcagtgattacaggcccatacaatcagataggacagtgggttttttcttgtgatacaaagtggcccatttctgctgtactcatctcagacttakaaaaataaatttccaaaccttctaataaaaaacacttgtcggccgggcgcggtggctcacgcctgtaatcctagcactttgggaggccgagacgggcggatcacgaggtcaggagatcgagaccatcttggctaacatggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctggga

SEQ ID NO: 17813 - DNA, 601 bp, Human
ctataagcagaagttgctaacgtgggattccatggaccactgggaaaatctatgggatcccaagaagcccagcaacctcttgaaactaaatgcaaaatgtttgaaaatgtttttgtagggtagagtctatttttcagatttagatttttagattttcaacagtatatgtatgactccaatatataaaaagtattacttagggaaccttctccctctttttggagacaataaaataccacctttcctaaatatttccaccagctatagtctccagtagtaactgctaaaacaagaaaaaaayttagacactacacagacccaagaaagcaactgtttactacttggagcacagacaaatgtctttgttctttatatttagattaagtcctcagaaaacctgagattgcttccactgagatatttgctcaacgaaaaatcctatttgacttcacactcaattaactgatagtttcatttagatttaaagttttcacaggtaaccaccagaataaatttttagaactgtgcattgaacacaaaatgagctggttttatcatgtcagcaaaatgagagtaacagagtagtatattttaattggct

SEQ ID NO: 17814 - DNA, 601 bp, Human
caccagaataaatttttagaactgtgcattgaacacaaaatgagctggttttatcatgtcagcaaaatgagagtaacagagtagtatattttaattggctaccatagaaattttgtaaatctttatcaaacctatatgttcgggtttgtcgtaaaactgaagtgaagatttaatgaacactaaatcattggaaggtttttaaaacatgtgattgacatatgtgcatgcatagcatttgtaggatacatctttatttagtctatttctttcttactcccagctactcatcacaatttgtaaytatatatttgtgtgattatttaatatctatctccttactggtctctgaagctccatgaaggcagggactgtgtatgtcataaatctatataggttaccattatatcctggtaaaagccggcttcctgggtatgctaccagtgcagtcacagaaatcctgtgctaagaagggcctccacacttggtctgacgctatgctgttgctgtcttgaaattcactttaaaaagttttaagggaaactgcattttcattttgcactgggccccataaaccatgtggccgtcttattcccagcaccta

SEQ ID NO: 17815 - DNA, 601 bp, Human
atctttatcaaacctatatgttcgggtttgtcgtaaaactgaagtgaagatttaatgaacactaaatcattggaaggtttttaaaacatgtgattgacatatgtgcatgcatagcatttgtaggatacatctttatttagtctatttctttcttactcccagctactcatcacaatttgtaattatatatttgtgtgattatttaatatctatctccttactggtctctgaagctccatgaaggcagggactgtgtatgtcataaatctatataggttaccattatatcctggtaaaagcyggcttcctgggtatgctaccagtgcagtcacagaaatcctgtgctaagaagggcctccacacttggtctgacgctatgctgttgctgtcttgaaattcactttaaaaagttttaagggaaactgcattttcattttgcactgggccccataaaccatgtggccgtcttattcccagcacctatcacagtgctggcagatagcagatactaatatgaattgatgaatgaatgaaaaaattagtgaataaagtttatgctgaattcttaccacatatcctgcttatatgagaattttaaagg

SEQ ID NO: 17816 - DNA, 601 bp, Human
ggcttccatagtgaattccacagactaggtggcttaaactacacttgatgttagccaaaaggctgagaagtgattaggtggcttaaactacagatgtttattttctcacagttccagcagctccgagtctgtgatcaagctgtcggcagcgttggtttcttgtggggcccctgttcttggcttgtggatggctatcttcttccagtgttttccaagtgtctgaatcttcttttcttataaagacaccactcacattggattagggcccaccctactgacctcattttaatttaattacctstttaccagccctatccccaaatacagagtcatgttccgaagtactgaaggttaggacttcagcatatgaatttggggacaacacaattcaaactacaacactgtgctgtgactctttttcgaacccatttctggattgaattttggctttctggcttattagcttacaattcaggtttagggttttgttttattaaaaacaactgtgaaactatcgggttgcagattcaggtcttacttaaatacaataaactacctgttcaaatacagaaagtttcaataaatttgcatttaactcgca

SEQ ID NO: 17817 - DNA, 601 bp, Human
aggaaatcgtggtccaccaggctcaagaggaagcccaggtaaagggtttacttttaaacagcataaaataacaaaaatcatgtttgacctcaaaagttttcaacctcctcctcatgttaccttgttgcttcttctttccctgtggtcatctccattcccccactacctgtggttcccatacccagcagttgtcaaggcaaggtagcctgtttgagggatgcatagttaataaattaacgagcctggctggacgcagtggctcacacccgtaatcccagcactttggtaggccaaggcagayggatcacttgaggtcaggagttcaagactagcctggccaacatggtgaaaccctgtctctactaaaaatacaaaaattagccagtcttgcttggtggtgcatgcctgtaataccggcaactcaggaggctgagatgggagaacctcttaaacctgggaggcagaggctgcagtgagctgagattgcgccactgcactgcagcctgggcaacaaaacaaaactgtatcaaaaaaaaataattagcctaaaagacagtgatgcattcattcaactctatttgttgaatccctagagctgggc

SEQ ID NO: 17818 - DNA, 601 bp, Human
agggatgcatagttaataaattaacgagcctggctggacgcagtggctcacacccgtaatcccagcactttggtaggccaaggcagatggatcacttgaggtcaggagttcaagactagcctggccaacatggtgaaaccctgtctctactaaaaatacaaaaattagccagtcttgcttggtggtgcatgcctgtaataccggcaactcaggaggctgagatgggagaacctcttaaacctgggaggcagaggctgcagtgagctgagattgcgccactgcactgcagcctgggcaacaraacaaaactgtatcaaaaaaaaataattagcctaaaagacagtgatgcattcattcaactctatttgttgaatccctagagctgggctaggctctagggaagcaggcacagaccctgctgtaacagaccctcactggggagaagcagatcctgctggtgggtgccaggtgcttcgctggcatcatcttctcctgtctttaccacaatcccatcacatgctccaggggaaagaatgtttgtggcaatgctaagtgaagggtttatacttcattagaaacaatcactgataaatagaacctt

SEQ ID NO: 17819 - DNA, 601 bp, Human
cctggctggcaatactgacagacttttcatgaattcaggtgcgcctggtccccctggacctccagggagtcatgtaataggcataaaaggagacaaagggtctatgggccaccctggcccaaaaggtccacctggaactgcaggagacatgggaccaccaggtcgtctggtgagtatggataattattttgactcattattaattcaatatcaacttataattattcttatattgtatattatatcatatattgttgatgttaactgtattagtccattctcatgatgttaataaagacayacccgagactgggtaatttataaaagaggtttaattgactcacaattctacatggctggggagacctcaagaaacttataatcatggcagaaggcacctcttcacactgcaacaggagagagaatgagtgccaagcaaaaggggaagccccttataaaaccatcagatcggccgggcgtggtggctcacgcctgtaatcccagcactttgggaggccgaggcgggcggatcacgaggtcaggagatcgagaccatcctggctaacatggtgaaaccccgtctctactaaaaatacaaaaa

SEQ ID NO: 17820 - DNA, 601 bp, Human
gataattattttgactcattattaattcaatatcaacttataattattcttatattgtatattatatcatatattgttgatgttaactgtattagtccattctcatgatgttaataaagacatacccgagactgggtaatttataaaagaggtttaattgactcacaattctacatggctggggagacctcaagaaacttataatcatggcagaaggcacctcttcacactgcaacaggagagagaatgagtgccaagcaaaaggggaagccccttataaaaccatcagatcggccgggcrtggtggctcacgcctgtaatcccagcactttgggaggccgaggcgggcggatcacgaggtcaggagatcgagaccatcctggctaacatggtgaaaccccgtctctactaaaaatacaaaaaattagctgggcgtggaggcaggcgcctgtagtcccagctactcaggaggctgaggcaggagaatggcgtgaacccgggaggcggagcttgcagtgagccgagatagcgccactgcactccagcctgggtgacagagtgagactccgtcaaaacaaacaaacaaacaaaaccatcagat

SEQ ID NO: 17821 - DNA, 601 bp, Human
aatcatggcagaaggcacctcttcacactgcaacaggagagagaatgagtgccaagcaaaaggggaagccccttataaaaccatcagatcggccgggcgtggtggctcacgcctgtaatcccagcactttgggaggccgaggcgggcggatcacgaggtcaggagatcgagaccatcctggctaacatggtgaaaccccgtctctactaaaaatacaaaaaattagctgggcgtggaggcaggcgcctgtagtcccagctactcaggaggctgaggcaggagaatggcgtgaacccgggargcggagcttgcagtgagccgagatagcgccactgcactccagcctgggtgacagagtgagactccgtcaaaacaaacaaacaaacaaaaccatcagatctcatgagaactcactcactaccatgagaatggcatgggggaaaccacccccatgattcaattacctcccactgggtccttcccaggacatgtggggattataggaactacaattcaagatgagatttgggtggggacacagccaaaccatatcattaacattgacttatcgttagtacaagagtactattatactcttata

SEQ ID NO: 17822 - DNA, 601 bp, Human
atttatcaatcttagacatcatcttattcatttaggcctgtgccccaagcctgcaatctctcaattcatattctctctctcaacaccacagccgtcgtccctagctttctcttagcagcgtattagacaagttgacccctctgtttacatcaaatccttggagacagatgttgaatagatgaatgtgactcagggatcataactgagtgtctactctgtaccaatggatagaaaaacaaaaagctacagtcccttgccctagaggagcccacaataaagtgagggtgatagacacagagayggccattttcacactgtgtggtaggaagaatgcagggggctgtggggacacagaggaagggtatttaatccagactgtagagggaaggtgttcaggaaaggtccctccccaaggagattgatgcctggcctgagtcttgaaagacgcataggagttatccaagaaaataggaaaagccggggtatgggtcgggtggaggaaaggagctttctgagcaaaatgacaatgggtgtgtgtgagtgacacacacacaactctattactggagctgaggtgggaatgaggacaccttgggaggag

SEQ ID NO: 17823 - DNA, 601 bp, Human
gggtgatagacacagagacggccattttcacactgtgtggtaggaagaatgcagggggctgtggggacacagaggaagggtatttaatccagactgtagagggaaggtgttcaggaaaggtccctccccaaggagattgatgcctggcctgagtcttgaaagacgcataggagttatccaagaaaataggaaaagccggggtatgggtcgggtggaggaaaggagctttctgagcaaaatgacaatgggtgtgtgtgagtgacacacacacaactctattactggagctgaggtgggaatraggacaccttgggaggagtctggagggctaagcaggagtcaggtaacggaggtctggttttctagactaagaagagggaggaggacatcacttgctgatccaagaaacacttaacaaagcagctctttgtgcccagagtttgctctctaccagctggaattaatcccttaatgaactgccttttgatgtggctattcaccaagctttaaatctatccttgttgctctatgcagcagccattttgtccacaaaaatatagtagagagagctaccatggcacatggcacagctctctctacc

SEQ ID NO: 17824 - DNA, 601 bp, Human
acactgtgtggtaggaagaatgcagggggctgtggggacacagaggaagggtatttaatccagactgtagagggaaggtgttcaggaaaggtccctccccaaggagattgatgcctggcctgagtcttgaaagacgcataggagttatccaagaaaataggaaaagccggggtatgggtcgggtggaggaaaggagctttctgagcaaaatgacaatgggtgtgtgtgagtgacacacacacaactctattactggagctgaggtgggaatgaggacaccttgggaggagtctggagggcyaagcaggagtcaggtaacggaggtctggttttctagactaagaagagggaggaggacatcacttgctgatccaagaaacacttaacaaagcagctctttgtgcccagagtttgctctctaccagctggaattaatcccttaatgaactgccttttgatgtggctattcaccaagctttaaatctatccttgttgctctatgcagcagccattttgtccacaaaaatatagtagagagagctaccatggcacatggcacagctctctctaccatgtaaattgtcagtgtaaatacattgac

SEQ ID NO: 17825 - DNA, 601 bp, Human
taggcttctgaatggaatgattatgccttaagtttgtctgaatcacctgggagataaagatattacttatttgtttgatcaattcagggacatagtgaattctggaagaacataaataaaaattgcagcacaattttaaactgctgcatttagtatcctcatagttcattttcgagagtcttattttctgggaagtggggctaacaagttaggtgactaatcatcctagcttgcccaggactgaggatcttcccaggatgcaggactttcattcctgaaactgagaaagtcctgggttaaygggatggttggccaccttacttttcatcctatatgataaaatgcaatacaatgttggtttttgcctaggaccctgtgggccaagaggtaagccaggcaaggatggaaaaccaggaactcctggaccagctggagaaaaaggcaacaaaggttctaaaggagagccaggtaaacccccagcttgtttcctcaccgaagaagtgctatttcgacatacagagaagtcttgttcgagtgggtgactatatgagttatctaggcctttgagtttatgttgttcagatcagaccaaaggccaagg

SEQ ID NO: 17826 - DNA, 601 bp, Human
tgatagccctggcccctttcttggagatacagaaatgcattggatatcacacatttgtataaaagctcacttccagttcctgccctgctcagctaatcacttcccaattcctgtgcagagatgaggagacatcttttgtttggggccaactatagctccctctgaatgagggcaggggttaggaaaagagaaaaatgtgtctccccaatatattaaaaccatggcaacttggatttttcaagtaagacatcagaccggagaatttggatgtggcctatttttaatttcaaaaaaccactcmaggtccctggaggagacaagagtgggcagaattcagagaaaattgaaaaaatgcataatattggggcttttacaaatttctgaggaaagtcctgacttccgagtcaggactaaactgtgaccctgcctgactcccaggggcacggatgtcccaggggcaacaaaactaattcctgtgatgatgtaggcccaaagtctaaccatcgctgttttctctgtgattccttaggaccctagagaaccatggcccaagtctggttggggagggagtcagcgtacagtggcagcagaaatggatggg

SEQ ID NO: 17827 - DNA, 601 bp, Human
acctccagtgatctgcccaactcagcctcccaaagtgctgggattacaggcatgagtcactgcacccagcctggaatgcctattttttataagataactgctttacatacattctctgtaatttttatgaaaacgctcataggtaatttctatcatttacagttttacaaataagaatgaagtactttccccagggtcttacaactatttagtggaaaagctaggatctgaacccaggtctatctgctccaaaatctgtgccccttttgacattcatatggagataaaagcaaagaaaaayagtcttttaaagaaaaagctttcagatgtaaatgctagtgaagaagtttatggattggccatgtgtgactgtgatgactgtcatagctgcacgcaggtggttctttcttttttctttttctttgtctcttgagacagaatctccctctgtcgcccaggctggagtgcagtggtgcaatcttggctcactgcaatctccacctcctggctcactacaatctctgccttctggctcactgcaatctctgcctccagggttcaagcaattctcttgcctcagcctcctgagtagcttggacta

SEQ ID NO: 17828 - DNA, 601 bp, Human
tattacaaacaaattttaacagaggacatatgcaattttaaaagaccactaaaaggccaagtgcggtggctcaggcttgtaatcccagaactttaggaggccgaggtgggcggatcacctgaagtcaggagtttaagaccagcctggccagcatgacgaaaccccatctctactaaaatacaaaaattagctgggcatggtggtgcatgcctgtaaccccagctactccggaggctgagataagagaatcacttgaacccggaaggcagagattgcagtgagccgagatcgtgccactgcrctccagcctgggtaacagagtgaggttctgtctcaaaacaacaaaacaaaacacccattaaacatctgcatatattttctagaccttatatttgtcaaacagcttctggatccatcatcttatttaacgcttaaaacagctgtggttagaacttcgggtcacaccattccaaaggatggtaggagaactggggctcagttctgggctgtgatttatctgccatccttgttcttttgttctctgtagagccttctcctctctaaaacctcatgtcctaagtgagcctttgttctccaccct

SEQ ID NO: 17829 - DNA, 601 bp, Human
ccactcattatttcaggtgatactctcaaatgcatgtcaacaaagtcgggcaagtcttatcatccctactcaatacaggagataactgagtcttatataagttaagaaatgaatctttggcagagccaagaaccactggctcctcattctttgacccaggtgttttctgctcccaacttgtaggaaaaggagaacagaaggtaattttgcactttgatttgctttgaaaaaacctacaataacttgattcactgaaattgcattgggtgaatccaaggtggagagtatgaacagatagggwtatgttcactagagtgatttaaaccaagtcagttgtctcaagatcaacctgagttgcaggcaggccacaatgggatttcccagacacgtctgagggtgagtttaatgactgggattcttcagtgaggaagcagaagaaagatagcttattacagaatgttctgggcttatttttcttctgagctaaaatgttcaaattattcttgtatttcttgatttaatcttgaaatggcccagctgcctcttgcctgtctccaaaaaaaaacttttaaagaaagggttatgtttgtattaaaataaa

SEQ ID NO: 17830 - DNA, 601 bp, Human
ttataacaggaaaaagaatataacacaaaaataaacttttaaaaatcaggtaagagaaatagaaaaaatacacatgtatatatcatagtattgtttccactcattatttcaggtgatactctcaaatgcatgtcaacaaagtcgggcaagtcttatcatccctactcaatacaggagataactgagtcttatataagttaagaaatgaatctttggcagagccaagaaccactggctcctcattctttgacccaggtgttttctgctcccaacttgtaggaaaaggagaacagaaggtaaytttgcactttgatttgctttgaaaaaacctacaataacttgattcactgaaattgcattgggtgaatccaaggtggagagtatgaacagatagggttatgttcactagagtgatttaaaccaagtcagttgtctcaagatcaacctgagttgcaggcaggccacaatgggatttcccagacacgtctgagggtgagtttaatgactgggattcttcagtgaggaagcagaagaaagatagcttattacagaatgttctgggcttatttttcttctgagctaaaatgttcaaattattctt

SEQ ID NO: 17831 - DNA, 601 bp, Human
tagaaaagttcaaaggctggctgcggtggctcattcctgtaatcccagcactttgggagggcaaggctggcagatcacttgaagccaggagttcaagaccagcctggccaacatggtgaaaccccgtctctactaaaaataacaaaaaaattagccagatgtgatggcacatgcctggaatcccagctactcaggaggctgaggtgggagaatcacttgaactgggaggcagaggtggcagtgagctgagatcgtaccactgcactccagcttgggtgacacagtgagaccctgtctcacaaaaaaaaaaaaaaaagttcaaacaaagaagttattaatgtcttatacttgtaattccatcttcttttttgaaaaacaaataatatagacacataattttaaaaattcaaatggtgccaaagagtgtaacaggaaaacaaatgtcctctttcaacactggccccaagttccctcctatacaggataatttttttcaaataggtgtttgggcattaataagcatattcatacaatgacctcattcacacacacacacacacacgcacacacagaggcagatgagcacatgggcacacaggca

SEQ ID NO: 17832 - DNA, 601 bp, Human
cacacacacacacacacacacacacacacacaccctttaggaagaatcagctccttgttctcatgaatcctaatcacctatatccagagtcatcatccacttccatataaaagcatagtcccagagtactatttccataggcagatcccttaacagcaatcaccatgatgcacctgcaatgaacatgagcactgagcgtgcattcccaggctgggcctgccagtggggagggagtggtggtttaggcccctgtgtagtggacaaatcacctctaggtgctaggacccaagggcatggatargaatatcaagaaagcatcagagaaaaggtttgcctggctcatgatctggcctagctgtcattgcaacatttatacattggccatacaattttatgattgatcaacctttttaaacttaaggctgtaaactcaagcctttagaccactgtatgatgggaaaacataaaacaataaaactaatatttatagtcccatggaagacatatatacatatgtatgtgtgaatgcattgaatatatatgtgtatatgtgaatattcatgtacgtatacatatatatgaacaggtatatgtgtatggg

SEQ ID NO: 17833 - DNA, 601 bp, Human
gttttgtgaaactttctctttaccccaaaaggctacgtagcatgtaaaaataaaacctaaattttttttaagataacaaatttaaactaatttagtttgcagtactctgggaaattgaggaggggaccttccttaaaatccttagaaatactataatgaattataaagcccccacatacctctttttttttttccattccattttcatatgagaaatgggagtattaagctcactacaaatattaggactcatcagcaaataaaaacattccttatgagtatgcattaatttcaagaacaytgtacttgacataacaagtatacctagctcatattttggaattttttctctaacctgttagaaaacgttgctttccaagtaaagtgttttgctctgggagttattgtacaaaatttaaatgtaaacaccctttcatgcactaaaatgagaaaatataaaaagagtttgctatgtataatatataccatgcaccataacatatatatatcttgcaccatattttatacatgttatacaatatataattaacagatattatgatatataaactatatgtaagatataagatactatataaaa

SEQ ID NO: 17834 - DNA, 601 bp, Human
attggtgtattcagggacattttgaagaaaaatcctgtctgagtatttcctgcatgggcttacctatttggaagaaaaaattttttaacccatcatgatcataatacttacctgaatacctttaacggcacctaaaatgaacactgaatttcctttttctcccttttccccaggatggccctgaaaataaaatatgtatgtacttaacaggaaaatagcatattaccatttcagtattttcttttctatataaaatataactcatcagttaaaattaccattattgacatgattaacaagmagacatttctgtatcctcttccatattattatcaccctaaggttctcacatatatttactccatattcagttaagatctgttaaggaatcttctaagacagaatatctactcatatatagctatttagcagaaaattttcatatttccttacaatataaaacacatgcattgttcctacaaataactaattttgcaattgttaatttatgccctagaaacagtaaaacgtatatatatatatagagagagagattttatccatttcagtacttgtattcaaaataggcctaagaattatt

SEQ ID NO: 17835 - DNA, 601 bp, Human
tcctcacagtttacctgttgctggtgtctttccacaccttgctatgctttataaacatcttgacccccttgactaccctagagtggacagaaaagaaactcaggtggaaattgcctcacaccagcctctgtctacttctatcgccttgtgactctgtgctgagactcaacctactttaaaagatcaaaggctatatattctcttgaatgaagcctctttttttaaaatgtaaaatatatgtaagttaaaatatgacatttcaacctttttttttttttgagatggagtctcgctcttgtcrcccaggctggagtgcagtggcgccatctcccttcactgcaacctccacctcctggattcaagcaattctcctgcctcagcctcccaaatagctgggattacaggcatgcgccaccatgcccagctaatttttttgtatttttagtagacggggtttcaccatgttggccaggctggtctcgaactcctgacctcaggtaatccacccgccttggccttccaaagtgctgggattacaggcgtgagccaccacgcctggcccatttcaaccatttttaagtgtacaggtagttcacttaat

SEQ ID NO: 17836 - DNA, 601 bp, Human
gcatttttgcaaaaatatcataacacaaagattatgcactatgaatactcaaattgtggcatttgtgattcacacatttactgtttagttttgtgaaactttctcacatcagaaacatcagagagatgaagatgggcaaaatattaaatataatatacaaatactgattcaccaggcaaaatggtagcgagaagcaatgcaagattattctagctggtatatattatacatgtagttgctaagtggactcactttcctaaatattaagtggctgcatatacctgagtaatgtcacgagatmattagaagacagaagaggaaggcaggagggagcttgatgagcttcaagtacagcttcatgggcatgagactggtgcagttacacagggccccatgcttcatgttctgtggtcgccatcttgaaatgcttaataatttttgaacagggaacccacattttcattttgcactaggtgagccgcacaaattatgtagctggctttgctgggattaaaacgtggatcataggctatttgaggaggaaatagaagcatagagcctgctcaggagacttactggtaagccaggcagtcctgggtcc

SEQ ID NO: 17837 - DNA, 601 bp, Human
gtgaagcatttttgcaaaaatatcataacacaaagattatgcactatgaatactcaaattgtggcatttgtgattcacacatttactgtttagttttgtgaaactttctcacatcagaaacatcagagagatgaagatgggcaaaatattaaatataatatacaaatactgattcaccaggcaaaatggtagcgagaagcaatgcaagattattctagctggtatatattatacatgtagttgctaagtggactcactttcctaaatattaagtggctgcatatacctgagtaatgtcacragatcattagaagacagaagaggaaggcaggagggagcttgatgagcttcaagtacagcttcatgggcatgagactggtgcagttacacagggccccatgcttcatgttctgtggtcgccatcttgaaatgcttaataatttttgaacagggaacccacattttcattttgcactaggtgagccgcacaaattatgtagctggctttgctgggattaaaacgtggatcataggctatttgaggaggaaatagaagcatagagcctgctcaggagacttactggtaagccaggcagtcctg

SEQ ID NO: 17838 - DNA, 601 bp, Human
gatccacctgccttggcctcccaaagtgctgggattacaggcatgagccaccacgcctggccggcaaaactgctctcaattttagtcttgtaaacatcgaaaaactggaaagactaatataatcattgaattgctggtctgggcggccctcggtgcccctacagaaaacaaaattataagtgaagcatttttgcaaaaatatcataacacaaagattatgcactatgaatactcaaattgtggcatttgtgattcacacatttactgtttagttttgtgaaactttctcacatcagaaacrtcagagagatgaagatgggcaaaatattaaatataatatacaaatactgattcaccaggcaaaatggtagcgagaagcaatgcaagattattctagctggtatatattatacatgtagttgctaagtggactcactttcctaaatattaagtggctgcatatacctgagtaatgtcacgagatcattagaagacagaagaggaaggcaggagggagcttgatgagcttcaagtacagcttcatgggcatgagactggtgcagttacacagggccccatgcttcatgttctgtggtcgcca

SEQ ID NO: 17839 - DNA, 601 bp, Human
actcctgacctcgtgatccacctgccttggcctcccaaagtgctgggattacaggcatgagccaccacgcctggccggcaaaactgctctcaattttagtcttgtaaacatcgaaaaactggaaagactaatataatcattgaattgctggtctgggcggccctcggtgcccctacagaaaacaaaattataagtgaagcatttttgcaaaaatatcataacacaaagattatgcactatgaatactcaaattgtggcatttgtgattcacacatttactgtttagttttgtgaaactttytcacatcagaaacatcagagagatgaagatgggcaaaatattaaatataatatacaaatactgattcaccaggcaaaatggtagcgagaagcaatgcaagattattctagctggtatatattatacatgtagttgctaagtggactcactttcctaaatattaagtggctgcatatacctgagtaatgtcacgagatcattagaagacagaagaggaaggcaggagggagcttgatgagcttcaagtacagcttcatgggcatgagactggtgcagttacacagggccccatgcttcatg

SEQ ID NO: 17840 - DNA, 601 bp, Human
agatggagtttcagtcttgttgcccaggctggagtgcaatggtgccatctcagcttactgcaagctctgccttccgggttcgagtgattccctggcttagcctcctgagtagctgggattgtaggtacgcgccaccacgcctggctaatttcgtatttttagtagataggggctttcaccatgttggccaggctggtctcaaactcctgacctcgtgatccacctgccttggcctcccaaagtgctgggattacaggcatgagccaccacgcctggccggcaaaactgctctcaattttartcttgtaaacatcgaaaaactggaaagactaatataatcattgaattgctggtctgggcggccctcggtgcccctacagaaaacaaaattataagtgaagcatttttgcaaaaatatcataacacaaagattatgcactatgaatactcaaattgtggcatttgtgattcacacatttactgtttagttttgtgaaactttctcacatcagaaacatcagagagatgaagatgggcaaaatattaaatataatatacaaatactgattcaccaggcaaaatggtagcgagaagcaatgca

SEQ ID NO: 17841 - DNA, 601 bp, Human
tgtatttttagtagagacggggtttcaccatcttggctaggctggtcttgaactcctgacctcgtgatccacccgcctcagcctcccaaagtgctgggattacaggtgtgagccacctcacccagtcttttttttttttttttttttgagatggagtttcagtcttgttgcccaggctggagtgcaatggtgccatctcagcttactgcaagctctgccttccgggttcgagtgattccctggcttagcctcctgagtagctgggattgtaggtacgcgccaccacgcctggctaatttcrtatttttagtagataggggctttcaccatgttggccaggctggtctcaaactcctgacctcgtgatccacctgccttggcctcccaaagtgctgggattacaggcatgagccaccacgcctggccggcaaaactgctctcaattttagtcttgtaaacatcgaaaaactggaaagactaatataatcattgaattgctggtctgggcggccctcggtgcccctacagaaaacaaaattataagtgaagcatttttgcaaaaatatcataacacaaagattatgcactatgaatactcaaa

SEQ ID NO: 17842 - DNA, 601 bp, Human
gcaccaccacgtctggctaatttttgtatttttagtagagacggggtttcaccatcttggctaggctggtcttgaactcctgacctcgtgatccacccgcctcagcctcccaaagtgctgggattacaggtgtgagccacctcacccagtcttttttttttttttttttttgagatggagtttcagtcttgttgcccaggctggagtgcaatggtgccatctcagcttactgcaagctctgccttccgggttcgagtgattccctggcttagcctcctgagtagctgggattgtaggtacrcgccaccacgcctggctaatttcgtatttttagtagataggggctttcaccatgttggccaggctggtctcaaactcctgacctcgtgatccacctgccttggcctcccaaagtgctgggattacaggcatgagccaccacgcctggccggcaaaactgctctcaattttagtcttgtaaacatcgaaaaactggaaagactaatataatcattgaattgctggtctgggcggccctcggtgcccctacagaaaacaaaattataagtgaagcatttttgcaaaaatatcataacacaaa

SEQ ID NO: 17843 - DNA, 601 bp, Human
tactcctaaattctgttacaattttgatatacatcaggatgcttttaaagtattattattaattaacattatatattaatgtatttatactttttagtatgtttttaaaacatggtctgcaagatctcaaattgcggaaatatagtccctaatttgagatcaagatgagtcagccatacaaaattttctacaacatgtaagttgtaacacaactatacacaaattgtcaaggaaaggttacagccaggctagcctggaagtgtggagagatgttccccgggctcctgctgactctgcccargtcaaatgattggggagtgtataatgaaattactctgtttaggaggatgaactgatatttattttaacagcaacattgaggtatcacatttattacatggacctgagcttcaatcgtagtaaggaaaccagcccaggaaagtcgttccatcactagccagaagttacagggcaaaattatagcttaacttttggaaggcaaaatggagtctctgtcgcccaggctggagtgcagtggtgagatcttggctcactgcatcttctgcctcctgagttttagcagttctctgcctcagcctcc

SEQ ID NO: 17844 - DNA, 601 bp, Human
agcaaagaaaatgcattactacctactcctaaattctgttacaattttgatatacatcaggatgcttttaaagtattattattaattaacattatatattaatgtatttatactttttagtatgtttttaaaacatggtctgcaagatctcaaattgcggaaatatagtccctaatttgagatcaagatgagtcagccatacaaaattttctacaacatgtaagttgtaacacaactatacacaaattgtcaaggaaaggttacagccaggctagcctggaagtgtggagagatgttcccygggctcctgctgactctgcccaggtcaaatgattggggagtgtataatgaaattactctgtttaggaggatgaactgatatttattttaacagcaacattgaggtatcacatttattacatggacctgagcttcaatcgtagtaaggaaaccagcccaggaaagtcgttccatcactagccagaagttacagggcaaaattatagcttaacttttggaaggcaaaatggagtctctgtcgcccaggctggagtgcagtggtgagatcttggctcactgcatcttctgcctcctgagtttt

SEQ ID NO: 17845 - DNA, 601 bp, Human
ccacaccgggatttccctgagaaagaaatgaaaaagaatctaattgcttttgaattttaaaaaagtaattaaaagcaattaagacttctggctacacaatatattgcagttcatggaatactttgggaagtctgataagaggaaagccatcattctgacaaatatcagtggtcaaccatttcattgttcagggctctattgatgtatcttgctcatgactgcctaccttcaaacctggacgccctggttggcccggaggtccctaaatcaagggagaaaaaaacacaaatcaatcatcagrcatagaaatcagaatgtgccttcttttgttaccccaaaatagggtcctatttaggaaacccttaattttaaaacatgcagtgatggagtttctatcatggatgggctgttttctgtgaagatgatgtcagtggctcatccgcagggacctgtgcttcaagatggagtcccactgataatggtgggttttcactgattcatcgattataatctctcaaacggcccacctgtgtctgacccaaaatggcaatgttgcttctttattttcatgtagaatctggtttttaaagggatcacatca

SEQ ID NO: 17846 - DNA, 601 bp, Human
tctattcttattatttaacatactgaattccatctccttcagaaatcatctctttttacaatctgtttcaccttaaaaaaaaaaatcttaagagattactcttcacctgttctaattagcacacttataaaccagatactatttgagccagttctctatgtgagaggtatatgggataccacagtggaccacggaaccaggcagcagatacaatttgggaatgcagccattgaaaaagtggcttattttgagcaaagtaaagaaatttaacccagcaatggaaaagcaacaatagaatctkcatgtggcaccaataataccagcactggtagctgacagaggaattaatatttgccaagaatctattacggcccagttctatgcatttgttaccttctcaattatcaagacatcaaactcatctgtaacatctaaaggacaactgggcttccggtggtcttttcaatccacacgtcaaaacaacattaacaagcacatgtcataatttagcagcctgagctaggtctgccactcagcagctgggtaaacttgagaacactgggaaccttccaagcctcattttcaatgccgcacgatgggg

SEQ ID NO: 17847 - DNA, 601 bp, Human
attacaatgaatataatttggtctattcttattatttaacatactgaattccatctccttcagaaatcatctctttttacaatctgtttcaccttaaaaaaaaaaatcttaagagattactcttcacctgttctaattagcacacttataaaccagatactatttgagccagttctctatgtgagaggtatatgggataccacagtggaccacggaaccaggcagcagatacaatttgggaatgcagccattgaaaaagtggcttattttgagcaaagtaaagaaatttaacccagcaatkgaaaagcaacaatagaatctgcatgtggcaccaataataccagcactggtagctgacagaggaattaatatttgccaagaatctattacggcccagttctatgcatttgttaccttctcaattatcaagacatcaaactcatctgtaacatctaaaggacaactgggcttccggtggtcttttcaatccacacgtcaaaacaacattaacaagcacatgtcataatttagcagcctgagctaggtctgccactcagcagctgggtaaacttgagaacactgggaaccttccaagcctcat

SEQ ID NO: 17848 - DNA, 601 bp, Human
tatttggtcctgtttgcaaagctagctgaataaaaggaaataaatataaaatagattccatttctttataacatttgctacttgaagtgatcctcagtcttattcaaaaaatccatgtcattgccagtgttttaattaagaatgtatttttgttgtcgttgcttttccaaatttaatttacttaacttagtgcttgcactgggccaaatatctttaaaatctctgcaatataatttgcctggaaattaatagttgctctgtgcatcattagcaataaaaatgaccatggaaaccaatattkccccattcagtactaaatctagaaccaaataaactcaatgcccatgccagctgcggtctggcctccatggtgactctatgagtgggctttctattagtgacatgtggtgatgtttggagcttaatattgtactttttttctagctcctgcccctatatcaccatgttgtttcctcaaatagacttaaattaactattccaagctactttcctactgcactgaggtgccagacaagagatggcacaatcctgtcacttttcccaaattcttctatcttttgcttgcctgttttatctaaat

SEQ ID NO: 17849 - DNA, 601 bp, Human
gtttattcacctaacaaggtccgaatctacattttattttagcaacaaatagcgtccctctaaattgtgttcctttaatgccaccatggctttaagggaacacaattcccttgcacatgctgagcaagtgccagatgaggtcacaaaagttaaaaaggaaagaaaaaatgcagtggtgttaaaagcagaaaactctctaagatgccctctgtttctaatctcaatgagcctatgaatttttttaaactctcatgattattcaccttcaaaaggatcacttctcaaatgtagaacataatartgcttaatatgacactgatatgataatatgataatcatgcataataacacacagcatgcattaaagtactatacagtcagcactcttataaaaaatattttaaaaaaaataacaatccaatgataaaaataataaaacaatagaatatgacaactgtttacatagcatttacattgtattagagattataagtaacctagagatgatttaaaatataagatatggcgtgtgtaagtattatgcaaatactacatcattttacatcagggacttgagcatctgagggttttggtagcctag

SEQ ID NO: 17850 - DNA, 601 bp, Human
attaggagacatttttgcagtttctcattacatttaaaacgaaatatcttaaatgtgaaccgccttggctgtgcctcttcctcagacacgtgaactttgaatggggttctttgtcactgatttaggctactccttttggtggcagcatcttgataggtgttagtcaaatagttctgtttttgtttttgtttttgttttcagacggagtctccctctgtcgcccaggcaggagtgcatgatctcagctcactgcaacctccacctcccaggttcaagcgattctcgtgcctcagcctcccamgtagctgggattacaagcatgtgccaccacacccagctaatttttgtattattagtagagatgggatttcaccatgttggccaggctggtctcgaactcctgacctcaagtgatctgcctgcctcagccttccaaagtactagagttacaggcgtgagccactgaacccagccagtaaaatagtttcatacaatttttagcgattaaaaatagactttctgaaagataacaataaaaatcccagcatacagtatatgtactgaaaaaaacctcatgcacatgtataattatacactcatg

SEQ ID NO: 17851 - DNA, 601 bp, Human
cccaaggtcttgttttacagataagaaaactgatgtacagagaggtttaataaatgtccaagatcacacagcttgcaagtaggagaaattggaacttttctagttcatagtgcaaatgcattaagtatttcactgtaccacattatactatatggctttcactaaatgctaaggtgggatttgattacaagtgtctgactctgaaactgtgcttatctcatggtaaatactgtagataattaccaaattatctacaagatattctatacgttgtatatatagtaaataccatagatattamcaataatatctatcatatctacaaattatatatacaagtatataataggactagatacactcctgtgcttagaacaaaatgaaaatgagctcctgtggatttggctgccatcttgtcttcatgccatttctaagacctgatgtggactcaatacaatcagtcattggatgaacctgggtgctgcctgctgccttgtcccattgccaagaatgcttaaccacctgccaacagggagaatgggctacagtgtgtggcatcttgcagtattgtccacccaactgtagagcatgaagtcaatag

SEQ ID NO: 17852 - DNA, 601 bp, Human
tgatgactggatggctccacctagacccaagactcatgactcaagggtcccgtggcacccacccagaagtggattcaacacgttaggaccattttccacacccccatgatctcatccccagccccctgcctgccaaactatctttaaaaaaccctagcctccaaattttcagagaggcttttttatttttatttttatttcatttattattttagtaataataaaactccagtcttccatttagccagctctatgtatgttaaacgctttctctattgcaattcccctgtctcgacaaatyggctctccctgggcagtgggcaaaataaacccaccgggcagtcacaaaccaagcccatatataactctgatgaaaattaaaactacatttaaaaaaaattggtattattttaccaagttctatcatttacactgaaactcctaaccaaatgattgcacatactttaatggatgtgaaagtccaacttcagtttatttgtttgtaaaagacaaccaacttagctcatgaaacatcatataacttttaaaatattttaaaaactatgctttcttagtggcactgcaaatatcaaaagcagca

SEQ ID NO: 17853 - DNA, 601 bp, Human
ggccttttgagatgtcttttcagactttggcgtttctgatgactggatggctccacctagacccaagactcatgactcaagggtcccgtggcacccacccagaagtggattcaacacgttaggaccattttccacacccccatgatctcatccccagccccctgcctgccaaactatctttaaaaaaccctagcctccaaattttcagagaggcttttttatttttatttttatttcatttattattttagtaataataaaactccagtcttccatttagccagctctatgtatgttaaaygctttctctattgcaattcccctgtctcgacaaatcggctctccctgggcagtgggcaaaataaacccaccgggcagtcacaaaccaagcccatatataactctgatgaaaattaaaactacatttaaaaaaaattggtattattttaccaagttctatcatttacactgaaactcctaaccaaatgattgcacatactttaatggatgtgaaagtccaacttcagtttatttgtttgtaaaagacaaccaacttagctcatgaaacatcatataacttttaaaatattttaaaaactat

SEQ ID NO: 17854 - DNA, 601 bp, Human
gcaaaaattctcacagtgaaaaaattgtgacagtgaaggagatatgacctaaataacttcaccttgtctttagcctctaaactgcccttggccatttctgagcgtgggccaagctaactttgaaagaatttacttatagtttaaataataatagccctccccaaaactaaactaccttcataatgctaataaaaagccaccaggtaaacaaaacaaaacaaaacaaaacaaaacaagaagggcctgtattctgctaagatgtaggtatacttaaatgattagcagcattattattccagargtcacaagatttgcaatctccccaattactcctataaatgatatcactattataaaacctaagattggccttttgagatgtcttttcagactttggcgtttctgatgactggatggctccacctagacccaagactcatgactcaagggtcccgtggcacccacccagaagtggattcaacacgttaggaccattttccacacccccatgatctcatccccagccccctgcctgccaaactatctttaaaaaaccctagcctccaaattttcagagaggcttttttatttttatttttat

SEQ ID NO: 17855 - DNA, 601 bp, Human
ggctcacatctacaatcccagcactttgggaggccaaagggggcagatcacctggggtcaggagtttgagaccagcctggccaacatggtgaaaccctgtctctactaaaaaatgcaaaaaattagctgggtgtggtggcacgtgcctgtcatcccagctactcaggaggctaaggtagaagaatcgcttgaaccagggaggcagaggttgcagtgaaccaagattgcatcactgcactccagcctgggcaagagtaacactctgtctcaggaagaaaaaagaaagaaagaaagaaagaaagaaaagaaaagaaaagaaaagaaaagacatgacatgaaagctacatgctggattaaaactgcttactgactgtgtgcaagccagtacaaatgtacccacactaaggcaaatcaagtggaatttaagaccccaaaaacaaacaaaaaaaaagagctcctatgagcttccagaaaggaaaatggatttcaaaaccaaaaaataaagtatctaaatgttatgagttctcagtagccaacactggaagctaggaaacaatagaaaatgccatcaaaatcctgagggagaaagatttcctaacta

SEQ ID NO: 17856 - DNA, 601 bp, Human
tgtctcctaaatttcaagaatctgtacctctggaataagaacaacagtgaggtccaaaacaggatgatttgtctaaaaaaacagaccaaaagatccccttcctgaaattggcagcagggaaagaaaatagaccccctactatccccgccaaaaaaacctagaagaaacacgcatcacagcaagctattttaatttattttacaattaaaacagaagatgagggagagtattgcatccctgaaacatgaacagcctgctacaaaaggaaacattaaaagagaacacagcaattgaaaaacagatatagatatagatatagatatagatatagatatagatatagatatagatataaatagatcatgagagcagaaatttaaaaattcaggtgaagggttgtaatgtagagttcaggaaatctcccagaaagtgttacagaaaaataaacagctggagagtaatagagtaaaggttaaaaaaaaaaaaaaaagacatgtaggattgattttctgacagatagatagagtacagaaagagaaaaaagaggggaaaaaatggaggagacaacgttttcaaaggacacttgatctcttctcagcct

SEQ ID NO: 17857 - DNA, 601 bp, Human
aatgtctcctaaatttcaagaatctgtacctctggaataagaacaacagtgaggtccaaaacaggatgatttgtctaaaaaaacagaccaaaagatccccttcctgaaattggcagcagggaaagaaaatagaccccctactatccccgccaaaaaaacctagaagaaacacgcatcacagcaagctattttaatttattttacaattaaaacagaagatgagggagagtattgcatccctgaaacatgaacagcctgctacaaaaggaaacattaaaagagaacacagcaattgaaaaacagatatagatatagatatagatatagatatagatatagatatagatatagatataaatagatcatgagagcagaaatttaaaaattcaggtgaagggttgtaatgtagagttcaggaaatctcccagaaagtgttacagaaaaataaacagctggagagtaatagagtaaaggttaaaaaaaaaaaaaaaagacatgtaggattgattttctgacagatagatagagtacagaaagagaaaaaagaggggaaaaaatggaggagacaacgttttcaaaggacacttgatctcttctcagc

SEQ ID NO: 17858 - DNA, 601 bp, Human
cagaaatgtctcctaaatttcaagaatctgtacctctggaataagaacaacagtgaggtccaaaacaggatgatttgtctaaaaaaacagaccaaaagatccccttcctgaaattggcagcagggaaagaaaatagaccccctactatccccgccaaaaaaacctagaagaaacacgcatcacagcaagctattttaatttattttacaattaaaacagaagatgagggagagtattgcatccctgaaacatgaacagcctgctacaaaaggaaacattaaaagagaacacagcaattgaraaacagatatagatatagatatagatatagatatagatatagatatagatatagatataaatagatcatgagagcagaaatttaaaaattcaggtgaagggttgtaatgtagagttcaggaaatctcccagaaagtgttacagaaaaataaacagctggagagtaatagagtaaaggttaaaaaaaaaaaaaaaagacatgtaggattgattttctgacagatagatagagtacagaaagagaaaaaagaggggaaaaaatggaggagacaacgttttcaaaggacacttgatctcttct

SEQ ID NO: 17859 - DNA, 601 bp, Human
cccagaaatgtctcctaaatttcaagaatctgtacctctggaataagaacaacagtgaggtccaaaacaggatgatttgtctaaaaaaacagaccaaaagatccccttcctgaaattggcagcagggaaagaaaatagaccccctactatccccgccaaaaaaacctagaagaaacacgcatcacagcaagctattttaatttattttacaattaaaacagaagatgagggagagtattgcatccctgaaacatgaacagcctgctacaaaaggaaacattaaaagagaacacagcaattgaaaaacagatatagatatagatatagatatagatatagatatagatatagatatagatataaatagatcatgagagcagaaatttaaaaattcaggtgaagggttgtaatgtagagttcaggaaatctcccagaaagtgttacagaaaaataaacagctggagagtaatagagtaaaggttaaaaaaaaaaaaaaaagacatgtaggattgattttctgacagatagatagagtacagaaagagaaaaaagaggggaaaaaatggaggagacaacgttttcaaaggacacttgatctctt

SEQ ID NO: 17860 - DNA, 601 bp, Human
caaccccattctttgcgcccttgttttcctaggattctttctgtctgaaataagaatatacacacatatagatgatgcagtggttatggcatgcttctgctaccataaccattgataaagccaaccctaatctcagccctaccttaaattaatgggttgcaaaacaagataatggacaacaaaacaaaacaaataaacaaaaaaatggactcagtgtatggcaaagatattcccccactcagtgatcaattcttagctaatgaagaaaatggaaaagcagagcttatagaaataaaatttyagagatgtcagttaaagacgacagataaaatgcaaacagtttggcatcctccccaaatcccagtagagtaaaagaatattataaaaaaagcataaactggcctggtgcgatggctcacacctgtaatcccagcactttgggagaccaaggtgggtggattgcttgaggtcaggagtttgagaccagcctggccaacatggtaaaaccccccccatctctgcaaaatcacaaaaattagccagccacggtggtgcgtgcctgtaatccccgctacttgagaggccaaggcaggagaatcgc

SEQ ID NO: 17861 - DNA, 601 bp, Human
acccatctgtaaagccccatgctctgcagcccttcctaacctcctgccagttccttgacttcatttcctgctctgcccctctctctcttctctccagctacaatcgatggtgatggcgtttatcaccacatgacatactggatatttacttgctgatctgttagatggtctgtgtcctctctgaagctctaggagggcagagactgggctctggtccctgctgtatccccagcacctgaaacaaggcctagaacatagcaggcacttaacaataccaattagttgaataagtaaacgatgkatgaatggatgagtaaataaactgtttttgcaggcattagcataatgtttgtaggttcaaaacataaatcatatatcacacaataaattagaaagaggcacctcgatttttatctctacgtgtctgatatggtttggctttgtgaccccacccaaatctcatctcgaattgtaatcgccataatccccatgtgttgagggagggacctggtagaaggtgactggatcatggggagggtttcccccatgctgttctcacaatagtgagtgagttctcatgagatctgatggttttataagg

SEQ ID NO: 17862 - DNA, 601 bp, Human
cccaaatgtcggagatgggatctgaagctggtccacttgctcctaggccctagtgccttgcactagagcatcctggccggaaatcccatcctagggagcgccgtcaggctaaggcaatgaatgcaaagacttggttcaattatacaaacaattgcaaagaacttaagcctagttttctgttttcttctttcctaccaatctgtggctgctagggccagagacaagcagaccatctccagagagaggagatgtagggaggatggagagcccccaagagcgagagcaccccatagtctgcacygtctttcatgctcttctgtctgtccttcccttcctcctttcccttcttttcttccctccttcctttcctttctttctttcccttccttttcttctctctcttccccttctcctcccccttccctcccttctctaccctttccttccctagtgccccatggtatgaccctggtccctgactatgaccacaatgtaatgaatttaatgcagagaagccatatggacagaatcatatacacaacagaccagatacacaatcagaaacgtggccagcctacaaaggaaagccccatagagcaac

SEQ ID NO: 17863 - DNA, 601 bp, Human
cctgtagtctcagctactcgagaggctgaggcagcagaatcgcctgaacccgggaggcagatgttgcggtgagctgagattgcaccattgcactccagcctgggcgacaagagtgaaattccaccaaaaaaaaaaacaaaagcaaaacgaaacaaaaaaaacacttcctctctgccaggcatatcctagttgttcagtctagataagggacatcaactgcagatgcctacaggggtggcgcctgtccagtccaaggggaacaggtgggtaggcatggggggaatcaacccgcagccacagyagcagtgggaacgcaataaccttgtgttcataaacttctaatatctcaggagaagccataaacctcacattaataactcaaaaacaaacaccatgaggacacaaccaaacattccagcaggtcagaaatagcccatatattagtccacttttgcttcgctataaagaaatacctgaggccgggtaatttgtaaagaaaaggggctcatggttctgcagactgtacaagcctggcaccagcatctgctcagcttctggtaagccctcaggaagcttccaatcatggcggaaggtgaagtgg

SEQ ID NO: 17864 - DNA, 601 bp, Human
ctcatgcctgtaatcccagcactttgggaggctgaagtgggaagatcacctgaggtcaggagttcaagaccagcctgaccaaaaaggtgaaaccctgtctctactaaaaatacaaaattagctgggtgtggtggtacatgcctgtagtctcagctactcgagaggctgaggcagcagaatcgcctgaacccgggaggcagatgttgcggtgagctgagattgcaccattgcactccagcctgggcgacaagagtgaaattccaccaaaaaaaaaaacaaaagcaaaacgaaacaaaaaaaacacttcctctctgccaggcatatcctagttgttcagtctagataagggacatcaactgcagatgcctacaggggtggcgcctgtccagtccaaggggaacaggtgggtaggcatggggggaatcaacccgcagccacagcagcagtgggaacgcaataaccttgtgttcataaacttctaatatctcaggagaagccataaacctcacattaataactcaaaaacaaacaccatgaggacacaaccaaacattccagcaggtcagaaatagcccatatattagtccacttttgcttcgct

SEQ ID NO: 17865 - DNA, 601 bp, Human
ctcctctccgggctgggcacggtggctcatgcctgtaatcccagcactttgggaggctgaagtgggaagatcacctgaggtcaggagttcaagaccagcctgaccaaaaaggtgaaaccctgtctctactaaaaatacaaaattagctgggtgtggtggtacatgcctgtagtctcagctactcgagaggctgaggcagcagaatcgcctgaacccgggaggcagatgttgcggtgagctgagattgcaccattgcactccagcctgggcgacaagagtgaaattccaccaaaaaaaaaaacaaaagcaaaacgaaacaaaaaaaacacttcctctctgccaggcatatcctagttgttcagtctagataagggacatcaactgcagatgcctacaggggtggcgcctgtccagtccaaggggaacaggtgggtaggcatggggggaatcaacccgcagccacagcagcagtgggaacgcaataaccttgtgttcataaacttctaatatctcaggagaagccataaacctcacattaataactcaaaaacaaacaccatgaggacacaaccaaacattccagcaggtcagaaatagccca

SEQ ID NO: 17866 - DNA, 601 bp, Human
gaagccatttcatgcagagaaaaaaagtatgtccacacataactcaatatctctgatatcactctagtatagcatcctgtttgtagcaatgtctgtgaaccatcaaaaaggtgggtagaacaaatttcttagtataaatcaatatattagaaagaattagaaatcataaagtactaatgtaggttgggttttcttttattcttatttttactatatatgctagtcataagtagcagtggggcctggccaaagtgtatgtcatatggtatcctgcccaagaaatggataaagaaaatgcccwtctgaagaataaattatcaggacagaaaactgttcacatagcatttggacaaatttctttccagaaagagaaaaaagtggaatgcttaataaataagactttggtaccttggaagaatgaacccatcccaggagtctgagcagtgtattactcagcacattggagacttcaaatgtatgacgaattgctctaatgctctgtaggtgtcgaattttaagtactagagtagatcatagacttatttgagctagtaaggaaaactattactggacttcattaaagaaacatttactgaaaaca

SEQ ID NO: 17867 - DNA, 601 bp, Human
agggtaccagtggagatgggcacagtggcatcagcaatcatcaggcagtaacagtgaagaggaagccaaaaatgcaaacaacagacataaaaactcaaatggacaacagggttggaagccatttcatgcagagaaaaaaagtatgtccacacataactcaatatctctgatatcactctagtatagcatcctgtttgtagcaatgtctgtgaaccatcaaaaaggtgggtagaacaaatttcttagtataaatcaatatattagaaagaattagaaatcataaagtactaatgtaggttgrgttttcttttattcttatttttactatatatgctagtcataagtagcagtggggcctggccaaagtgtatgtcatatggtatcctgcccaagaaatggataaagaaaatgcccttctgaagaataaattatcaggacagaaaactgttcacatagcatttggacaaatttctttccagaaagagaaaaaagtggaatgcttaataaataagactttggtaccttggaagaatgaacccatcccaggagtctgagcagtgtattactcagcacattggagacttcaaatgtatgacgaatt

SEQ ID NO: 17868 - DNA, 601 bp, Human
aagccaccacacctggtcttgtcttattttcacacaatctaacaatgtgttcaagcaagcttaactatctttttttaactggctgtactaatttataagctgagagctatagaggggaggagggtaccagtggagatgggcacagtggcatcagcaatcatcaggcagtaacagtgaagaggaagccaaaaatgcaaacaacagacataaaaactcaaatggacaacagggttggaagccatttcatgcagagaaaaaaagtatgtccacacataactcaatatctctgatatcactctartatagcatcctgtttgtagcaatgtctgtgaaccatcaaaaaggtgggtagaacaaatttcttagtataaatcaatatattagaaagaattagaaatcataaagtactaatgtaggttgggttttcttttattcttatttttactatatatgctagtcataagtagcagtggggcctggccaaagtgtatgtcatatggtatcctgcccaagaaatggataaagaaaatgcccttctgaagaataaattatcaggacagaaaactgttcacatagcatttggacaaatttctttccagaa

SEQ ID NO: 17869 - DNA, 601 bp, Human
agtgttgaggctacaggagtaagccaccacacctggtcttgtcttattttcacacaatctaacaatgtgttcaagcaagcttaactatctttttttaactggctgtactaatttataagctgagagctatagaggggaggagggtaccagtggagatgggcacagtggcatcagcaatcatcaggcagtaacagtgaagaggaagccaaaaatgcaaacaacagacataaaaactcaaatggacaacagggttggaagccatttcatgcagagaaaaaaagtatgtccacacataactcawtatctctgatatcactctagtatagcatcctgtttgtagcaatgtctgtgaaccatcaaaaaggtgggtagaacaaatttcttagtataaatcaatatattagaaagaattagaaatcataaagtactaatgtaggttgggttttcttttattcttatttttactatatatgctagtcataagtagcagtggggcctggccaaagtgtatgtcatatggtatcctgcccaagaaatggataaagaaaatgcccttctgaagaataaattatcaggacagaaaactgttcacatagcattt

SEQ ID NO: 17870 - DNA, 601 bp, Human
caatcataactcactgcagccttaaacctctgggctcaagcaatcctcctacctcagcctctcagttagctagaactgcaggtgcatgccaccatgcctggctaattggattttacttttttgtgtgtagagatggggtcttgctgtattgcccaggctggtctcaaactcctagccttaagggatcctgctgcctctgaaagtgttgaggctacaggagtaagccaccacacctggtcttgtcttattttcacacaatctaacaatgtgttcaagcaagcttaactatctttttttaacyggctgtactaatttataagctgagagctatagaggggaggagggtaccagtggagatgggcacagtggcatcagcaatcatcaggcagtaacagtgaagaggaagccaaaaatgcaaacaacagacataaaaactcaaatggacaacagggttggaagccatttcatgcagagaaaaaaagtatgtccacacataactcaatatctctgatatcactctagtatagcatcctgtttgtagcaatgtctgtgaaccatcaaaaaggtgggtagaacaaatttcttagtataaatcaatata

SEQ ID NO: 17871 - DNA, 601 bp, Human
tggtgaaaccccgtccctactaaaaatacaaaaattagctggatgtgatggtgcacacctgtagtcatagctacttgggaggctgaggcataagaatcacttgaacccaggaggtggaggttgcagtgagctgagatcgtgccactgtactccagcctgggtgacagagcaagactctgtgtcaaaaaatatatatatatgaacctattgtcagtatattagggtggccaagcaccatttcaaataccattatagaaacactatacagagcccaaggttacttacctagtgatatcaatartcaaaaaaccacagcaaagaaattggagggaggtaaaaatgactgagcaagccagttgctttgctcacacagatgccactaccttgtcgtattttctttttatttattttctttttttgagacggggtctcacttcatcccccaggctgcagtgcagtggcacaatcataactcactgcagccttaaacctctgggctcaagcaatcctcctacctcagcctctcagttagctagaactgcaggtgcatgccaccatgcctggctaattggattttacttttttgtgtgtagagatgggg

SEQ ID NO: 17872 - DNA, 601 bp, Human
atttgacagatgggtagccttgaatatcagatgctaagcctccattttcttactgtaaaattggaaaggtattgcttttcagaagactgttttgaggaaaccatctagtctggtttctgtgatattgtaagcattcagaaatactgcacatatttaagatattttaagttcctaagcatcggatcatctcatcctcttcttttatgaccttaattaccattacctacacatggtatccacccaacgcatgtctgaaaaatgcagcaacatcctttatcagtgagattttccatcagccaaygccttgactctgtgggtttgcacgagttcaccctttcatgctcactacttcccccatgtgcatcttctccaggaaacagaattgatgctaaacatcgggacccgagctccatcctccaccccacagagtcaactgaatacacctaaaatcagtggggcccttctaggatacaagtttctcagaagaaaatgaacaccacgagaatgatataaagaccaaggaccgaaagtcctgctaggactgaactgccaagaggattttagaccatgtccaatgatgctatacctcttaaaacaatca

SEQ ID NO: 17873 - DNA, 601 bp, Human
tgcatgacaatttgacttttggttaactgtctggttctgttcctctgataaaaattagattgtcaactaccttcctaggcagtactgcttatagtaaaatcaatccccagttgcaaaatttgcatctggtctggaagaactgtggggagcctgcatcaaggattccctcactggcaatccctggtggggttctcaaaagctgtgcagtggataacagctcccatggggaatgaggctttcaagtcagggctgcctccatgcccaccatatgtgggtctcatcccttcttgcaccccacctractgaacagctgcaagcactctcaaatgcaaggaatatctgacactgtcctgctggcattttgagtgaccttttatccttctacatggcctggtctcaaatgtggtctacaacagtcttatggatctggattgtttcaacgaatctaggaagacctcagcgaacgttgaaattcgtctcctagtttgatctatatagacgctgctttttcacaattagatgagtacattatgacaatatccactcagtgacagtgatttctaagtagttccttgagaggaagaatgaattaagcagagat

SEQ ID NO: 17874 - DNA, 601 bp, Human
gcagtcattgtaggttacagaaacacacgcaaaagtccataatttcaggagacagttactcttaagcaaatgtaagtttaaaataaataacttagatacttcttaatattttaaatatatatatatagaaatggagtctctctctgtcacccaggctggtgtgcagtggtgctatctcggttcactgcagcctccacctcccaggttcaagcgattctcctgcctcagcctcctgagtagctgggattacaggcacccaccagctcacctggctaatttttgtatttttagtagagactgmgtttcgccatgttggccaggctggtctcaaacccctgacctccacctgcctcagcctcccaaagtgcagggattacaggcgtcagccaccgcgcctggccaatatacacattttacaatttatatacatacatataatataagcatgtgtgttaagcctcaaatactggaaacaatgtgtgtgatatgccttaaatacagaataagagatttatgtcaaaccattctctaatatcatatgtcatagaatatagaaataagtagatcaagggaggtggtgggattacaaatcaaatacatt

SEQ ID NO: 17875 - DNA, 601 bp, Human
tggcctggaactcctgggtggcctcgctctcctggtggaccaggaaatcccagtcctgggggccccacaggtcctgctttgcctggggggcccagaggtccaggaaatcctttaccacctggggtcgcatcttcatgatccccctgggaatgttatgtcatgagtcaattaccaaccactgaatgtccatgaactcaaagcagtcattgtaggttacagaaacacacgcaaaagtccataatttcaggagacagttactcttaagcaaatgtaagtttaaaataaataacttagatacttyttaatattttaaatatatatatatagaaatggagtctctctctgtcacccaggctggtgtgcagtggtgctatctcggttcactgcagcctccacctcccaggttcaagcgattctcctgcctcagcctcctgagtagctgggattacaggcacccaccagctcacctggctaatttttgtatttttagtagagactgagtttcgccatgttggccaggctggtctcaaacccctgacctccacctgcctcagcctcccaaagtgcagggattacaggcgtcagccaccgcgcctggcca

SEQ ID NO: 17876 - DNA, 601 bp, Human
ttttttatgtttttagtagagacagggtttcaccgtgttagccaggatggtctcatctcctgacctcgtgatccacccacctcggcctcccaaagtgctgagattacaggcatgagccaccgcacccggcctagagaatctattttaaaccttctgtgattttctacaaggagttatctcagctaaaataacttataaatcataaacttcaatggaggcacaactgtcaaattaaaatgtgagtattcacttctctcgaagttacagctgctgaaagaaatcaaacttttttttatccacycatgaccagtaaaagtaaaaatgaacgttcaatccgtcaacctgcaattctccactccgctgatacggaattatatttccgcactcttgccattgccttgtggtgggcggagtgtaattccctgcccttttacccagggcttggtcatgtgacttgttttgggcaataggaaatgaatgcccatgatccaatcagaggtgtggagggagcctgtgagctgagctggccctcttgcatttctgcaatcacatgagaaaagcctggccttgcaatgagatgcatgttgcaaccccaaaccta

SEQ ID NO: 17877 - DNA, 601 bp, Human
aaagcacttgcaaaaagtaatagagaattttttttttttttttttttgagacagagtcttgctttgtcaccaaggctggagtgcagtgacgcagtctcggctcactgcaagctctgcctcctgggttcacgccattctcctgcctcagcctcccaagtggctgggattgcaggcgcccgccaccacgcctggctaattttttatgtttttagtagagacagggtttcaccgtgttagccaggatggtctcatctcctgacctcgtgatccacccacctcggcctcccaaagtgctgagatkacaggcatgagccaccgcacccggcctagagaatctattttaaaccttctgtgattttctacaaggagttatctcagctaaaataacttataaatcataaacttcaatggaggcacaactgtcaaattaaaatgtgagtattcacttctctcgaagttacagctgctgaaagaaatcaaacttttttttatccacccatgaccagtaaaagtaaaaatgaacgttcaatccgtcaacctgcaattctccactccgctgatacggaattatatttccgcactcttgccattgccttgtggt

SEQ ID NO: 17878 - DNA, 601 bp, Human
aggcaaaaagcacttgcaaaaagtaatagagaattttttttttttttttttttgagacagagtcttgctttgtcaccaaggctggagtgcagtgacgcagtctcggctcactgcaagctctgcctcctgggttcacgccattctcctgcctcagcctcccaagtggctgggattgcaggcgcccgccaccacgcctggctaattttttatgtttttagtagagacagggtttcaccgtgttagccaggatggtctcatctcctgacctcgtgatccacccacctcggcctcccaaagtgckgagattacaggcatgagccaccgcacccggcctagagaatctattttaaaccttctgtgattttctacaaggagttatctcagctaaaataacttataaatcataaacttcaatggaggcacaactgtcaaattaaaatgtgagtattcacttctctcgaagttacagctgctgaaagaaatcaaacttttttttatccacccatgaccagtaaaagtaaaaatgaacgttcaatccgtcaacctgcaattctccactccgctgatacggaattatatttccgcactcttgccattgcct

SEQ ID NO: 17879 - DNA, 601 bp, Human
aaggtccctctaccctgtctcttgtgcgaagacagcttgtcctctaggctcagctcatacccggctctcccatagagtgttcccagatgccagctcacagctccagcctctaagccactcttcctctcacaatcaggcctgcctaccttccacctggcaacagccccagacaggttacacagtccctgctcttggcctttgcagcaccaacatactagctgcggaatcaaattgagttgaatgaaccacagtgagctgccctgcatttgaaaacaatcaataaagtgcaaaggcaaggctrgagattcaggttatttgaaatgtaaccagcaccccaaatgagggaaaacacttgggtaaactgtttatattctacatgcctaaagcaaaataatctaaacgttcttcagtgacctgttccaaaactgagccagctctatgcaccaaaaggacagcaaagccctcataccttcagcccctggacatcccggatcacctctgggtccttttatccctggcactcctgaaagacccctctttcccgggggtcccaggtgaccaaatgcagggtctcccgggattcctttctgaccattcactc

SEQ ID NO: 17880 - DNA, 601 bp, Human
tccacgtgtcctgtgctaatgtactctagtggatgcctaataaacactggcccaccgacttttagaaaagaaccagaatgttctttgtaaacatctgatctgtggttcacatcttgatcaccatcacccaagaggcccactgaagttcagaatgtggggccccaccccagaaataatgaatcagaattcctcagactggggtcctgaagacaataattttaatgagctgccccacccccacttggttatttttaagtacattaaaacctgaaaaactccactggggatcctgaaggatccytactgatttcagaaaaggatatgaatcagtgtccaggccatcttcctctcttgcgtttgatgccctgcctgccaccccaaatggaatgaaggtccctctaccctgtctcttgtgcgaagacagcttgtcctctaggctcagctcatacccggctctcccatagagtgttcccagatgccagctcacagctccagcctctaagccactcttcctctcacaatcaggcctgcctaccttccacctggcaacagccccagacaggttacacagtccctgctcttggcctttgcagcaccaaca

SEQ ID NO: 17881 - DNA, 601 bp, Human
ttttcatatctataaccttcttccattgaacacttcccttagatatattttcacaagtgagatagtcggattactgggtcattatttttattgacttacattatgtttcacctgttactttccaattaattgtttctttcaatatgaatctttttatttacaaacttccatgcaagctccttgagggtgctaattctcctcctctcctccacgtgtcctgtgctaatgtactctagtggatgcctaataaacactggcccaccgacttttagaaaagaaccagaatgttctttgtaaacawctgatctgtggttcacatcttgatcaccatcacccaagaggcccactgaagttcagaatgtggggccccaccccagaaataatgaatcagaattcctcagactggggtcctgaagacaataattttaatgagctgccccacccccacttggttatttttaagtacattaaaacctgaaaaactccactggggatcctgaaggatccctactgatttcagaaaaggatatgaatcagtgtccaggccatcttcctctcttgcgtttgatgccctgcctgccaccccaaatggaatgaaggt

SEQ ID NO: 17882 - DNA, 601 bp, Human
caattattcctctgctgtggataatactacaagggcattttcatatctataaccttcttccattgaacacttcccttagatatattttcacaagtgagatagtcggattactgggtcattatttttattgacttacattatgtttcacctgttactttccaattaattgtttctttcaatatgaatctttttatttacaaacttccatgcaagctccttgagggtgctaattctcctcctctcctccacgtgtcctgtgctaatgtactctagtggatgcctaataaacactggcccaccracttttagaaaagaaccagaatgttctttgtaaacatctgatctgtggttcacatcttgatcaccatcacccaagaggcccactgaagttcagaatgtggggccccaccccagaaataatgaatcagaattcctcagactggggtcctgaagacaataattttaatgagctgccccacccccacttggttatttttaagtacattaaaacctgaaaaactccactggggatcctgaaggatccctactgatttcagaaaaggatatgaatcagtgtccaggccatcttcctctcttgcgt

SEQ ID NO: 17883 - DNA, 601 bp, Human
gagagatagagtgtgtgtgtatgtgtgtgtgtgtgtctgtctttgttctttccaattattcctctgctgtggataatactacaagggcattttcatatctataaccttcttccattgaacacttcccttagatatattttcacaagtgagatagtcggattactgggtcattatttttattgacttacattatgtttcacctgttactttccaattaattgtttctttcaatatgaatctttttatttacaaacttccatgcaagctccttgagggtgctaattctcctcctctcctccaygtgtcctgtgctaatgtactctagtggatgcctaataaacactggcccaccgacttttagaaaagaaccagaatgttctttgtaaacatctgatctgtggttcacatcttgatcaccatcacccaagaggcccactgaagttcagaatgtggggccccaccccagaaataatgaatcagaattcctcagactggggtcctgaagacaataattttaatgagctgccccacccccacttggttatttttaagtacattaaaacctgaaaaactccactggggatcctgaaggatccctact

SEQ ID NO: 17884 - DNA, 601 bp, Human
aaatttctactcactagaaagacagggtcataatcttcaggaaagaacatcccccataattccacaccctaacccaaaaatctactttgttttcctatgttttctttacattttggttcatatgtttacatttaaaaatagtaatcagtgcaaattcagttgttggagcgcttcagattgcatattaatctgcaaatgttttccagtttgttgcagtctttacaaatatgatttaaattgctaatggctggatggtattcctttgagagatagagtgtgtgtgtatgtgtgtgtgtgtgtmtgtctttgttctttccaattattcctctgctgtggataatactacaagggcattttcatatctataaccttcttccattgaacacttcccttagatatattttcacaagtgagatagtcggattactgggtcattatttttattgacttacattatgtttcacctgttactttccaattaattgtttctttcaatatgaatctttttatttacaaacttccatgcaagctccttgagggtgctaattctcctcctctcctccacgtgtcctgtgctaatgtactctagtggatgcctaat

SEQ ID NO: 17885 - DNA, 601 bp, Human
ttttatgagagatttcatcacttgtattctcaaatttctactcactagaaagacagggtcataatcttcaggaaagaacatcccccataattccacaccctaacccaaaaatctactttgttttcctatgttttctttacattttggttcatatgtttacatttaaaaatagtaatcagtgcaaattcagttgttggagcgcttcagattgcatattaatctgcaaatgttttccagtttgttgcagtctttacaaatatgatttaaattgctaatggctggatggtattcctttgagagrtagagtgtgtgtgtatgtgtgtgtgtgtgtctgtctttgttctttccaattattcctctgctgtggataatactacaagggcattttcatatctataaccttcttccattgaacacttcccttagatatattttcacaagtgagatagtcggattactgggtcattatttttattgacttacattatgtttcacctgttactttccaattaattgtttctttcaatatgaatctttttatttacaaacttccatgcaagctccttgagggtgctaattctcctcctctcctccacgtgtc

SEQ ID NO: 17886 - DNA, 601 bp, Human
ctgtatgaatttgcattttatgagagatttcatcacttgtattctcaaatttctactcactagaaagacagggtcataatcttcaggaaagaacatcccccataattccacaccctaacccaaaaatctactttgttttcctatgttttctttacattttggttcatatgtttacatttaaaaatagtaatcagtgcaaattcagttgttggagcgcttcagattgcatattaatctgcaaatgttttccagtttgttgcagtctttacaaatatgatttaaattgctaatggctggatgstattcctttgagagatagagtgtgtgtgtatgtgtgtgtgtgtgtctgtctttgttctttccaattattcctctgctgtggataatactacaagggcattttcatatctataaccttcttccattgaacacttcccttagatatattttcacaagtgagatagtcggattactgggtcattatttttattgacttacattatgtttcacctgttactttccaattaattgtttctttcaatatgaatctttttatttacaaacttccatgcaagctccttgagggtgctaattctcctcc

SEQ ID NO: 17887 - DNA, 601 bp, Human
ctaactttgcatcaggctttacatcaaatctctacaatatttacaaacccagtttgcactgtatgaatttgcattttatgagagatttcatcacttgtattctcaaatttctactcactagaaagacagggtcataatcttcaggaaagaacatcccccataattccacaccctaacccaaaaatctactttgttttcctatgttttctttacattttggttcatatgtttacatttaaaaatagtaatcagtgcaaattcagttgttggagcgcttcagattgcatattaatctgcaaaygttttccagtttgttgcagtctttacaaatatgatttaaattgctaatggctggatggtattcctttgagagatagagtgtgtgtgtatgtgtgtgtgtgtgtctgtctttgttctttccaattattcctctgctgtggataatactacaagggcattttcatatctataaccttcttccattgaacacttcccttagatatattttcacaagtgagatagtcggattactgggtcattatttttattgacttacattatgtttcacctgttactttccaattaattgtttctttcaata

SEQ ID NO: 17888 - DNA, 601 bp, Human
aagggcagatcatttgagtaaatgtttcccagtagggatgaatgtagattataaaaaatatttttaacagaaaacaaaaagaaaaaacaaacatgtatttgtatttcctcttggtggagggaaactaatagaagaaaactttccaggtttttcctgaagctctacagccgagaagaagtcagagccggtgtctagcattattggtgctagaaatatggctgtagcggaaagttttgcctcaatctggttttaatttttcaagtgcgtatattactgcatttggataaaagcaatgggattkaaatgacagagtaaacaatgtgaatagtgaaatgaagatcatattgaaaatagcccctgctatgttctgaatgtgtccctccaaaattcatatgttgaaagttaatcaccaatgtgatagtattaaaaggtgaacacttggggaggtgattaagtcataagggcagagccctcatgaataagattggtgaccttattaaagaggtgcaaaagagctgtttgccccatctgcctgtgaggacacaaggaaggcacaccaaatctgctggcagcttgatcttggacttcccagcctcctgag

SEQ ID NO: 17889 - DNA, 601 bp, Human
gcttaaacaatgcgttaaacaacagtaaagcaatatttgttggctaaaataacagtagcaactttccatcaatctaagaatatatttttctagatgccataaatagaagggcagatcatttgagtaaatgtttcccagtagggatgaatgtagattataaaaaatatttttaacagaaaacaaaaagaaaaaacaaacatgtatttgtatttcctcttggtggagggaaactaatagaagaaaactttccaggtttttcctgaagctctacagccgagaagaagtcagagccggtgtctarcattattggtgctagaaatatggctgtagcggaaagttttgcctcaatctggttttaatttttcaagtgcgtatattactgcatttggataaaagcaatgggattgaaatgacagagtaaacaatgtgaatagtgaaatgaagatcatattgaaaatagcccctgctatgttctgaatgtgtccctccaaaattcatatgttgaaagttaatcaccaatgtgatagtattaaaaggtgaacacttggggaggtgattaagtcataagggcagagccctcatgaataagattggtgacctt

SEQ ID NO: 17890 - DNA, 601 bp, Human
gccctctagcctgggctacagagcaagcctctgtctcctaaaaaaaataataataataaaataaaaaaataaaataaaaattccatgctctgccgccccatcctcagtttcctacctacagacctgaagtgtgggccctgatgtgtctgagtcctaatcccctaacagggggtagggatgagagtggggaccccctccaaaatgaaaatgcacccttcccgaccctaggagtttaccgtgctacccagtcttcatgaattctgtggccctaacacctacaaaccccttttcccattgaccrgtacagaaacatttcgccactggaaataacgatacagaggacaagagcaagggaggcatcattaagggaaggacaaagccagactaacagttaactctttttgtgtggtcatctgtccagtcttcacttggcagtggatttcatgtttctaagatgggaggacatcatggaaaaagcactacctaccctttggacctggaggaccaggtagcccatcatctccaaagggacctgggattcctgggaggcctgggggaccatgtgccccaggccgtcctgggagtccggggaggcctttca

SEQ ID NO: 17891 - DNA, 601 bp, Human
agacctgcaatcctggcactagggagaccaaggcaggaggatctttgaggccaggatttcaagatcagcctggctaaaatagcgagatcctgtctcctaaaaaaaaaaaaaattaggcgtggtggcacatgcctctcaggaggctgaggtaggaggatcacttgagcccaggagttcaaggctgcagtgagctatgatcctgccactgccctctagcctgggctacagagcaagcctctgtctcctaaaaaaaataataataataaaataaaaaaataaaataaaaattccatgctctgcygccccatcctcagtttcctacctacagacctgaagtgtgggccctgatgtgtctgagtcctaatcccctaacagggggtagggatgagagtggggaccccctccaaaatgaaaatgcacccttcccgaccctaggagtttaccgtgctacccagtcttcatgaattctgtggccctaacacctacaaaccccttttcccattgaccggtacagaaacatttcgccactggaaataacgatacagaggacaagagcaagggaggcatcattaagggaaggacaaagccagactaacagtta

SEQ ID NO: 17892 - DNA, 601 bp, Human
attttaattcaatatgaggctacttgcccaaaaggccttaagggcaaaaatccttgggtctgaaaattgtcaagcattttttctcaacactggaaaggaaatactaccttcacccattagagccacaggactaaggagtaggagtaaatatttaacagggatggggacataatatttaaaccattggtctcaaaacttatttttcatagtaaagaaaacatttttttctttttctttttttttttttttttttttggagacagaatctcactctgtcacccaggctggagtgcagtggcaygatctctgctcactgcaagctccacctcccaggttcacaccattctcctgcctcagcctcccgagtagctgggactacaggtgcccaccaccacacctggctaattttttgtagttttagtagagacagggtttcgccgtgttaccaggatggtctcgatctcctgacctcatgatctgcccgtctcggcctcccaaagtgctgggattacaggcgtgagccaccacacctggccagaaaactttttttttcaaatgaagcttggggaaactctactcgtggcccagatgaaagtggact

SEQ ID NO: 17893 - DNA, 601 bp, Human
gcgttagtccaaattttaatttttagtgggataattgtatagtagcataatagcacagcaaacatcacttatctaagctagcaaagagtgactctttgattctttgattccacataaataatttacaagctagtaaaacaaaaaattgtggtagaatcaatcaactaagaagaaaaggtaattttaattcaatatgaggctacttgcccaaaaggccttaagggcaaaaatccttgggtctgaaaattgtcaagcattttttctcaacactggaaaggaaatactaccttcacccattagwgccacaggactaaggagtaggagtaaatatttaacagggatggggacataatatttaaaccattggtctcaaaacttatttttcatagtaaagaaaacatttttttctttttctttttttttttttttttttttggagacagaatctcactctgtcacccaggctggagtgcagtggcatgatctctgctcactgcaagctccacctcccaggttcacaccattctcctgcctcagcctcccgagtagctgggactacaggtgcccaccaccacacctggctaattttttgtagttttag

SEQ ID NO: 17894 - DNA, 601 bp, Human
tgtaattccagctactcgggaggctgaggcaggagaatcgcttgaacccgggaggcagaggttgcagtgagctgagatggtgccactgcactccagcctgggcgacaagagcaaaactccatctcaaaaaaaaaaaagtcttttctaatctcagtgttattggggaaagttgcctaacaaatgtgatctgtaaaaatgtcaacttatttgatatggttaaaaactcttaagtgtttacctctttctcctgggaatccatcatctccaggaggtccaggttccccaggtgttcccttttgtsaaatgatagccatttctccttcatctccgggaggtcctatggctcctatggatattaattatgcaagaacaaaatgaacaggaacatcacacacataatttatccattactacatttcactcccaaatcgcaaattcccacttaacctacgaagctctatttatgtagatcacaaaatgtcaccattgttggctgatttcctaaaggaaggtcagtcatcttttacgttcctgaccccatttgtccagccacagagtctggtgtgccaggagtgctcactgaatgtttgccaaattcaac

SEQ ID NO: 17895 - DNA, 601 bp, Human
gagcacacaaatggggttgtcaaaaatcctcgctctgcaatgtttctgtggaccattagcatgggcattggggtgtctgttagaaaggcaggatacctggctgccccagagctgctgaatcagaatctgcattttaacaagctctccaggtgattaatgtgctctgaagtttgagaggcactggtcacaatgacttgaacagtcattgcgctattcactttaaaaccaactaccaaacctgaaaccagtattttatgtatagctcaggttgatcccagtttagaatatccaaatctaggartacacaggaacttcagctaaattttagcatggagaagcaaaaaatgtaccacaaggtttatttgtgtttatttatatctaaaaaaaatggccttttctcacagtggttcacgcctgtaatccagcattttgggaggccgaggcgggtggatcacctgaggtcaggagtttgagaccagcctggccaacatggtgaaacccccatctttactaaaaatacaaaaattagccaggcgtggtggcatgcgcctgtaattccagctactcgggaggctgaggcaggagaatcgcttgaacccgg

SEQ ID NO: 17896 - DNA, 601 bp, Human
ctattttctccttgagctacaccttacattctaaaagccagtgaaagggcaatggtatatacgctggcaaattatagctccttacggacatcctaagaacagaaaggttttattgtctcttcccccacaaagcagtagccccttacctggtcacctggaagtcctggaaaaccaatgaaccctcttagaccagttgagcctggagggcctgggggtccaggaggccctggctgacctttctcaccaggttcccctctgtgaaatccaggtggtccgtatcttcccggctctcctcttctcycttgcatcccgggagttcctttatcacctgatgaagttggaagtgttacaggtctctgctgaaattttgagctaggtaatagttaagctgagggacctggtcctacttttaggagataaagccaaaggtattgaggattctgattgctgtcccaagccgcttcctgatcatttctggcttcagtgacctcattgatgaaagaagctgcctgggaatatctaaggactatcagaggtgggaaggagcacacaggattatttgcctccgctgcttattttacaaatgaagaagcacttaccc

SEQ ID NO: 17897 - DNA, 601 bp, Human
agtggtaacgaaagtttaaatgcatgcaagcctcccactacatgtatctagtttttcaaagttgatatagcttctccagaattagagttctcagtcgcaactggtagcatcccattctctacacttggttgtgaaacagtaattgtgttactaatttgaattttaaattacaaataaacaagttgatactaaataaaatagtattataaatcacagcatatgaaagactttacaaatccatttcattccaaaagatggatagtgagttacgtgttttccagaagtataatgttggcaactrcatgtattgtacctcctggattctgaaagggtattttactcatggttgtgaagacgaaatatattgaaagcaaaatctgtgatatctgaaactggaagactttaaagacaggatttgggtgatttttcaggacgactttcattccagtaaaccagtggtcatgaggcaagtcttcatgggtggtttaaaccaggctgggagatagcgattatatgactctatgttaggggaaccaggcaggagcactggtcagaaatgtcagtttcatcgtggccttctagaaggctctattttctcctt

SEQ ID NO: 17898 - DNA, 601 bp, Human
agcctctatgtcctaactgggactctaaaagctgtacttatgaagtccttagaaaagatactggctcctgcgggacatagggtttctaagccaaagtgggcacggcccactgacatggatctgttctccttgcaactgagctgttacttgaggggctgcagtcactccatggactgctgctgggactctcacagaggaggaagacacgaagagcctgcaggcatgctgttttctatctgatacccttggatctgagtgacaactgtagaatatttggatcttgagtgtttgactgtctaasaagagccccttgggtgttgcagtttctttgatacactttgcttatcatgtaaaaggcacttgtttacaatgttataaacattcgggactatgcatttgacagatggcttctgtatctccaaaccatacctttaggtcctcttgctccatcaattcctgaaaatccagggggacctggagaacctggctcaccctgacagtttaatgaaacaaaaggccttaatcagatttcaaatacaaatggcacatgcacaacacgatccagttgtaattttctgtaactaatttggtttttgtaatc

SEQ ID NO: 17899 - DNA, 601 bp, Human
tcttagcacctgctggaaagtcatggctttagcctctatgtcctaactgggactctaaaagctgtacttatgaagtccttagaaaagatactggctcctgcgggacatagggtttctaagccaaagtgggcacggcccactgacatggatctgttctccttgcaactgagctgttacttgaggggctgcagtcactccatggactgctgctgggactctcacagaggaggaagacacgaagagcctgcaggcatgctgttttctatctgatacccttggatctgagtgacaactgtagaayatttggatcttgagtgtttgactgtctaacaagagccccttgggtgttgcagtttctttgatacactttgcttatcatgtaaaaggcacttgtttacaatgttataaacattcgggactatgcatttgacagatggcttctgtatctccaaaccatacctttaggtcctcttgctccatcaattcctgaaaatccagggggacctggagaacctggctcaccctgacagtttaatgaaacaaaaggccttaatcagatttcaaatacaaatggcacatgcacaacacgatccagttgtaa

SEQ ID NO: 17900 - DNA, 601 bp, Human
aataataataataataaaaaacccaattgtaaattacatctatcttgggacttcttaagtgaactcttagcacctgctggaaagtcatggctttagcctctatgtcctaactgggactctaaaagctgtacttatgaagtccttagaaaagatactggctcctgcgggacatagggtttctaagccaaagtgggcacggcccactgacatggatctgttctccttgcaactgagctgttacttgaggggctgcagtcactccatggactgctgctgggactctcacagaggaggaagacaygaagagcctgcaggcatgctgttttctatctgatacccttggatctgagtgacaactgtagaatatttggatcttgagtgtttgactgtctaacaagagccccttgggtgttgcagtttctttgatacactttgcttatcatgtaaaaggcacttgtttacaatgttataaacattcgggactatgcatttgacagatggcttctgtatctccaaaccatacctttaggtcctcttgctccatcaattcctgaaaatccagggggacctggagaacctggctcaccctgacagtttaatg

SEQ ID NO: 17901 - DNA, 601 bp, Human
ttaatgaagcctctctttcactagaatgttaggtgtgttacaatgcagcactgtttttgacacaaggtaaactaaggcccgtggggccaaatctagcctgcagccaattttgcaaataaagttctattggaaaacagccacactcctttgtttacatatagcctatggctgctttcacactataacaacacagttgaatagttgtgactgagaccatatggcccaacaagctgaaaattgttatgatctggccctttaggaaaaaaatattttgctatagtaaaaaaataataataataawaaaaaacccaattgtaaattacatctatcttgggacttcttaagtgaactcttagcacctgctggaaagtcatggctttagcctctatgtcctaactgggactctaaaagctgtacttatgaagtccttagaaaagatactggctcctgcgggacatagggtttctaagccaaagtgggcacggcccactgacatggatctgttctccttgcaactgagctgttacttgaggggctgcagtcactccatggactgctgctgggactctcacagaggaggaagacacgaagagcctgcagg

SEQ ID NO: 17902 - DNA, 601 bp, Human
ttttaagcatggcccaatacaagcatgaaggaagtgagaagaggtaggtttttactgtgaaagaatggtaaagagactaataaatgtataggtaagcagaaaaggagtgacttctgaaccccaaagttataaaatatcaaaatcaaatataaaactttttccatttgtaaccatttcccaagaagggatctatattattctttctgaagaaataagcccacacaggtcatgtttgttatagcatttagtatattatttatagagtgtctctcaaagtagtaaggcagaggattgtaggtcrttcattaattagtattttatattttaaatttcttttaacttatatcaaaataaaggataactgcatgttaacctgtgaatttacagctagttacgctaaggctaaggttaaaaaggtaaatcattttaaagtagatttaaagaaaaatattaacccaatggtataccaagatagtaaaactattaaaggttttatgcaaacattgcaactaagatatcctgctctttgtttgtttacttgtttgtctgaataaagggttaatgaagcctctctttcactagaatgttaggtgtgttacaa

SEQ ID NO: 17903 - DNA, 601 bp, Human
atttcaattccttttaagcatggcccaatacaagcatgaaggaagtgagaagaggtaggtttttactgtgaaagaatggtaaagagactaataaatgtataggtaagcagaaaaggagtgacttctgaaccccaaagttataaaatatcaaaatcaaatataaaactttttccatttgtaaccatttcccaagaagggatctatattattctttctgaagaaataagcccacacaggtcatgtttgttatagcatttagtatattatttatagagtgtctctcaaagtagtaaggcagagrattgtaggtcattcattaattagtattttatattttaaatttcttttaacttatatcaaaataaaggataactgcatgttaacctgtgaatttacagctagttacgctaaggctaaggttaaaaaggtaaatcattttaaagtagatttaaagaaaaatattaacccaatggtataccaagatagtaaaactattaaaggttttatgcaaacattgcaactaagatatcctgctctttgtttgtttacttgtttgtctgaataaagggttaatgaagcctctctttcactagaatgttag

SEQ ID NO: 17904 - DNA, 601 bp, Human
gacagagatgaagccagttggtagacaggtaagtgaaaaaatagaccatgggaaaaagtgagaaaccatggattgactaagggctagggttcctttagctttggcagaactatgtctcctatctgtgggatccatgagacatctttgactccaggtattttgagtgcatttcaattccttttaagcatggcccaatacaagcatgaaggaagtgagaagaggtaggtttttactgtgaaagaatggtaaagagactaataaatgtataggtaagcagaaaaggagtgacttctgaaccccraagttataaaatatcaaaatcaaatataaaactttttccatttgtaaccatttcccaagaagggatctatattattctttctgaagaaataagcccacacaggtcatgtttgttatagcatttagtatattatttatagagtgtctctcaaagtagtaaggcagaggattgtaggtcattcattaattagtattttatattttaaatttcttttaacttatatcaaaataaaggataactgcatgttaacctgtgaatttacagctagttacgctaaggctaaggttaaaaaggtaaatc

SEQ ID NO: 17905 - DNA, 601 bp, Human
ggcagaaaccaaaagcattatcatgagctgtcctgatgtagaacatattggagtacaacccaacatatccagaaatatccagaaaagatactgtgtagacagagatgaagccagttggtagacaggtaagtgaaaaaatagaccatgggaaaaagtgagaaaccatggattgactaagggctagggttcctttagctttggcagaactatgtctcctatctgtgggatccatgagacatctttgactccaggtattttgagtgcatttcaattccttttaagcatggcccaatacaagcawgaaggaagtgagaagaggtaggtttttactgtgaaagaatggtaaagagactaataaatgtataggtaagcagaaaaggagtgacttctgaaccccaaagttataaaatatcaaaatcaaatataaaactttttccatttgtaaccatttcccaagaagggatctatattattctttctgaagaaataagcccacacaggtcatgtttgttatagcatttagtatattatttatagagtgtctctcaaagtagtaaggcagaggattgtaggtcattcattaattagtattttatatttt

SEQ ID NO: 17906 - DNA, 601 bp, Human
tatctgattttactcataataatggccaattgcttgaggggtgggattctggcccattccaggtcaaacaagtctttccttgagaagatggaataagaaagtgagaatttgaagtccttggctactggggcagaaaccaaaagcattatcatgagctgtcctgatgtagaacatattggagtacaacccaacatatccagaaatatccagaaaagatactgtgtagacagagatgaagccagttggtagacaggtaagtgaaaaaatagaccatgggaaaaagtgagaaaccatggattgmctaagggctagggttcctttagctttggcagaactatgtctcctatctgtgggatccatgagacatctttgactccaggtattttgagtgcatttcaattccttttaagcatggcccaatacaagcatgaaggaagtgagaagaggtaggtttttactgtgaaagaatggtaaagagactaataaatgtataggtaagcagaaaaggagtgacttctgaaccccaaagttataaaatatcaaaatcaaatataaaactttttccatttgtaaccatttcccaagaagggatctatattat

SEQ ID NO: 17907 - DNA, 601 bp, Human
atggttgggagccagtttgaagtggaggactcaaaatggagtgggaggaaaggcaagaaaatagatggggtttcaagagaattacagaggtaagttagatgtatcttatagtaactgcccatttacactcctttctaaaggagttccaccagcaccttgtggaagtctttctcctatctgattttactcataataatggccaattgcttgaggggtgggattctggcccattccaggtcaaacaagtctttccttgagaagatggaataagaaagtgagaatttgaagtccttggctactrgggcagaaaccaaaagcattatcatgagctgtcctgatgtagaacatattggagtacaacccaacatatccagaaatatccagaaaagatactgtgtagacagagatgaagccagttggtagacaggtaagtgaaaaaatagaccatgggaaaaagtgagaaaccatggattgactaagggctagggttcctttagctttggcagaactatgtctcctatctgtgggatccatgagacatctttgactccaggtattttgagtgcatttcaattccttttaagcatggcccaatacaagc

SEQ ID NO: 17908 - DNA, 601 bp, Human
ctgcaatcatatttcaagctcttttataaggcagctcaactcagtgtccttgcaaaaagaaaatcacaaaggcatactgcattgatgacaagagatggcacattcaaaagccactgtaggccatgactcccacagtcccacaaagctactggtcactccataatgcttccagacacaaggacctacattatggttgggagccagtttgaagtggaggactcaaaatggagtgggaggaaaggcaagaaaatagatggggtttcaagagaattacagaggtaagttagatgtatcttatagyaactgcccatttacactcctttctaaaggagttccaccagcaccttgtggaagtctttctcctatctgattttactcataataatggccaattgcttgaggggtgggattctggcccattccaggtcaaacaagtctttccttgagaagatggaataagaaagtgagaatttgaagtccttggctactggggcagaaaccaaaagcattatcatgagctgtcctgatgtagaacatattggagtacaacccaacatatccagaaatatccagaaaagatactgtgtagacagagatgaag

SEQ ID NO: 17909 - DNA, 601 bp, Human
aatgctatggaagtgtttatatataacccgttttatctataccttaatgcacaaaggggtaagaaaatattgatacgatcattgccagctagaagtaattgttctgcttttcaaactaaactactttttttgttttagtaagaaaaatatgcagctatacctggacatccagggctacctggctcaccctttggaccaggtggaccaaagtgactggcagggtcacctttgtttcctgaaagggataaaatgcatgtgacattactttagacaatttaatttggtctcatacaggtgacartaacgtttatggtatttgtatagcttatcttcagatattttaggagagtgtttttaaatacttttattctaaataagaacaaatagaaatatagatgcaagatgcaatttacataccacacacacacacacacacacacacacacacacggttttagaatacatcacaatcataaggatctccaggtattgataagtttgagtttttaagtcctgaaaaaattttcaactttaggtttctatttaagaaattatttggcattgagtggctatatccttatgttttagaaaccaaaatcaa

SEQ ID NO: 17910 - DNA, 601 bp, Human
cctctaggggtcctgttctgtcggcttgaactcaaatggtttccctttccctgtaaagcatggagctgtgcataacactggcaccccccttctgctgtgggtcatctaatgtagccagttgtggcctcaactgtcacaagaactcaatggtgcatcacaatccattctgaaggattccatgttaaattattattgagaagcaaaatactgtttaaaatgacttagatttcttgttggtgatgaggtttatgtttgcttgatttggtttgatttttagtaaattaaaatagattcaatgatrgctcaacaatggcgcaccacttacactggcatgtgcttttctcagtagaaagaaagagctggaatgacaacctgcagctgtagtcattgtgagtggttattgcgaatgcatcattttaaatgatagagggtgcaaaatggtccagattttaattgtttgcaatattcatttttgagtttgccaaaatatgggcatgcctggggagtttattattgtgtcaacatcatcggtcacatgagccatgatggaaaaatgattgtgaatccctagtatgtaaccctggtgttcttctaggccagg

SEQ ID NO: 17911 - DNA, 601 bp, Human
ttttctgaaatgtaaacatatatgagttaaaccaatagaacattctgtcctaaggctgctttcccctctaggggtcctgttctgtcggcttgaactcaaatggtttccctttccctgtaaagcatggagctgtgcataacactggcaccccccttctgctgtgggtcatctaatgtagccagttgtggcctcaactgtcacaagaactcaatggtgcatcacaatccattctgaaggattccatgttaaattattattgagaagcaaaatactgtttaaaatgacttagatttcttgttgrtgatgaggtttatgtttgcttgatttggtttgatttttagtaaattaaaatagattcaatgatggctcaacaatggcgcaccacttacactggcatgtgcttttctcagtagaaagaaagagctggaatgacaacctgcagctgtagtcattgtgagtggttattgcgaatgcatcattttaaatgatagagggtgcaaaatggtccagattttaattgtttgcaatattcatttttgagtttgccaaaatatgggcatgcctggggagtttattattgtgtcaacatcatcggtcacat

SEQ ID NO: 17912 - DNA, 601 bp, Human
ctaaacacaaacctggtttctaacctgaccactattggctgagtgccctgggatataacttatttaaccaggcatctgtgaatggacatttgttccattcaaacaacgcatattcctgggcatgcatctttgtacacttgtctgattactgactccagataaattcctaagagaattcctaagtcaagcgatatgcatattttaaatattggtgcatttctatagggtccagaaagggagtaccaattaatatctgcaacattttctgaaatgtaaacatatatgagttaaaccaatagarcattctgtcctaaggctgctttcccctctaggggtcctgttctgtcggcttgaactcaaatggtttccctttccctgtaaagcatggagctgtgcataacactggcaccccccttctgctgtgggtcatctaatgtagccagttgtggcctcaactgtcacaagaactcaatggtgcatcacaatccattctgaaggattccatgttaaattattattgagaagcaaaatactgtttaaaatgacttagatttcttgttggtgatgaggtttatgtttgcttgatttggtttgattttta

SEQ ID NO: 17913 - DNA, 601 bp, Human
tatagttctgctcagaaaatatctaatattctttctgttgtatgaaatgaaacacagctattgccagatggaattttaagataatgcacaaaattattgatatgaggtgttttaatttacaaggtacccatctaaacacaaacctggtttctaacctgaccactattggctgagtgccctgggatataacttatttaaccaggcatctgtgaatggacatttgttccattcaaacaacgcatattcctgggcatgcatctttgtacacttgtctgattactgactccagataaattcctargagaattcctaagtcaagcgatatgcatattttaaatattggtgcatttctatagggtccagaaagggagtaccaattaatatctgcaacattttctgaaatgtaaacatatatgagttaaaccaatagaacattctgtcctaaggctgctttcccctctaggggtcctgttctgtcggcttgaactcaaatggtttccctttccctgtaaagcatggagctgtgcataacactggcaccccccttctgctgtgggtcatctaatgtagccagttgtggcctcaactgtcacaagaactc

SEQ ID NO: 17914 - DNA, 601 bp, Human
tctaaacatatatacatatatatatttagatatatatgtacatatatatatatctaaatatatttgttcatgtcagaggtgaaagacccatagcaaagaaggtgggaaaggtagtttgtgccactgtattaacttgtttttgttagacttccattttagcaatcttacagtataaaaacaaagaaaataaaatttctcatatagttctgctcagaaaatatctaatattctttctgttgtatgaaatgaaacacagctattgccagatggaattttaagataatgcacaaaattattgatatgaggtgttttaatttacaaggtacccatctaaacacaaacctggtttctaacctgaccactattggctgagtgccctgggatataacttatttaaccaggcatctgtgaatggacatttgttccattcaaacaacgcatattcctgggcatgcatctttgtacacttgtctgattactgactccagataaattcctaagagaattcctaagtcaagcgatatgcatattttaaatattggtgcatttctatagggtccagaaagggagtaccaattaatatctgcaacattttctgaaa

SEQ ID NO: 17915 - DNA, 601 bp, Human
tgtatatatgtatacatatatacatatatactatctaaacatatatacatatatatatttagatatatatgtacatatatatatatctaaatatatttgttcatgtcagaggtgaaagacccatagcaaagaaggtgggaaaggtagtttgtgccactgtattaacttgtttttgttagacttccattttagcaatcttacagtataaaaacaaagaaaataaaatttctcatatagttctgctcagaaaatatctaatattctttctgttgtatgaaatgaaacacagctattgccagakggaattttaagataatgcacaaaattattgatatgaggtgttttaatttacaaggtacccatctaaacacaaacctggtttctaacctgaccactattggctgagtgccctgggatataacttatttaaccaggcatctgtgaatggacatttgttccattcaaacaacgcatattcctgggcatgcatctttgtacacttgtctgattactgactccagataaattcctaagagaattcctaagtcaagcgatatgcatattttaaatattggtgcatttctatagggtccagaaaggg

SEQ ID NO: 17916 - DNA, 601 bp, Human
gcattttattttgtatagttattttcagtttcagtttctttcatttgatcctcaggacaatcctgcagtatgcatagggccagtttacaggtgaggcaactacgctcagagaagatactctcagcttacccaagaccacaggtgaagtaataatggaggttgactttgagccaccgatttttcccttctgaggcttctcactttgatatttgtcatgaactcccataatgctgacctcaaaactattttccctatcaaatgtatacttcagttatacagttcagttaaaatattatactaygtctaggccgggcacagtgcctcacacctgtaatccaagcagtttgggaagccaaggcaggcagatcacttgaggccaggagtttgagaccagcctagccaacatgacaaaactctgtctctaccaaaaatacaaaaatcagctggtgtggtggtgcacacctgtagtcccagctacttgggaggctaaggtgggagaattgcttgaacccagaaggtggaggttgcagtgagccaagattgtgccactccactccagcctgggtgaaacagcaagactccatctcaaaaaaaaaaaata

SEQ ID NO: 17917 - DNA, 601 bp, Human
atgtattatcttatttatcctgaaaacattcctacagtaaagtagcattattctcatctacaaatgaaaacactgaaatattaaaaataaaaacttgtctcctgaattttgtggggttgtgttaagaacagaacttctgagttaatttgcactatattttctctctgaatagagtgcagagtaggtaggactgaacccaggataatcacatataatcccaagaccagctgcagattcatgccttctcatgatgctcattcaagttcaatgaagccttctccagtcaatggaaatagtgtaytaagtaaactctgtgctagtgaataacatataatacaatttaaaatttctaagctgaggccatggcatatgggaaaggggccaatttaaatggtggtaaccacaggagaacaggcaaatttggccaaggcaaactttctgaaaaagtcagcctaagtgtaaaatcactcaggtttatgatttttaagttaaaatactaggtaacatcacaggcccccattttggactaccctgagcttatgaaatcttcctatctttggggtttacataaaaataccagtaagtatgggaaaatgtcttc

SEQ ID NO: 17918 - DNA, 601 bp, Human
tgattgaatttaacatctattagtctcactatgtattatcttatttatcctgaaaacattcctacagtaaagtagcattattctcatctacaaatgaaaacactgaaatattaaaaataaaaacttgtctcctgaattttgtggggttgtgttaagaacagaacttctgagttaatttgcactatattttctctctgaatagagtgcagagtaggtaggactgaacccaggataatcacatataatcccaagaccagctgcagattcatgccttctcatgatgctcattcaagttcaatgmagccttctccagtcaatggaaatagtgtattaagtaaactctgtgctagtgaataacatataatacaatttaaaatttctaagctgaggccatggcatatgggaaaggggccaatttaaatggtggtaaccacaggagaacaggcaaatttggccaaggcaaactttctgaaaaagtcagcctaagtgtaaaatcactcaggtttatgatttttaagttaaaatactaggtaacatcacaggcccccattttggactaccctgagcttatgaaatcttcctatctttggggtttacataa

SEQ ID NO: 17919 - DNA, 601 bp, Human
gggaggtggaggttgcagtgagctgagaacgcgtcactgtactccagcctgggtgacagagcaagacaccatcaaaaaaaaagaaaaaagaaaaggaaagaaaaggaaaaaagaaagaaagacagagagagagagagagaaggaaggaagggaggaggaaggaaggaaggaaggaaggaaggaaggaaggaaggaaggaaggaagggaaggaaggaaaggaagggaaagaaagaaagaaagaaagaaagaaagaaagaaagaaagaaagaaagaaagaaagaaagaaagagagagagagaragaaagaaagaaagaaagaaagaaagaaagaaagaaagaaagaaagaaagaaagaaagaaagaaagaaagaaaatggtagcactaccattctccctggtagaaggcaggtcagctgactggatgggcactacctgcagccctggctaaggaagagtaggaagatgctaatggcacctacggaaaagagtggtataaccaagagcagggtcactcactggtacaggaaaaaaacaccatcaatttgccctcattgggctgcatctttcttgtgggatgggcttcattttgacttacctttt

SEQ ID NO: 17920 - DNA, 601 bp, Human
acctgggaggtggaggttgcagtgagctgagaacgcgtcactgtactccagcctgggtgacagagcaagacaccatcaaaaaaaaagaaaaaagaaaaggaaagaaaaggaaaaaagaaagaaagacagagagagagagagagaaggaaggaagggaggaggaaggaaggaaggaaggaaggaaggaaggaaggaaggaaggaaggaagggaaggaaggaaaggaagggaaagaaagaaagaaagaaagaaagaaagaaagaaagaaagaaagaaagaaagaaagaaagaaagagagagaragagagaaagaaagaaagaaagaaagaaagaaagaaagaaagaaagaaagaaagaaagaaagaaagaaagaaagaaaatggtagcactaccattctccctggtagaaggcaggtcagctgactggatgggcactacctgcagccctggctaaggaagagtaggaagatgctaatggcacctacggaaaagagtggtataaccaagagcagggtcactcactggtacaggaaaaaaacaccatcaatttgccctcattgggctgcatctttcttgtgggatgggcttcattttgacttacc

SEQ ID NO: 17921 - DNA, 601 bp, Human
gatgtgcacctgtaatcccagctacttaggaggctgaggcaggagaattgcttgaacctgggaggtggaggttgcagtgagctgagaacgcgtcactgtactccagcctgggtgacagagcaagacaccatcaaaaaaaaagaaaaaagaaaaggaaagaaaaggaaaaaagaaagaaagacagagagagagagagagaaggaaggaagggaggaggaaggaaggaaggaaggaaggaaggaaggaaggaaggaaggaaggaagggaaggaaggaaaggaagggaaagaaagaaagaaagraagaaagaaagaaagaaagaaagaaagaaagaaagaaagaaagaaagagagagagagagagaaagaaagaaagaaagaaagaaagaaagaaagaaagaaagaaagaaagaaagaaagaaagaaagaaagaaaatggtagcactaccattctccctggtagaaggcaggtcagctgactggatgggcactacctgcagccctggctaaggaagagtaggaagatgctaatggcacctacggaaaagagtggtataaccaagagcagggtcactcactggtacaggaaaaaaacaccatcaa

SEQ ID NO: 17922 - DNA, 601 bp, Human
gatgggcatttgggttggttccaagtctttgctattgtgaatagtgctgcaataaacatacatttgcataggtctttatagcagaatgatttacaatcatttgggtataaacccagtaatgggatcactgggtcaaatggaatttctggttctagatccttgaggaatcgccacactgtcttccacaacagttgaactaatttacactcccaccaacagtgtaaaagcattcctatttctccacatcctctccagcaactgttgtttcctgactttttaatgatctccattctaactggcaatgagatggtatctcattgtggttttgatttgcatttctctaatgaccactgatgatgagcttttattttcatatgtttgttggccgcataaatgtctttttgagaagtgtctgtttatatccttcgcccactttttgatggggttgtttctttcttgtaaatttgtttgaattccttgtagattgtcagatggatagattgcaaaaattttctcccattctgtaggttgcctgttcactctgatgatagtttctttgctgtgcagaagctctttagtttaattagatcccatttgtcaa

SEQ ID NO: 17923 - DNA, 601 bp, Human
aacattactcgacacacccaagagcttttatatgggctcatacttttaacacatagggtgaccaacgtgtccctgtttgcctgcgacttcttcctggttttagcactgaaatttctacatcctgaaatacccactcaggcccaggcaaaacgggacagctgctcaccctaacttcaaagctgatgggaagagagatctttgtgactataagtaatggttgaaaaacctggaagattcttattaacaaagattctgaaataagatttaaatattttttgtatcagcaaatatgtgagtgccyactaagggtgtaagatatggtttcctaatgcacagagtctgccccaaatgtacctcctggcaggtgctgtcaagacgatgcgggacaagtctgtccctgacttgacagaacaaacaggcaattacatccagtgtggtaagtgctgtgggggaagggcaggaggagagtaatctagtaaaaaaagcggggggagaatatttccatgatgttcatagctctaagggacatggcatctcttttctgaggaaagccatttccagattcttttttcttatgaaacattttacttgctaccagtaa

SEQ ID NO: 17924 - DNA, 601 bp, Human
gtgaaacaatcatgtctttgggtgactgtctcccctgctcaagggtaaataggagttcaagactaggtcctatggatgtgttcaataaatgtttgttgagtgactgaatgaaaaaatatggaacaaggtggatgagggagaaagctacaaaaaggagcagggtagaatttttatttgtatgccatatctttctttaatagatttataggacaaatataatttacagaagttagaggtatcagtttgcatataaataattcaagtgctaattattgtctattcattttaagcaagtcctctrtgtattcttattagaagctggcacagttagttgcttccattctatttatcatcagtacttgaaacagacagtcattattcttttaagatctaggatttagattggttcaaatgagccatattctcgtgcaccaaaaaaaaaaaaaaaatgggaatgcatctttattttccccaaatctcttattcctaaccactttttacagttctggcttagtttattctccaatcctctttcctattttatgagccaacgtttcaagtttgcaccaaaagaacacacagaccttctttatctgccaaa

SEQ ID NO: 17925 - DNA, 601 bp, Human
gtatgttgagttgtgttgaagttgtctgaacgagagccttttcaaatgacacttcttgatggcccttggtaaagttggaggaggagaggcaaggaagaaagcaggtaaggaatatttatcgagcatctccagggcactgagccatctgctgggtgccttctcacaagtcctgtcccactgatggctacgagcactgaagcttcttcccagcctctggtcaagcctggaaaacttcctatctcatcagtagatcttccacccagtagctgttcttttttttttttaattaattaattaattwatttatttattatactttaagttttagggtacatgtgcacaatgtgcaggttagttacatatgtatacatgtgccatgctggtgtgctgcacccactaactcgtcatctagcattaggtatatctcccaatgctatccctcctccctccccccaccccacaacagtccccagagtgtgatgttccccttcctgtgtccatgtgttctcattgttcaattcccacctatgagtgagaatatgtggtgtttggttttttgttcttgcgatagtttactgagaatgatgatttccaatttcat

SEQ ID NO: 17926 - DNA, 601 bp, Human
acataaagtatgaaagttcacttgtttttacttgttaaaatgtgtctactatatttttaaattgcacatgtggcttgcattacatttctactgttcaattctggcctggaagattatcaagagtattattaggggctaaagatgaacttgtgtttcttccttttacttgtccaactttgacccaaacttcaggactctttggggaaataaggacattttggaaggtagtcactttgtttgcataggaaatagaaatggcggcacagtaccccagaccctcaagggtaagataaccaagttrttcacatattacttaacggaacaacattcatacctttctggccatcttttccatcacatcctggaaagcctttgtatcctggagggcctggtgggccagggggacctggtggccctggtagaccacagtcacctggctcccctctcagaaggtcaacactcccagggaggcctggaggcccaggtgctcctgaccacagagaagagacaaaaatattcttttagtcaaagacgaatgtgtatactggctgcttgacagcttccgaagaaaaacaattcaatgacttgcaagcaaggaata

SEQ ID NO: 17927 - DNA, 601 bp, Human
tgggaggaggggggaggggggagggatagcattaggagatatacctaatgtaaatgacgagttaatgggtgcagcacaccaacatggcacatgtatacatatgtaacaaacctgcacgttgtgcacatgtacactagaacttaaagtataataaaaaatatatatatatagaaaaaaattaaaaaataaagtaaaaaaaaatcaactcctaattttcaaactttttcattttgacaataaattattactttaccaaacatgagactttgtagtgcggcctgaaagaaatatactcttaatrtaagaaaagggcttaaataataagaatgtgctagtaattcagaatattaactactttctgaacgatgatcattttagtaaatgtttaaacaaaatgctgtatgtaggttggaagctcacccggaagaccagtgggcccttttctccctggaggtccaggtaaacccttctctccaggtggcccaggaaatccatgtggtccctgcggtcccgggaatcccactggtccttaaaaaaaaacaaaacataaaaatgagggcactggaatgagacaagataaaaacaatgacagtttgataga

SEQ ID NO: 17928 - DNA, 601 bp, Human
tacagaggaaaaaggacaagtacagaaatgactagaaaccagagtgaggggaaattaccaattttatagcaaagcttacctctgggacctagagggatccaaagacaacaaacgaggccagtccatgattttcacagggtggaaagagattttaaatttgtggattaggacaaaaatgaaatagattaagaacatacataataatttgaggcagcatcaatgacaagcagaatggcagcaccttatttacataaaatgtccacatcaatgtgactgacaggagcagctatgatttagtaayggagttttcatctctagaatgacttgaaactctcttgagcaatataaaattctagttgatttcttctggcaaatatcctctaatttaatgcatgtaggaattctatccatttaaaagcttctgaaaatttcatattaatttgccaagtatagggtatgcatagaaaggaaatatgaaaagaaacaacatataggccaggctcagtggctcacacctgtaatcccagcactttgggaggccaaggcgggtggatcacgaggtcaggagatcgagaccatcctggctaacacggtgaaaccc

SEQ ID NO: 17929 - DNA, 601 bp, Human
aggcacaaaataacacattgtttttgcactgcagagcattaagtgaacattttccttttaacacacaaagaaatgtgctccttgaaaatggacttgagggtgtgataggaaaggcttgtcacagccccttactgggaggtgaggccccattttttaatgttgtatataccatttattttagggatgctctaggtatttatattgtagaatttaaaaaaggaacttacattggttatgtactatatagcctttgacagagaaagcccacatacttcatgcccaaattgaaactatataagcwaaggctctacactgccttgacaacctataatgaggctgaatgttaggatgctctaatatgaggttactatatctgtaacgaggaagcaaaacactgcagcttaatatccttacagcaccccatctataaaaatgtaacaaagtttagctcacacatacagaggaaaaaggacaagtacagaaatgactagaaaccagagtgaggggaaattaccaattttatagcaaagcttacctctgggacctagagggatccaaagacaacaaacgaggccagtccatgattttcacagggtggaaa

SEQ ID NO: 17930 - DNA, 601 bp, Human
tacagtttaatgtaaaacttggcttttctactatgggtgacttgagagagatgcatagaggcatcttctattttccatgagtaatgtctggcccttcccagtgggaacggagttcagaaagtgggagcatgtgtttggtgcttcctatttagaattttgatgctctcttgaaatgactttatacatacaatcacagagagacaggattgaaatgaaaacatcaaatacagtttaatttttaaatataaacattgaaaataccaggactttttacatttttgattttgcttttctttacttkttaataagtcagaaactgaaaaataaaaagggggagctgaggcctgtcttctaaagaccttaaaaataatacatggtgtctatattcacagcaattttcattaggactaataacagaggcctggaaagaacaaatgcaggcattcacaatttttctttttctcttctgagaaatgcttttgattttctttgaaaatgccaggcacaaaataacacattgtttttgcactgcagagcattaagtgaacattttccttttaacacacaaagaaatgtgctccttgaaaatggacttgagggt

SEQ ID NO: 17931 - DNA, 601 bp, Human
ggagcttgcagtgagccaagatggtgccactgcactccagcctgggcaacagagcaagactccatctcaaaaataaaataaaataaaataaaataatagaagggatgtgtggatccagttagcccatgattgatgtactttggatcaaggtagaaacaaattgcaaagggaaagacatgctttctcctcagtagtttaggctccatataaaaagctacaaaataaaagatctagaatttcatttcagcaatatatcatgaaaataatgaacaatcagcatgcggctcatacctggtcctgrggggcctctcattccagggagccccatggctccttctggtcctctcatgcctggcgccccaggaaggcctgggattcggggacagtcatccacatctgcaggtggccccggttcacctgaaattggaatcaccgcttgtgtaatggatgcacgtgcttatgaacaagctccttctacagtctctggttaaagttggacttctgacactatactgaaatttagtacaaattcagtataaaattcagtataaatgtttgtaaagattcaacaatccaatgtaagttccatgaaggcagaaat

SEQ ID NO: 17932 - DNA, 601 bp, Human
tgcccgccaccaagccctgctaatttttgtacttttagtaagagacaaggtctcaccatgttggccaggttggtctcaaactcctgacctcaggtgatccacccacctcggcctcccacagtgctgggattacaggcgtgagccactgcgcctggctggagaacactttttaaatggagaacactttttaaaagaatggtttcgcttaaatacttgaataaggatcctgccaccccggcagttactgaacaatgctccagtgattaaccatgtagtaactgccaaaacgtacagcaagacyctatttttccccatccctcctctaacagctcctacttccttcttgcaggctctgtttccgctccaccaagccccaattcaattgtttttaactcaaaatcaagtaggcagctattaatgactgttcatggagcatctaccatgttgtgctaagaggtttgaaaactctacatccaaaagctggccaagaatgaaagatttaagtaggagttccacataaaaatagaaaggatgggccaggtgcagtggctcatgcctgtaatcccagcactttgggaggctgaggcaggcggatcacgag

SEQ ID NO: 17933 - DNA, 601 bp, Human
cactttttaaaaaacatcataatcatgtaggtgttagagaggtggccttggagtgtccccacttccagcaggcagggtcagtggctccaataaagagagggcacaggaacccagggaaggccctcctgtggccacgtgcagcagatgagcccatgaaaccctaagtcaggggaattagagattacaggcaagcacacctgggccacataagcactagaccatctttcagaagctcatagtctatggagagagaatcttgttcttgttcatgtcaaagataactatcatgttcaagtgtaamgaattgacccattcacatatttttctcttcctagttactttctttggttatttttttaaagccaccacagtgggtgaccccaaccatccctctggcctcaattttgatgttgaggtggagcagtgcatttcaaccttggctgcctgctacagtcacctggggggcattgaaaaatgttaacattcaggctctgccaccttccacattctattggtctgagattaggccgaggtaccaatattctttcaagatcctccaggtgattttaacctgcagctaggactgccttgctaagaaacg

SEQ ID NO: 17934 - DNA, 601 bp, Human
aagagaaggcgatgcttcaccagaacgacggggcactttttaaaaaacatcataatcatgtaggtgttagagaggtggccttggagtgtccccacttccagcaggcagggtcagtggctccaataaagagagggcacaggaacccagggaaggccctcctgtggccacgtgcagcagatgagcccatgaaaccctaagtcaggggaattagagattacaggcaagcacacctgggccacataagcactagaccatctttcagaagctcatagtctatggagagagaatcttgttcttgttsatgtcaaagataactatcatgttcaagtgtaaagaattgacccattcacatatttttctcttcctagttactttctttggttatttttttaaagccaccacagtgggtgaccccaaccatccctctggcctcaattttgatgttgaggtggagcagtgcatttcaaccttggctgcctgctacagtcacctggggggcattgaaaaatgttaacattcaggctctgccaccttccacattctattggtctgagattaggccgaggtaccaatattctttcaagatcctccaggtgatttt

SEQ ID NO: 17935 - DNA, 601 bp, Human
gcctcccgagtagctgggactacaggcacgggccaccatgcctggcttttttttttttttttttttttctgagatggagtctttctctgttggccatgctggagtgcaatggcatgacctcagctcactgcaacctccgcctctcaggttcaagtgattctcctgcctcagcctcctgagtagctgggactacaggtgcacgccaccaagcccagctaatttttttgtatttttagtagagacagggtttcaccatgttggccaggctggtctcaaactgctgacctcaggttatctgccyacctcagcctcccatagtgctgggattacaggtgtgagccaccacacccagcccttatttccagaacctctgttcttatccattacactatttcttcatgataatcagggatgcgtataagtaagatatcattaccagttgcttatcgtagtgagaaagtggaaactccttaaatcagagtagttactggaccagcagcagcagcggcagcacctgggaatatgttagaaataaagactctcagagccctctccttacctaacaaatcaggtctgggggggacctcagcgagctgtgttt

SEQ ID NO: 17936 - DNA, 601 bp, Human
accatctcccttcggtcaggggagcagacacaatcattgtctttgagggagtttattgctattatacctaatttcctgaattactagccttctccaggtttccagtctctacttgttttctattctctttctctctttctctctctgtctctctctctctgccacagagtagcctggtatgggctgatttgtgtacccccaaatttcatatgttgaagtcctagtccccgtatctcagaatgtgactgtatttggagataagacctttaaggaggtgattctgttaaaatgagcctcttaggctgggccctaatccaggctgactggcctccttatgcaaggagaaaatttggacacagaaacggaccccagggatgcatgtccctggaatggcacagaggagaggccacgtgaggacacaggaagatggtggcatccgcaagccacggagggaggccttgggagaaaccagccctgttgtggctccttgatcttggacttctgcatcccgaactgtgaaaaattgtctgttgtttaagccactgtgtcagtgatactttgttgtggcggcccgagcagaccaacacgtagcctaaaatca

SEQ ID NO: 17937 - DNA, 601 bp, Human
gtttctactcactactaacctggtacaggagtttgcatccctggccagggactctctggagatgggattgtgtctcaggctctttggatccatgcgcctaacgagctacatggtgcattgtttcacacttctattctgaagagtcctatgtcccctttcccaacaccacttcccattttttttcttttaagaaagagccctgttttctacatcagtgtactaatggctatatgataagatgaagtgaactcaggaaaccaggcgatttggccacttggagagggtgagaacacacacaccrtccctgaggtcttcatcacagcctcttaagggtgatcccacagccaccaggctgaccgtcccttcatgaccttgaaaagtgaactgcagaaatggccaagactttgatgatgatgtatagcagtttgggaaaatactgaataggatgcagggccttgtctaggttttatgatggtttaacatcagttagaacataagagatgcatcccactctgttctcattgtttctgtctctgatacctggtgagtcagcatctaaggcaaatgatctgaataggatccagtttggaaagccacttga

SEQ ID NO: 17938 - DNA, 601 bp, Human
gtaaggaaccagaggactctgggaataaccacgacaaaacagaaggaaccactgaaagggagtccaaaatgagcaccatgacatctcttagcacagtctaggaagtcttagccccctaggaagtttctcttggccacgtgttggtgaatttcgcattctctagctatacttcacgcagacctggcaccggctgattttctggcgttgggcctggctttcttttaaggtgtctggtgctggagcagaggaaaactgcaagtctgctttcaccgttgtgagccagaagctatacttatttgcraaaaagtggcaagttccctgccggccctggcattcaaggaatggtgctgctctgaaatcttccaggcagctgccaggtgacataagggcctgccctcctccttggtccccagctcctgtgtgctacccagaaaacaagagagaattagggctcagacacacacagacaaccccagacccaatcagggacacacccaggtttgggtctgatcttaacatttttccttagattattccataaagaacaaaatacaagcgctgaaaaggagtcgtactcagcatggtaagtatgcacacaaat

SEQ ID NO: 17939 - DNA, 601 bp, Human
gtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagygcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcaca

SEQ ID NO: 17940 - DNA, 601 bp, Human
ggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgccgccaccactcccctggggctctgagcgccctccctgttgtctggagggtgcgtggcagctggagtgggagcagagacctcagggtgggagggctggaggacggggccctgcagcctgtcctgtgcccaggaaagtgacckcctgcttcgagtcagcggccaagaagtcggtgggtcagttcagacagctctccccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcct

SEQ ID NO: 17941 - DNA, 601 bp, Human
gaggtctgagggcagaggcaccactgcagcagctccaggaaggacctgcaccgggggaggagtgcctgggaagggcctgggggctgagggtgaggaggaggggcccgccgccaccactcccctggggctctgagcgccctccctgttgtctggagggtgcgtggcagctggagtgggagcagagacctcagggtgggagggctggaggacggggccctgcagcctgtcctgtgcccaggaaagtgaccgcctgcttcgagtcagcggccaagaagtcggtgggtcagttcagacagctctycccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatgg

SEQ ID NO: 17942 - DNA, 601 bp, Human
gctggcagggcaaggtggctacacctgtaatcctagcactttgggaggccaaggcgggcggatcacgaggtcaggagatcgagaccatcctggctaacacagtgaaaccccgtctctactaaaaatacaaaaaattagccgggtatggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtc

SEQ ID NO: 17943 - DNA, 601 bp, Human
cttttaaattttttgtagagatgagggtctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggaagaagggctccaccatggagcgctggtgagtcycctcctgctctggggtctctccgggggttgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagcacatgaccgccgtggtgaagctgttcgggcccttt

SEQ ID NO: 17944 - DNA, 601 bp, Human
ctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggaagaagggctccaccatggagcgctggtgagtctcctcctgctctggggtctctccgggggytgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagcacatgaccgccgtggtgaagctgttcgggccctttaccaggaattactatgttcgggccgtcc

SEQ ID NO: 17945 - DNA, 601 bp, Human
ggaagaagggctccaccatggagcgctggtgagtctcctcctgctctggggtctctccgggggttgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagyacatgaccgccgtggtgaagctgttcgggccctttaccaggaattactatgttcgggccgtcctgcatctcctgtgagtccccgtcccgcaccccctctagggctcaggagggcttggagccgaccctccccactgtcccaccggccgggctgcctggacaggagccacccccacttacctcagtgtttttccaaacaaaaattcgggtccctggctctggcagggcctgtgtctgctgtctagtgtgcaggatttgtaaggatccactccaaatccgaggagctccgatccgtcgccag

SEQ ID NO: 17946 - DNA, 601 bp, Human
cggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgccmgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgc

SEQ ID NO: 17947 - DNA, 601 bp, Human
tgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaamctttagacactggggatgccttcatgctttctggtgagggtctgttaacttggcccgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccacca

SEQ ID NO: 17948 - DNA, 601 bp, Human
cggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaaactttaracactggggatgccttcatgctttctggtgagggtctgttaacttggcccgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatatt

SEQ ID NO: 17949 - DNA, 601 bp, Human
agcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaaactttagacactggggatgccttcatgctttctggtgagggtctgttaacttggcscgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgtt

SEQ ID NO: 17950 - DNA, 601 bp, Human
atggcctgcaaggcctgacgtgatttggtaccctattgcttctctcatctcctgtattcttccactcaggttcttgccttagaatattggcacttgctgttccttctgtctagaatgctttcccgccaggtctctgcatgggctacttgctcatttcctttaggtctttatttaaatgctgtcttctcagtgagggctgcctgaaccacctgtttacaatcacacctgcgtctctacaactggtcctcccccatcctccttccctattctttttctatgtaacacctatctgcctgataaatgtgaccaactatcctggtttgcccgggactatgccagtttcagcactgaaagtcccacatcctgggaaaggccctggtcccaggcaaactgaaacaattggtcactctactgatacactatatattttacttgtttattgttgacctagtgacgacatattgctccatgaggtaaaggaattttggctggtttgtccactgctgtattcccagagtttagaacaatacctgctgctatacatagtaagttttcaagaaatatttaatggatgaagagccaataatgactattacaactt

SEQ ID NO: 17951 - DNA, 601 bp, Human
aagtctgttggctttgccttcaaaatatgtccagaattttccctcatctcttatcatctctactgctaccacctggaccagccaccatcacctcttgcctaactggtctgtctgtccccatcccttgtcctcttgcacctattctcaacagagcagccagaatgattctgctgaaacataaatgagtcatatgtgtcagtcctctctcaaattcttcagtggcttcctttcttgcagggggtaaaagccggaattgttacaatggcctgcaaggcctgacgtgatttggtaccctattgcytctctcatctcctgtattcttccactcaggttcttgccttagaatattggcacttgctgttccttctgtctagaatgctttcccgccaggtctctgcatgggctacttgctcatttcctttaggtctttatttaaatgctgtcttctcagtgagggctgcctgaaccacctgtttacaatcacacctgcgtctctacaactggtcctcccccatcctccttccctattctttttctatgtaacacctatctgcctgataagtgtgaccaactatcctggtttgcccgggactatgccagt

SEQ ID NO: 17952 - DNA, 601 bp, Human
agcttattctgtgcttgcacctggcagttgaagtgggctgggaaaaaaagaaaaaccacacatgcgcacacatgtgtgcgcatgtgtgtacgttagcgcacacgtgcctgctgtcaggtctcggttaaattcaagtgggcccttagtgtcgctggcaatgctactgcatgtccccagcccattcactctctcactcttctagatgactattatattctccctactcagccccagctgaagactttatttccaattttcccaagaaagtggaagcaactacaagagaatctccacaatcccsaacgacccggacctgtgcccatatattccaccttccctcctattactatggaaattccatgtccctattcaaggccaacccatccacttgtccccagggacctcttcacatctcacctagcacactctttctcttccatcaacaatcatttgattttcctccataactgaccagtccccctacaactcacatgctgtaatttctcctattttaaaaatcaaaattcctttgcccgcacatctcactcatctactggcccatttcctgccttctttatggcaaactccttggaagacttgt

SEQ ID NO: 17953 - DNA, 601 bp, Human
ttgacaattttcttaacagaaagttgggaaaaaattactgtcaatcattaaaattaaaatacccttccctgaatcctcaactcccttgaccctcttcttactttgtcatggttgtctgataagaccacactctagctaaatccaactcttagcttattctgtgcttgcacctggcagttgaagtgggctgggaaaaaaagaaaaaccacacatgcgcacacatgtgtgcgcatgtgtgtacgttagcgcacacgtgcctgctgtcaggtctcggttaaattcaagtgggcccttagtgtcrctggcaatgctactgcatgtccccagcccattcactctctcactcttctagatgactattatattctccctactcagccccagctgaagactttatttccaattttcccaagaaagtggaagcaactacaagagaatctccacaatccccaacgacccggacctgtgcccatatattccaccttccctcctattactatggaaattccatgtccctattcaaggccaacccatccacttgtccccagggacctcttcacatctcacctagcacactctttctcttccatcaacaatcatt

SEQ ID NO: 17954 - DNA, 601 bp, Human
taaaaatatgatttcaaaaaaggcacattcatagacaaaaaagattgtagctaactaagtacctgcttacctttcataaagaagggtcgagttgttttccagagctctggattgttgttaaatatgatgcctttctcatgcataccgatgcactgcagcccaagtttgctgccgaatcgagagctgtaatgattgtgcttcattatgtggaacatacttgaggacctgaaaagacaggaaactttggtgtcaatttttaagggtcaggagaactcctggtggtacattttgactaggaggyagctctcttagcaaatgcatgttgctccaaatgcaatgtgcatgatttctagtattcgggttgaataagcacttctgttagcatgaggacatccttctccagttgaatcatttctacctactgactccctgtttcaacatcaccaaagatagaaaacacacacacacacccatataccattccttacttctctttcttctctaacctcaccaaaatactacccactactggagtcagagctgcaaggctgctaagaagctgaaccctccataccaccagagccagaagaacctccagcct

SEQ ID NO: 17955 - DNA, 601 bp, Human
atgaggttaagggggaaaaccactggataaggaagcttgcaactgggtctcagctcattcattactccctattttgcctgggtgaaaatcataacttcgttggaactttatttcctcaactgttaaaatcagaggctagatgacagatatggtccctctcagttctaaaattatctaatttcattcacaaattgcttcctgctaaatcatctgggctgtcagtcaagcactcagcaaacacattgtttggccgtgtttaaatcaaacatatgggtgacatgctaaattcttaactgaaatkactctaaatatatagctacatctcttcttttgcctataaaattgctttgcacatcaataagaagaaaagaatttgtggtgattaagaaatataggcttcagggctatattccgggctatcatttactaatgtttggaccttgggcaagttacttaacctcattttctgtgaattgtaggagataacaacatttaccacatggggctgccattcaagtgtttagaacaatggctacaacagagtaaaggcataatgaatgttagctcttcctcctttattgcagtagaattcaaaatatga

SEQ ID NO: 17956 - DNA, 601 bp, Human
ccttcctgcatcactgcagtagctcctaaatgttctcactgctcacaatcctgcttccttccaattagtcattctctctgctaccagagggatttttataaaatacaaatatgtttatgttattctgcttaaaatctttagtgattctccatagtttttgagataagctcaattccttgccttaactgagaggtctttggtgatctggccctgccctccccttggccacgtccctgaatgtatctgcaccaggcacaaggacttaccgacagggccctggatgcatcatgtctatctattygtctgtgcctttggttatcctattctttactcctagaatatttgtcttttgttttcttaattagcttctaccttcatttaaaactcattataagcatccattcctctgaaaagtctcccctgcccctcaatgtgctttagatggcctgttcatctgtacttggcatcactctgggcacaccgccagcattaccatcacctagggtagtatttggtgatgtgctgggctgccccttcctaattcaaacctctctcccccattataagttcctggagggcaggaaccacatcttgtttgtca

SEQ ID NO: 17957 - DNA, 601 bp, Human
tgttgttctctgggtgactgccacttcagcaagcaggacaaatgactcaaccctttgtgtggaagggttggcttagaatgtcacttgtggttttctcccaggccgatgcatgatttgcctctgtgtttaaagagcttgaagccacatgccaaatttatgggcaaaaatgtaataacatggcttataggcagtggtatgatgtagatatgatttaatttttaaaatatgctaaaaagtattgactctatctagtgaaaagaaaattgggcaacaatcagcaaataccatcaatatggacacrtttctcggcagttttgggaaacacatgctatttcttcacccctcgccaccacccttccctacctcccaagatgggtcattgcctaagttgcacttaactatttctctacagactcacccagtaagtcaatactttcattaatgttactgatttagatactaaaacttgtgccaaactttccactatatcaggaaaaccaacagggagtctaactccaaaaggagattcactgaaaaatgcttaggaccctcattgattatagaaatgtcagacaccacagtgaactttccaataagcaat

SEQ ID NO: 17958 - DNA, 601 bp, Human
tagtgtgtggataaaggtcacaatggcaataaaaaatgtaacccatagaaaacagtgtaaaacaattagatacaagtccagtgaattccattcctgtcaggtgtttgatcattaggttaaaaagttatcaaataattcaatgacttttgcacaatggcacaacttttcaagaactagctgaaatattggcatttgtactcaagttgcaaattggtttaatcctgccaaaataaaatcaagttctatgagtttgacatgagcatgcacatgttttaatattcatttctgtatcatagtgcgsaaagtagtcttatgagtgagacatcttgttaaggttataaataataaatggcaaacatgtatatacagcaatttttaatattgtttggcacacattagatactacgttaatggcagctaatatcgtcatttccatcagcatcagtatcaccagcaatattgacatttttatcatataggcacaatgttttcatgtttagtagctttgagggaggagtgtgtgtatatatgtgtgggtatgtatgtatatatgtatgtatatatcatgcccaaaagaacaattggaaatggttaaatatat

SEQ ID NO: 17959 - DNA, 601 bp, Human
ccaaatcagggtaatgaggatattcatcaccttaaacatttatcttttctttatgctgagaacattcaaattttctctactagctacttggttgtacatagattattatttattttcttcactacactgattttttgaacactaggtcttgtttcttctatctgcctgtatttttgtacccattaatcaacttctcttcatctcttctctccccactacccttcccatcctctggtaaccaccaaactactcaaatgattaatgtttgttttttggtggtggtagagttgcatgcacatgtttttttttttttcatcagtagagtgatttggggggatttataggtttttagggtatattcactactagggttacaaaatgtatgaagtcacaatatgagttatggatttaagaatcctgtttaataataaattctgttcctcttgaggcaatgtaaggccaatgcttatggataagaagtaaaaacaaaacaaattctattattcaagggcataataagcattatgtcaactgtataaatatttagtggtaaataatgttctaaaagacacctgaatgggcttgtgaatttttctttgtg

SEQ ID NO: 17960 - DNA, 601 bp, Human
gcttgtggcctcactaaattcgagctatggtcaaatgtcttctctgcagaggccttttctaaccaccctctccatgacatctgtgcccacacacactgttgccctccttcacttcctgtcctcttgccctgcttcattttgccttcaaggcacttattattgcctaatattttattagatatctatgtcttttcctgtccacatcactcactggaatgtaagccccttgaaggcaagaattttatctgtcttgctcactgttatgtccccagaacctagaacagtgcctggcataaaatargcaatcaataaatgtttgatgaatgaatgtatgaatcaatgaacactggtgtaagttaattcaggaaaagtcacattgagttgtacatacttaatgccaacagtagaatggaattaatccaaatgattaattttctattgatacataatggatatacatatttaggggtaactgtaatattttgataaatttgtataatgtgtaataaccaaatcagggtaatgaggatattcatcaccttaaacatttatcttttctttatgctgagaacattcaaattttctctactagctacttggt

SEQ ID NO: 17961 - DNA, 601 bp, Human
tgcagccaaattgctgtaaaaagtgtttcatcagcaacttaatcaacagctcccttgtgggctctagagagcagaaaagttacctgagaggccaagaaaaacagcaaagacacaagggaaaaaaaccaatccaattgtactcataaatcttccaaagttgtattacttacacagacttctcatactttttgtatagccaagaaatcttaaagaagatgtctggtttgatgaggagagcttgccatgcatcaaaataaccttggattttaaccacgatagcactttctgtaggaaaaaaaamcacacatacacaagaaagagcagttgagcaaaatgtgagcctaagaaggttgctctgagcagaaaacattccctgcagattctcctaacagtctgggggttctaagctcagcaagattccatcttcagtaggagttttagccacgtgaataccactagacaaatcaagcactgatttgttctccttgccatccaaattggcctacttaaccagtgagttgccagttttcaagtttgtgttttcaagttttcagcctagaatttcacatattctccttgggctgagctttcaactagctcc

SEQ ID NO: 17962 - DNA, 601 bp, Human
agataattttgacagatattaatgacaggatcagtcgacccttctcttcaactcaaaatacactagtgtcctagttaccaagctgaagctcccagaccacacactcagcccccttgccgagaagctgcccagccaaaggcttcatttactctctggtctggccaaatgcagccaaattgctgtaaaaagtgtttcatcagcaacttaatcaacagctcccttgtgggctctagagagcagaaaagttacctgagaggccaagaaaaacagcaaagacacaagggaaaaaaaccaatccaawtgtactcataaatcttccaaagttgtattacttacacagacttctcatactttttgtatagccaagaaatcttaaagaagatgtctggtttgatgaggagagcttgccatgcatcaaaataaccttggattttaaccacgatagcactttctgtaggaaaaaaaaccacacatacacaagaaagagcagttgagcaaaatgtgagcctaagaaggttgctctgagcagaaaacattccctgcagattctcctaacagtctgggggttctaagctcagcaagattccatcttcagtaggag

SEQ ID NO: 17963 - DNA, 601 bp, Human
caagtttgatttctttcaaagatggccttgtttctgtagaagagtggagcaggatgaaattgaagcagagacagagtagtgaggcggtagagttggagaagacctgagtgtggacctggaagctcccctgcagagggcaggggagaggaaggggctagcatcactggattggagtggagagggaaatgtatcactaccctgtctttgctgtcatcctctcctcttccttctgccacaaactggaagttcatttgtgaaggggctgcttgaagcccagaaacagtgctataaatgatagackatcacttccctgggacgataatttccctgggagagtccacaaaagtcttttgtaactgacaaggtaggcagaacattgtatatgatcccatgtttttgtaaaatggacaaatccaaccataaatatgtgtttgtgggcaaatagaaaaagattttagcaaatacacagcaaactattaacaatggttgccactggagaggggagatgaggctggagaggagagcggaaaggattgggggatgtcacttactgctttacacatcattctgtgatttaaattcctcccaatgagcatgcatc

SEQ ID NO: 17964 - DNA, 601 bp, Human
gtccacattctgtgatctctcttcacatctgtaagaaatgtgttcctaaaagattacttatgtgaaggaagtgtcaaatgaggaattctgctttctcccagaaagcaagtttgatttctttcaaagatggccttgtttctgtagaagagtggagcaggatgaaattgaagcagagacagagtagtgaggcggtagagttggagaagacctgagtgtggacctggaagctcccctgcagagggcaggggagaggaaggggctagcatcactggattggagtggagagggaaatgtatcactmccctgtctttgctgtcatcctctcctcttccttctgccacaaactggaagttcatttgtgaaggggctgcttgaagcccagaaacagtgctataaatgatagactatcacttccctgggacgataatttccctgggagagtccacaaaagtcttttgtaactgacaaggtaggcagaacattgtatatgatcccatgtttttgtaaaatggacaaatccaaccataaatatgtgtttgtgggcaaatagaaaaagattttagcaaatacacagcaaactattaacaatggttgccactgg

SEQ ID NO: 17965 - DNA, 601 bp, Human
cagggtctgtgtaaagtcaagagagggaagtccacattctgtgatctctcttcacatctgtaagaaatgtgttcctaaaagattacttatgtgaaggaagtgtcaaatgaggaattctgctttctcccagaaagcaagtttgatttctttcaaagatggccttgtttctgtagaagagtggagcaggatgaaattgaagcagagacagagtagtgaggcggtagagttggagaagacctgagtgtggacctggaagctcccctgcagagggcaggggagaggaaggggctagcatcactgrattggagtggagagggaaatgtatcactaccctgtctttgctgtcatcctctcctcttccttctgccacaaactggaagttcatttgtgaaggggctgcttgaagcccagaaacagtgctataaatgatagactatcacttccctgggacgataatttccctgggagagtccacaaaagtcttttgtaactgacaaggtaggcagaacattgtatatgatcccatgtttttgtaaaatggacaaatccaaccataaatatgtgtttgtgggcaaatagaaaaagattttagcaaatacac

SEQ ID NO: 17966 - DNA, 601 bp, Human
cccttacgtttaactatttcaaggagcactccaatggtttgaaaaagatgatgcccttctacaaccaaataacttgttttgcagggtctgtgtaaagtcaagagagggaagtccacattctgtgatctctcttcacatctgtaagaaatgtgttcctaaaagattacttatgtgaaggaagtgtcaaatgaggaattctgctttctcccagaaagcaagtttgatttctttcaaagatggccttgtttctgtagaagagtggagcaggatgaaattgaagcagagacagagtagtgaggcrgtagagttggagaagacctgagtgtggacctggaagctcccctgcagagggcaggggagaggaaggggctagcatcactggattggagtggagagggaaatgtatcactaccctgtctttgctgtcatcctctcctcttccttctgccacaaactggaagttcatttgtgaaggggctgcttgaagcccagaaacagtgctataaatgatagactatcacttccctgggacgataatttccctgggagagtccacaaaagtcttttgtaactgacaaggtaggcagaacattgtatatga

SEQ ID NO: 17967 - DNA, 601 bp, Human
gcacactcaagggtctaatggggcctgtatagctggggttgggaggtagaaaagaagatgatggagaaggtgaccaaaggtgctcactaggaagtagttagcgagtctgtgtgtggcacacaggagggagcatggacgcttgcaaatggctctgctgcttttccatctttgcagaggccttttgaagtgtcaggggaacattaacatgtacacgtacatttcacctctcaaataaatggtattcaatatgtattaaaggcttatggtttctctgaatgccctccttcggtctctctttacygtattgagcttgttttctttttcccaccagaccatgagccccgtgagtgcaggggtggtgttggcttgttcaaggctgtagccctgcacctggcacagaacctgagaacctgctaggaggcactcaagaaaacatgctggaatttggattccagatgttattctgtatccttgctatctaccttgcctggaaacttcccacctgtgtgaggcatctgcagatcccttctctcccatatttaacccttcgatgaaattttcccttacgtttaactatttcaaggagcactccaatggtttg

SEQ ID NO: 17968 - DNA, 601 bp, Human
acatactgcccttggcacactcaagggtctaatggggcctgtatagctggggttgggaggtagaaaagaagatgatggagaaggtgaccaaaggtgctcactaggaagtagttagcgagtctgtgtgtggcacacaggagggagcatggacgcttgcaaatggctctgctgcttttccatctttgcagaggccttttgaagtgtcaggggaacattaacatgtacacgtacatttcacctctcaaataaatggtattcaatatgtattaaaggcttatggtttctctgaatgccctccttyggtctctctttaccgtattgagcttgttttctttttcccaccagaccatgagccccgtgagtgcaggggtggtgttggcttgttcaaggctgtagccctgcacctggcacagaacctgagaacctgctaggaggcactcaagaaaacatgctggaatttggattccagatgttattctgtatccttgctatctaccttgcctggaaacttcccacctgtgtgaggcatctgcagatcccttctctcccatatttaacccttcgatgaaattttcccttacgtttaactatttcaaggagc

SEQ ID NO: 17969 - DNA, 601 bp, Human
tacatcatcttctaaggctttgcgcatgaccaagtccacgacaggctggtaccgcatgctctcataaatgaagttttccatcacttttaatttttgtatatcatcaatctttatgtctctctcacctgtggaaacagataaaaggaacaaagaaggtaatgttagtttccatctgtgcttggtattaaagcttctatttttttccacagaaccgtttgctcttggttgaaaaaaattgtggctctaattctaatgcacaccagcaaccagggccaaatatgttatgcttgggccacagagkgttttataaaaattcagatatgaagccaattaccttaaaaactggtggagtttatagaaaagtctgaatgtccagaaaatttggtgatgctgaacttacattcccacatagcaataatgggctgacgctgagtggccaattacctgtttagagggggcatacatcatacagttccatctagaccacacccaatctgcttcaaacattcatctcatgtgcctgctttctgaaatctttgagtttttgttccctactctaaattgtaggggacattcatttcctctcttcacttacgagcaa

SEQ ID NO: 17970 - DNA, 601 bp, Human
tcttacattctttgcaaaattttcaagagtaaattcattgggtttggggaaaaactcgagtctgtgcatccttccaatattcaggataatgtttgtcccctttttcactgggtagccatcgattacatcatcttctaaggctttgcgcatgaccaagtccacgacaggctggtaccgcatgctctcataaatgaagttttccatcacttttaatttttgtatatcatcaatctttatgtctctctcacctgtggaaacagataaaaggaacaaagaaggtaatgttagtttccatctgtgmttggtattaaagcttctatttttttccacagaaccgtttgctcttggttgaaaaaaattgtggctctaattctaatgcacaccagcaaccagggccaaatatgttatgcttgggccacagagggttttataaaaattcagatatgaagccaattaccttaaaaactggtggagtttatagaaaagtctgaatgtccagaaaatttggtgatgctgaacttacattcccacatagcaataatgggctgacgctgagtggccaattacctgtttagagggggcatacatcatacagttccat

SEQ ID NO: 17971 - DNA, 601 bp, Human
gatgttcaataaatttttgttgatcagttgactgatttacatagcattatctggattgcccgtgtagaaacaaaatgaattagagtactgaattatttagcatcatgtttctacaccatatgcaaattgaaaaaagggcacttagggaactgcgtacgtaattcagattgaaaaacatattgcctaaaatttgacataatgaaggtggaatctgtagtacacatcaattataaaaaaagaaaaactgtctctcttctaattattaagtcctatttagaatgggacctactgctcatggggycatttgatgagccaaaggcactttgcaaaaaccaaatcttttggtctcatttgattttcatctgaagcagtagtggactttcctttgctcagatggtgctatagctgaatgtgatgacatgatgacaaagtttaaatggaaaagtaggttggttgggttaaacaaaaatcacttcattttagccaaatgaagggcccagctttttcacattttgacctattttgtggccaccatgtagatacttcttagagctggagacccaacatccttgaaggcttgaggatgaatacgggagccctg

SEQ ID NO: 17972 - DNA, 601 bp, Human
aaagattatttttgtgtgacaccatataagagataaaggcaagcaaggatgtagattcctggcctattcagtgccaagcatctaactatttgtagttatgcagaaaattaatgaggaccacagctgtcttgtccacatttggacttagtgcctggcatatagtagatgttcaataaatttttgttgatcagttgactgatttacatagcattatctggattgcccgtgtagaaacaaaatgaattagagtactgaattatttagcatcatgtttctacaccatatgcaaattgaaaaaagrgcacttagggaactgcgtacgtaattcagattgaaaaacatattgcctaaaatttgacataatgaaggtggaatctgtagtacacatcaattataaaaaaagaaaaactgtctctcttctaattattaagtcctatttagaatgggacctactgctcatggggccatttgatgagccaaaggcactttgcaaaaaccaaatcttttggtctcatttgattttcatctgaagcagtagtggactttcctttgctcagatggtgctatagctgaatgtgatgacatgatgacaaagtttaaa

SEQ ID NO: 17973 - DNA, 601 bp, Human
tataagtcactaaggcaaagattatttttgtgtgacaccatataagagataaaggcaagcaaggatgtagattcctggcctattcagtgccaagcatctaactatttgtagttatgcagaaaattaatgaggaccacagctgtcttgtccacatttggacttagtgcctggcatatagtagatgttcaataaatttttgttgatcagttgactgatttacatagcattatctggattgcccgtgtagaaacaaaatgaattagagtactgaattatttagcatcatgtttctacaccatawgcaaattgaaaaaagggcacttagggaactgcgtacgtaattcagattgaaaaacatattgcctaaaatttgacataatgaaggtggaatctgtagtacacatcaattataaaaaaagaaaaactgtctctcttctaattattaagtcctatttagaatgggacctactgctcatggggccatttgatgagccaaaggcactttgcaaaaaccaaatcttttggtctcatttgattttcatctgaagcagtagtggactttcctttgctcagatggtgctatagctgaatgtgatgacat

SEQ ID NO: 17974 - DNA, 601 bp, Human
tttcattcaccccctgtgttctgacccaacctcagagagtccccagttttgcctttcatgtgctggggtaaagcaatgcaaaccaaatcttattacagcaagtgttagtataatcaggtagctctgtggaatagccacagatttactattgttttataagtcactaaggcaaagattatttttgtgtgacaccatataagagataaaggcaagcaaggatgtagattcctggcctattcagtgccaagcatctaactatttgtagttatgcagaaaattaatgaggaccacagctgtcttrtccacatttggacttagtgcctggcatatagtagatgttcaataaatttttgttgatcagttgactgatttacatagcattatctggattgcccgtgtagaaacaaaatgaattagagtactgaattatttagcatcatgtttctacaccatatgcaaattgaaaaaagggcacttagggaactgcgtacgtaattcagattgaaaaacatattgcctaaaatttgacataatgaaggtggaatctgtagtacacatcaattataaaaaaagaaaaactgtctctcttctaattattaag

SEQ ID NO: 17975 - DNA, 601 bp, Human
ctccatcccctcagatgaacaactggaactcaagccctttctatgtcctatttcattcaccccctgtgttctgacccaacctcagagagtccccagttttgcctttcatgtgctggggtaaagcaatgcaaaccaaatcttattacagcaagtgttagtataatcaggtagctctgtggaatagccacagatttactattgttttataagtcactaaggcaaagattatttttgtgtgacaccatataagagataaaggcaagcaaggatgtagattcctggcctattcagtgccaagcakctaactatttgtagttatgcagaaaattaatgaggaccacagctgtcttgtccacatttggacttagtgcctggcatatagtagatgttcaataaatttttgttgatcagttgactgatttacatagcattatctggattgcccgtgtagaaacaaaatgaattagagtactgaattatttagcatcatgtttctacaccatatgcaaattgaaaaaagggcacttagggaactgcgtacgtaattcagattgaaaaacatattgcctaaaatttgacataatgaaggtggaatctgtag

SEQ ID NO: 17976 - DNA, 601 bp, Human
tacattttgttaatgaaggcctatccttctcaaagcacatttggtggaatcgggtctttatggatacggtttcttcaccgactatttctccctcaaactcttggcctctgctttttctcttgtagcctggttctctggtgtgaacaggagcagatgacaaatagcacctagcttggtgacaacccataggaggtatgcctataaaatgccatgggccactgagtgttcactgtgaggatgacactattggcaaggatggatgatttgtatgtgaactactgatgagaaatgctccagagtrggtactgaccagccttctctagtgttccagacacctgtctgagtttcttggggtaaagatcatttccagcatgtttttagtctcatctgggtgcaaggacaagtcgtgtatcttctgtatgctctcaacacactgtccttgcaatgtcttcacgtggaatcgtctcagaagtgtaacgaggatggctttcatcatcaccatggcgatgtactttcctgcacagccacggggcccaaagccaaatggctgaaagtacctataaggaacctatgaaaatgatcagacagttagccagaatat

SEQ ID NO: 17977 - DNA, 601 bp, Human
actttaattcacactagcaggtgggtttggccccaggtaccctgacattggcctggtctttctaatcaacttgagtgtttctgccccagacataaaaatccccttgggttgaggcagtagagctctactggggaaccagacatacattttgttaatgaaggcctatccttctcaaagcacatttggtggaatcgggtctttatggatacggtttcttcaccgactatttctccctcaaactcttggcctctgctttttctcttgtagcctggttctctggtgtgaacaggagcagatgacmaatagcacctagcttggtgacaacccataggaggtatgcctataaaatgccatgggccactgagtgttcactgtgaggatgacactattggcaaggatggatgatttgtatgtgaactactgatgagaaatgctccagagtgggtactgaccagccttctctagtgttccagacacctgtctgagtttcttggggtaaagatcatttccagcatgtttttagtctcatctgggtgcaaggacaagtcgtgtatcttctgtatgctctcaacacactgtccttgcaatgtcttcacgtgga

SEQ ID NO: 17978 - DNA, 601 bp, Human
gtgggtccggtacgcggcttaaccgtgttgggctggcggaggccgggcgcctgggccgcaccacccctggccccgcctctgcactggctcagcccggccctgggctccgaggtggccgctcatcctgcagcaggcgagggacggggctgggcccaggctgtggcgagtcctttcgggttgtgtgacggccggcggtcacacatgccacacccccaagcctgggccgagggccatcccggtcacacataggcctctaccttggaggaagtgtaagccacccatgtcccgtatagtctggctytttataccatttgcctttttctcatcctaattctgatccctgagtggcctaagtttatgcagtgggcaggtaaccctggggtcacttcttgaatggtttagatccagtcagctccaacagatagccctcggaattcccctaaggtcttgtcagtgttggcagctttcaactggtgttcattgccatctctcacgacttcctggaggcttaaatctttaattgcagcaggttatcagaacaactctcctttttaatctgcttaccagatacagccaaattgtgtgtatgtggcaccgtggc

SEQ ID NO: 17979 - DNA, 601 bp, Human
tttctgcctcattgcccttaggaaatggtagccgtccacatatagagattagggagattatgatgcaatttgtcaaactgtagtagcaccagaacgtaagtacattacttggtgcattttcctaagttaccttgtctaatttgctattcctagttgatgtctcaggaacatcttcatagattgttctaagtaaatacggactgtatatacacgctagcttagagttaggaaacaaaaattacaggtaaaaagattatcatgtatagattattcaagtatttaagttagaactttcagagcattatttatttatttatttatttatttattttgagacggagtctcactctgacatccaggctagagtgcaatggcactatctcagctgactgcaacttccgcctcccgggttcaagtgattctcctgccttggcctcccgagtagctgggattacaggcacccaccactacacccggctaattttcttgtatttttagtagagtcggggcttcactatgttggccaggctggtctcgaactcctgacctcaggtgatccgcccacctcagcctcccaaagtgttggcattacaggcgtgag

SEQ ID NO: 17980 - DNA, 601 bp, Human
cttgtctaatttgctattcctagttgatgtctcaggaacatcttcatagattgttctaagtaaatacggactgtatatacacgctagcttagagttaggaaacaaaaattacaggtaaaaagattatcatgtatagattattcaagtatttaagttagaactttcagagctttatttatttatttatttatttatttattttgagacggagtctcactctgacatccaggctagagtgcaatggcactatctcagctgactgcaacttccgcctcccgggttcaagtgattctcctgcctyggcctcccgagtagctgggattacaggcacccaccactacacccggctaattttcttgtatttttagtagagtcggggcttcactatgttggccaggctggtctcgaactcctgacctcaggtgatccgcccacctcagcctcccaaagtgttggcattacaggcgtgagccaccacggccggctcagagctttatgacattaaaatgatccctggcactaataattagccatgttttctgaaaattgaataaaaataccattgaatacgtttttaaaattaagttaaatatgagatgat

SEQ ID NO: 17981 - DNA, 601 bp, Human
gttcatttgttcatgtatttattcgtttgaatgtatattgagctagtgtgttccaggcggtgaacaaggtaaaaaaaccctgctcttatgaaacttgtaatttggtgataaaagacaaacaatatataagtaatggataaatattttgggaagtaactgaaaattaaagcaggtaatagggaggaagagagataattttagatacagtgtcaggaaaggcctttctgaggagatgatgtctgggcagggtcctgagtgaagtgggggagtgaggttacttcaggcagagggaaacaacacygagaaaggcctgaggtgggacttagcttgtgaagtttaaggagtaataagaaggctggtatgactggagcagaaacccatgcaatgtaaagtcggagaggtaggcaggagacagatcatggagtgccttgtaaggcaggtctagtagtttggattatactccaagtatgatgggaaacaaaggttttgagcagggcagcaatttcatatgtttacatttaaaaagttaattttgtccgttgagtaaggttgtattggttattttaacactgtttagaatgatgagatgactttcttgaca

SEQ ID NO: 17982 - DNA, 601 bp, Human
ccttttaaaaaaatgctaatatgatgatgaagggaaaagttggacctcttatacactttgtctcttgttaaataggaatctcattcttctcaactcatataacaggagaaatgttagattttcatttctaaaggatatttttcatggctaactctatacctttggcatcactcagcagagattattcagtgccttctatttgccaggcagaccctgagccagaacttagattttagtggaatgaggctgagtgttccataatcagtttggtgatcccttgacattgagtaaatcataaatsacttagtacccatgtgtgtaaagtgtgtaaaagctttgagtggatgcagtaacaagcattttacacacatacttgtattttatctgaggtacatgcttactgtcttttcctcaggaatgcaaacttcatcaggacagggactgtgtgtgactgttttgtttagtatctaaagtgatacagtaggtaatcagtacatatttattgaatgaatgaacactggggcctggtctgttttaattactgctctgtggcaaagcatccagtatggtgtcttgtacaaagtaagtaaccagctacaac

SEQ ID NO: 17983 - DNA, 601 bp, Human
taatatctactatgtgttagtcattgggctaactactggagtaccgcagtgagcaagacggacaagacccagcttttatagagcttacaattcagttgagggagacaaacatccaacatataattgtgacaggggtccatagacttaagcatagggagtaatgacatctatatatggattgggaatggtcacataattctttcctaaggaattatgttgatagctaaaaaggttgagagtaactctcgttacaggttggaccttttactgtaattcttttttttatttagactgtaagaartagggctatgtcatttatatatacacacacacagacacagcatgtgcagacacacccctccaagagcctaaagtagtgtttgtaatgtgaaatgcctgctgttagtgtttatttctaggtagatggaacagatcgtacataggtagaccagcataattctatgcatgtaggctaagagtagtaattcaccgttactgaagcttaaactgcatggtattggtgagtaaacagaacgtggtaggagatgaggctggagaaatagttactgaaggaatttggatgctgtacttaggaacatgg

SEQ ID NO: 17984 - DNA, 601 bp, Human
gttacaggttggaccttttactgtaattcttttttttatttagactgtaagaaatagggctatgtcatttatatatacacacacacagacacagcatgtgcagacacacccctccaagagcctaaagtagtgtttgtaatgtgaaatgcctgctgttagtgtttatttctaggtagatggaacagatcgtacataggtagaccagcataattctatgcatgtaggctaagagtagtaattcaccgttactgaagcttaaactgcatggtattggtgagtaaacagaacgtggtaggagatraggctggagaaatagttactgaaggaatttggatgctgtacttaggaacatgggctttatctaacaagacactggagaaccaacagagcgtaacaacagagagaataacatctgagttgggttttagctttgcggtagcactgggtaggctaaaatggaggatgtgaatgaggctagaggctgctggactgaagtttggaggtggatctgagaaggggagtgacactgagttgctagtatgcacctagcacctccttaggatcttaacatgcgtactctctgatcctcacaaccctaggc

SEQ ID NO: 17985 - DNA, 601 bp, Human
tagtagagatagggtttcaccatgttggcctggctggtcttgaactcctgacctcaagtgatccacccgcattggcctcccaaagtgctgggattacacagactgacttcttgagatacatcttgtaattatattgatgattacaattgatttgtaacacaatacctttatttcagtggtagcctggataaccaggtgccttattttccttataatgatctaatatgtaacacttgtaggaatttgtagagtacttttcttgacttttttctttgagttaattttaataacattaattgcsttgtttaagtcagtcacctcttattgtactccagtatttttaaagtatcaacctgatactttaaacctggtaggagcacacatttcagaatctaaaggaccttgtttgaatcacttcactgaaacacagattgctattcacctgtcatttgccacttttccatcaggtttgccttaaataaatgtatttcatttaactacttttctgtatccttttttttttttttttttttttgagacagagtttagctcttgttgcccaggctggagtagttcagtgacacgatttcagttcactgcg

SEQ ID NO: 17986 - DNA, 601 bp, Human
agagaggagctcttgaatttttggtattttctgaagtttaaaaaaaaacacctaagattacatagtgaatagggaagtaaaacccaaggtttttggctattatcttttatctcttgtttacttctcctgaccttactaaaacaagttcttttccaaaccaaatttatttatcattttagtaccatggacctactataagaattgttacatatcagtgattaaaagtatatgctcaaaaatacatatacttaaaatctaaaatatttaattcagttttattgtcattaaaagggtttttggrgaattatagcagtaatatatgttataaatatatatgctcatgtaagagtgagaaaagaatataaaatatggcaaaaattgaattttataaaaactttcctagaagaaggattgggaggacctataaacagttctctctgggctgtatggcaatgtggatgggttgttttttttttaattttgctttagtgtatttaaatttattcagtaaacctaaatttttaatcagaaaagacattaaaaattcagcaaagaaacctgttttgtagcttgtatttacattactctgaaattaaaaatt

SEQ ID NO: 17987 - DNA, 601 bp, Human
tcattttagtaccatggacctactataagaattgttacatatcagtgattaaaagtatatgctcaaaaatacatatacttaaaatctaaaatatttaattcagttttattgtcattaaaagggtttttggagaattatagcagtaatatatgttataaatatatatgctcatgtaagagtgagaaaagaatataaaatatggcaaaaattgaattttataaaaactttcctagaagaaggattgggaggacctataaacagttctctctgggctgtatggcaatgtggatgggttgttttytttttaattttgctttagtgtatttaaatttattcagtaaacctaaatttttaatcagaaaagacattaaaaattcagcaaagaaacctgttttgtagcttgtatttacattactctgaaattaaaaattagaacccatttaagggatgttgtgtagatcgtcatttggttcaagatttgaaaataaaaatacattttattagatacttaattctgaaccgaaatcagtgaaccaagcagggtggctaaaaagcacagatggatcagtaaaaattgaagcaatttttcatgtattgaaat

SEQ ID NO: 17988 - DNA, 601 bp, Human
tgttatgaattgctaaatgctagactagttggggttgtcaggacagtggaaggggaagaaaagggagactgtttcctaactcttaacagtcactgttactttatttgaagttggattgagaagaatgggagtaattggacttacttgcacatttgtattacaattgttaaactcctaaggatactgatcaaaattaattttcaattttttatctttatttgaaaaatggccacaatagttaattgaatattctggttagcctattatcttaaggtatgtaaaaattatcaatatgcaagtwcaaaacatatttgttaaatattacatagaagctgttttttccctcatatttcagaagttaaggacctgaaaaaggtaataggtcttaaatttattggaaatactaaagcattatataaaattatcttatttaattctaacatcaatcattgaaggcagtgttttcatccccatattacagaaaggttaagtcattgggtcaagttcatacaactactcattggccgtgctgagatatgaagcccagaatgtcagattccaaagctcaggctctttgcttcatacatacttgtcttccagt

SEQ ID NO: 17989 - DNA, 601 bp, Human
tttaatttcctttaggctttattgaacaactctcattattaccatatggcccatggaaaagattttgcatctagaggaattgaaagtaagtatacttttcatgcttaatgatattaccagactgcttgacttggctcttctgtctaaagacttaaatgtgtctaacgtacgcataatagatgtttagtgaaggaagagtaaaataaataatctaaaaaatgtggagagatttacttaaaaaagaaggcctaaatccagatttctcccagccaagtataaccaagcctaaccctgcaaatcsagatttctaccattatatcttctgttcctttgccaactttttcctgaggtttgcctttatgtgtttttgaagagtcagttttcatttcctaaaatctggaaatcactgagaaggctggattcctgagtactatggggagatagaggaaggaaggaaggcccacttaagctgttgatagtagaaaaattagaggagagaaagagtgaggcatagcggaaaaggaagaggacatttcataacgtatcttgtctcctgacatactttttgagctgttttaatcttttgtctccaattattgtt

SEQ ID NO: 17990 - DNA, 601 bp, Human
ctttaatactgccttttataagcattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggtcagtgtttaatattcagatttctgctttactttgaatacaaattaaactttgcattatagagtgatgatatttgaacttgrttacaggggaatatttatttaatttaaaatagcttgctaacctgaaatagatttccctgacatatatcacagatttttttgctgcaccatggtgtagcattactaagtaaggaagcattttgttttagataaattatttacagagtaatttttcctttgaatgatttatcaaacaaattactttaaactttgtgaatttataaagattattttgtaaaggttgttcatgtcaatggatatggaaagataactggcaaaaatcaagtcactgctacgaaagctgatggcggcactcaggtt

SEQ ID NO: 17991 - DNA, 601 bp, Human
ataaggtcagtgtttaatattcagatttctgctttactttgaatacaaattaaactttgcattatagagtgatgatatttgaacttggttacaggggaatatttatttaatttaaaatagcttgctaacctgaaatagatttccctgacatatatcacagatttttttgctgcaccatggtgtagcattactaagtaaggaagcattttgttttagataaattatttacagagtaatttttcctttgaatgatttatcaaacaaattactttaaactttgtgaatttataaagattatttygtaaaggttgttcatgtcaatggatatggaaagataactggcaaaaatcaagtcactgctacgaaagctgatggcggcactcaggttattgatacaaagaacattcttatagccacgggttcagaagttactccttttcctggaatcacggtatttatgcttcataatttacaaccattacaacttttctttagaaatacgttttataagttatttatgctatttgtgaactttgagagatttctgactgaaatactatattttgatggtcattcagctttgggaagttacctgtcttta

SEQ ID NO: 17992 - DNA, 601 bp, Human
tcttgctttaatttaatcttgttcactcatactcattattccaatctatatcttagtcttgattctgtcactcttatacttaactgcttttacttttcatagttcgtaaattttggaagtatgacaattaaggcatgcagtcccatcatctgatctgatcttggttaagcaaacttctgttgtcattcacgtcattagtacaaatttttgaccaggatgaaacatcgaaagccatctgacagtacagtctttcaccagttataaacacctttgatgtttattcatcttcgtttctccatckcatctacaaggatatcatgagattttcttaaaattttttttaacaccttgctgatatcaaaatatactacattcaccagtccagaaacccttcagaaagtaagagtggtttatgtgacctgtttggaacacttgtggtagtgtctactgattgtgaaaccagctgattaataatgtcttctagtatttagcagaatctcttcttttccatttttgaaaatttaggcatatttgcctgtctgccaccttttggcagttcccttgtgctaagtaagttcccagagttcactgagagtgcctg

SEQ ID NO: 17993 - DNA, 601 bp, Human
tcagttcacccatttaaaatgtacaattcaaaggtttttagtatattcatagagttgtagagctgttaccattgtctaactctagaacattttcatcaccctaaaagaaacttgctacccattagcagtcattctccatttctccctttgctcagcccctggaaaccactaattctactgtgtctatgaatttgcatattgtggacatttcatataaatgaaatcatacaatattattttgtgtgtgctctctttacatagcataatgttcttatggttcatccaagttgtagcatgtatstatacttcatttctttatctggctaaatatctcattctatggatatggcacattttgtttatccattcatcatgggtggacatttgggttgtttctactttcagactattatgaatgacactgctatgtctatttgtgtacaagtttttgtgtggttatctgttttcatttctcttgggtatataactggatgtgtaattgttgggtcatatggtaattattttaacttctcaaggaacaccgttacacttttccatacaatcccaccagcaacgtaaatttttgttgctctgcttttcc

SEQ ID NO: 17994 - DNA, 601 bp, Human
tttttgtgtggttatctgttttcatttctcttgggtatataactggatgtgtaattgttgggtcatatggtaattattttaacttctcaaggaacaccgttacacttttccatacaatcccaccagcaacgtaaatttttgttgctctgcttttccactgacacttggtattgtcattttttttaaaaaattgagctattctagtggttgtgtagtagtaactcactgtggggtttttttttctatttttattttttaaattgctatgtaatagatgtacttttttcaaggtacatgtgawaatttgatatattcatataattaaatcagggtaattaggctatccatcacctcgaacattttttttaatgctaggaatattgaattattctcttctagctattttgaaatgtgtaattgattgttacctatagtcaaccctgcattaacaccagctcttatttattctgtctaattgtatatttgtactgatgaatcaacctctcttcattcctcttctccccctagccttcccagcctctggtaaccatcattttgctctctatctccatgagttcagtttgtttgtttttttttttag

SEQ ID NO: 17995 - DNA, 601 bp, Human
ggaagcaaatttacttggcttgttattttaaagggtgctggagaaatggtaaatgaagctgctcttgctttggaatatggagcatcctgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctgcgtcatttggcaaatcaatcaacttttgaattagaagattatatatwtttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctc

SEQ ID NO: 17996 - DNA, 601 bp, Human
ttttaattttaaatttcttcccttgcagaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatrtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatt

SEQ ID NO: 17997 - DNA, 601 bp, Human
gggctcactcatttcaacatagaactcccaaatctcatcccacaacaaagagaccccaaacccgatgacatccaggaagggattccaaacttccatccttgccttgtacaaggtgatgtttgaagcatgtggaaagtgcaatgtggccacaaacaggtggacatagtcactgttcagaccaccctcgtaaatattctctgcgatgatcttgctgacgaaatttttgccggtgcctgtccacccgtgcagggagagcgtgagaggtttcttgggctttgggttgtttatgaaaccaaacacrgcatttaagatgattttctttgcaagatgctgtccaaagaggttgtcgtccagatccttctgcagtgctgggaaagacaaagccaatcaggagtggggaagaaacagcggcaaaatgtagccacatttacagcccataagaaagccagcaaagccgtctagacgccctccaagcaccttgcgaaacctcaagtactgcggtctgtaagctcctggcccagaggggacggcggtccagggagccctccctttgctggtcctgcctattctaaagccctggcccgactccttcccgaaaagc

SEQ ID NO: 17998 - DNA, 601 bp, Human
taaaagctgtttgcggctgggcaaggtggctcacgcctgtaatcctagcactctgggaggctgaggtaggcagatcacttgaggtcaggagttcgagaccagcctggccaatgtgaggaaaccccatctctactagaaatacaaaaattagccggctgtggtggcacatgcctgtagtcacagctacttgggaggctgaggcaggagaatcgcttgaaccgggaaggtggaggctgtagtgagctgagatggcgtcactgcactccagcctggacaacagagtgagaccctgactcaaagaaaaaaaaaaaaaggcagtttacaacagtaggttcaacaaacttaggactctacatgtttcctctttcacaaaatgagtgagatgtggccaggcatggtggctcacgcctgtaatcccagcacttcgggaagctgaggcaggcacatcacctgagatcaggagttcgagaccagcctggccaagttggcaaaaccccatctctactaaaaatacaaaaattagctgggcatggtggcaggaccctgtaatcccagctacccgggaggctgaggcaggataattgcttcaaccgggaggcag

SEQ ID NO: 17999 - DNA, 601 bp, Human
tttgtaagtcagaatctgagtctcaggtcaggcaactttcctaagactacggagctgggagagtgttaggactcaaatccagatgtgtctgctgccaaagcccaagctgctcatcagtgagttcaaccataaaagctgtttgcggctgggcaaggtggctcacgcctgtaatcctagcactctgggaggctgaggtaggcagatcacttgaggtcaggagttcgagaccagcctggccaatgtgaggaaaccccatctctactagaaatacaaaaattagccggctgtggtggcacatgcytgtagtcacagctacttgggaggctgaggcaggagaatcgcttgaaccgggaaggtggaggctgtagtgagctgagatggcgtcactgcactccagcctggacaacagagtgagaccctgactcaaagaaaaaaaaaaaaaggcagtttacaacagtaggttcaacaaacttaggactctacatgtttcctctttcacaaaatgagtgagatgtggccaggcatggtggctcacgcctgtaatcccagcacttcgggaagctgaggcaggcacatcacctgagatcaggagttcgagacc

SEQ ID NO: 18000 - DNA, 601 bp, Human
catcttgcaggtctgctacaaggatctaaaaggcaacagttaacatttatttgtaacatgcaccaggtacatgttatgcacttgacagacagagctccctggattgttacaagcaacactttgtaagtcagaatctgagtctcaggtcaggcaactttcctaagactacggagctgggagagtgttaggactcaaatccagatgtgtctgctgccaaagcccaagctgctcatcagtgagttcaaccataaaagctgtttgcggctgggcaaggtggctcacgcctgtaatcctagcactytgggaggctgaggtaggcagatcacttgaggtcaggagttcgagaccagcctggccaatgtgaggaaaccccatctctactagaaatacaaaaattagccggctgtggtggcacatgcctgtagtcacagctacttgggaggctgaggcaggagaatcgcttgaaccgggaaggtggaggctgtagtgagctgagatggcgtcactgcactccagcctggacaacagagtgagaccctgactcaaagaaaaaaaaaaaaaggcagtttacaacagtaggttcaacaaacttaggactcta

SEQ ID NO: 18001 - DNA, 601 bp, Human
tctcaaaaataaataaataaataattgactgttttgcccatcttgcaggtctgctacaaggatctaaaaggcaacagttaacatttatttgtaacatgcaccaggtacatgttatgcacttgacagacagagctccctggattgttacaagcaacactttgtaagtcagaatctgagtctcaggtcaggcaactttcctaagactacggagctgggagagtgttaggactcaaatccagatgtgtctgctgccaaagcccaagctgctcatcagtgagttcaaccataaaagctgtttgcrgctgggcaaggtggctcacgcctgtaatcctagcactctgggaggctgaggtaggcagatcacttgaggtcaggagttcgagaccagcctggccaatgtgaggaaaccccatctctactagaaatacaaaaattagccggctgtggtggcacatgcctgtagtcacagctacttgggaggctgaggcaggagaatcgcttgaaccgggaaggtggaggctgtagtgagctgagatggcgtcactgcactccagcctggacaacagagtgagaccctgactcaaagaaaaaaaaaaaaagg

SEQ ID NO: 18002 - DNA, 601 bp, Human
cccagctactcaggaggctgaggtagaattgcatgaacctgggaggcggaggttgcggtgagccaagatcaagccattgcactccagcgtggcgacagagcaagactccattaaaaaaaaaaatacaaaaattagccaggcatagtggcaggcgcctgtaatcccaggtacttgggaggctgaggcttgagaatcgctggaacctgggaggtggaggttgcagtgagctaagatcaccccactgcactccagcactccagcctgggagacagagcaagactccgtctcaaaaaaaaaaaawaataataataataaataaataaaataaaataaaataaataaataaaataaacaaggattcactcagacctgttaggctccagcagccaaggtttctcactctggtgaccaaacttatatgcaataacagggaacatgcactgagtgttcactatgggaacaacaatattctaagcactgttcatataactttttttttttgacagtctcgctctgttacccagactggagtgcaatgacatgatctcagctcactgcaacctctgcctcccagattcaagcgattcccttgcctcagccc

SEQ ID NO: 18003 - DNA, 601 bp, Human
catggtgaaaccccatctctattaaaatacaaaaattagggccaggcatggtggttcatgcctgtaatcccagcactttgggaggccaaagtgggtggatcacctgaggtcaggagttcaagaccagcctggccaacatggtgaaacctggtctctactaaaaaaaatacaaaaaaattagctgggtatggtggcaggtgcttatagtcccagctactcaggaggctgaggtagaattgcatgaacctgggaggcggaggttgcggtgagccaagatcaagccattgcactccagcgtggygacagagcaagactccattaaaaaaaaaaatacaaaaattagccaggcatagtggcaggcgcctgtaatcccaggtacttgggaggctgaggcttgagaatcgctggaacctgggaggtggaggttgcagtgagctaagatcaccccactgcactccagcactccagcctgggagacagagcaagactccgtctcaaaaaaaaaaaataataataataataaataaataaaataaaataaaataaataaataaaataaacaaggattcactcagacctgttaggctccagcagccaaggt

SEQ ID NO: 18004 - DNA, 601 bp, Human
accagcctggccaacatgacaaaaccccatctctactaaaaatacaaatattagctgggcatggtgtgcacctgtaatcccagctactcaggaggctgaggcacaagaatcgcttgagcccgggaggcagaggttgcagtgaggcaaggttacgccactgcactccagcctaggtgacagagtaaaactatctgaaaaataaaaataaaacagcacttgtcaaacattagtgttcataaaagttacctggagttcatcagcaaagattcccctcatgactcggaaggggactgagaatctscatttctttctacccagctcccaggtgatgctgacagtgaccctgatgcttttaacacttagggtgcaggattaggaaccagatgggactggcggtggatggccctactcactgttcttgttattgaaaaccgacacagacaacgcgtgttcaatgtctttgagcttgatgtcttccctctgctttccactcctccagaaatccaaagccacatctgtgatcctttctgctccagcattgctgcaaaacaatcccagtgggtaaggacagggttttctcctggagctcagaggcttgggc

SEQ ID NO: 18005 - DNA, 601 bp, Human
tttctgtgtttgttcactgctgtgtcccccgtcctaggtatgatgcctggcacttaccagatgctccatatacatgtgctgaatcaatgttcagccatctgcctgaggtcacagtcagtctgtgggccagggctgcccgactcccaggttggcactcctaagcaccgtgtaacctccacagcgtggattctaggccacggggctcatctgcctcagcattaggctaaagtttccactgcatgtgctcatgttttttggcaaggcaagaaactatccaacatgttacaaaatacttgtcttkcctcagtagtattccacttgcacacactgacatactgtaccccatgctgttcactaactgtaggattaatttcttggcaagtctgtttcaaatgagcccttctgttttgtcatctccagaacctgaagcgcaaagacttgaacagccagccctgcacaactcacaggtcttagccagtgagtcagcctccatcaggctggctttccacctccccaggttcaaggtcaaaggtctcatgacatttggagaagtagtgagctaaaacttaaaagctcaggttttagaatcagagataccgaa

SEQ ID NO: 18006 - DNA, 601 bp, Human
atttctgtgtttgttcactgctgtgtcccccgtcctaggtatgatgcctggcacttaccagatgctccatatacatgtgctgaatcaatgttcagccatctgcctgaggtcacagtcagtctgtgggccagggctgcccgactcccaggttggcactcctaagcaccgtgtaacctccacagcgtggattctaggccacggggctcatctgcctcagcattaggctaaagtttccactgcatgtgctcatgttttttggcaaggcaagaaactatccaacatgttacaaaatacttgtctytcctcagtagtattccacttgcacacactgacatactgtaccccatgctgttcactaactgtaggattaatttcttggcaagtctgtttcaaatgagcccttctgttttgtcatctccagaacctgaagcgcaaagacttgaacagccagccctgcacaactcacaggtcttagccagtgagtcagcctccatcaggctggctttccacctccccaggttcaaggtcaaaggtctcatgacatttggagaagtagtgagctaaaacttaaaagctcaggttttagaatcagagataccga

SEQ ID NO: 18007 - DNA, 601 bp, Human
gaaagatatctatatgtccacatgtgtacatgtgcgatgtgtgcatatgtactgcatgtatacacacaaacacatcacacacatcaacatatctatcccccatcatctgatacattttctttctttattatcactaggatgtaggattgataagggcaagaatttctgtgtttgttcactgctgtgtcccccgtcctaggtatgatgcctggcacttaccagatgctccatatacatgtgctgaatcaatgttcagccatctgcctgaggtcacagtcagtctgtgggccagggctgcccractcccaggttggcactcctaagcaccgtgtaacctccacagcgtggattctaggccacggggctcatctgcctcagcattaggctaaagtttccactgcatgtgctcatgttttttggcaaggcaagaaactatccaacatgttacaaaatacttgtctttcctcagtagtattccacttgcacacactgacatactgtaccccatgctgttcactaactgtaggattaatttcttggcaagtctgtttcaaatgagcccttctgttttgtcatctccagaacctgaagcgcaaagact

SEQ ID NO: 18008 - DNA, 601 bp, Human
atgcatgtgtgcttgggctcatttccagtaaagatacatcacagtctatgtaataatgatgagaacttaaaaaaaaacacacacacaaggccaacaacttagaatctgagcagtctctcataatgttaaaaatcattttaaataaagttaccacattttcaataaaacttattcatccttccttgaaacagaaacacttggaattaaaacataatttgtaaaaaatcatgagccctgcgatgagtgggctgggagctggctccttccttctgtgcgtgttcgggaggcttcacgtcctcgmccgtggtccctgggtggcctgcaggcaccagggggtggaaacaatgccagggagaattcctgtcacatcaaacaggaacattcactggattcctcttccagggaaaggagctgggggtggaagtgtggaaggactgagtgttgtttcttttccaactccaggcagtgactccggctgccaatcatgactgtcaatcatcgtagtaataatctaacttggtgaacaccgttttgcagcctttatctgagaaaactctctcctctttggggaaaaatgtcatctcctcagccactctgctta

SEQ ID NO: 18009 - DNA, 601 bp, Human
tgtggccaaaatcactcccacagctcccattgttgctaaggtgaaaacccttggagaggctgtttcaggcttatctgtggtgcctgaaggcgtcctcttacctacttgtccttcacctaaacacttcactgcccctggcagcatccgctgggaccatcctgggacagagctggctcatgctccagccacatccccagggatgccctcctgtggaacaaatgccatgcatgtgtgcttgggctcatttccagtaaagatacatcacagtctatgtaataatgatgagaacttaaaaaaaaacacacacacaaggccaacaacttagaatctgagcagtctctcataatgttaaaaatcattttaaataaagttaccacattttcaataaaacttattcatccttccttgaaacagaaacacttggaattaaaacataatttgtaaaaaatcatgagccctgcgatgagtgggctgggagctggctccttccttctgtgcgtgttcgggaggcttcacgtcctcgcccgtggtccctgggtggcctgcaggcaccagggggtggaaacaatgccagggagaattcctgtcacatcaaacagga

SEQ ID NO: 18010 - DNA, 601 bp, Human
cctggattgttctgctaggtcttcactcgcagccttacctcataaggtctacagtggaggggcgcttctccctcttcaaaaacgtactcaccaatggcacatgcaaaattttattgtaaaacggtagccatttgcatttataaagaaagacaccgttctcagcatcctcagaaggggcagctaagctttataggaggtttcggggattctgattgaacgtaacaaataatagtataaatgaggaagatttaatatggcaaaattcacataatttagaatccagcagagagcacgtgtgggcatttggaatggacagtgaagggccaccttttgcaaaacggagtgactggcaagtgacaagttggaaatacttttctttcaaaagactggttctaacaaatgttgacagtgtggccaaaatcactcccacagctcccattgttgctaaggtgaaaacccttggagaggctgtttcaggcttatctgtggtgcctgaaggcgtcctcttacctacttgtccttcacctaaacacttcactgcccctggcagcatccgctgggaccatcctgggacagagctggctcatgctccagccacatc

SEQ ID NO: 18011 - DNA, 601 bp, Human
gggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatcygggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgcta

SEQ ID NO: 18012 - DNA, 601 bp, Human
atcctcctgcttaaaacccttaagttctcattgcttttagataaaatataaaccctttcactttgtttttattactccttatgattcagcccttacttagcttacaaggacttcctcatgtctgagctctagccataatagctgactgttggatgagtcatcggggggaggttcttcttcaggctgcagattggcggtcagccctcctgacctcagctgggctcactcacacatctgggaggcagctgcctgaggccagggtgactctgctctatgcctcatgtctcctatcctccttgtrcccacatgttagctgggacatgttctcatcgcaatggcagaggcatgagaaagtgatcctgtttgggcaagtgcattttactcttttctttcactcatgtccactgacatttcattggccaagcaagcatgtggggtgtccagagtcaaagagggacatgttgccggggtcatgactatttctgagcaataatctaacctatcatagctcagatctcactccttgcaggaagcatctcctaatccttaagacctagttggaacttacactctgttcttccctatggttactgcccatttt

SEQ ID NO: 18013 - DNA, 601 bp, Human
cactccttgcaggaagcatctcctaatccttaagacctagttggaacttacactctgttcttccctatggttactgcccattttactatttttctgcccatttagactgacaactctgtgagccatcattgcaatatggcttgcttacccaatatcacctagcatgatgtagagcacatagtaaatactcaacaaatgttttctgtaagagctaaggaaggacatcagcagacaaaatagagtctttctatgccaaaaggtgaaagtggtctcatttccattccattgtcctgtaatttgrctagccaaaagcttagtggataccattcccataagtagacctcatctgcagggaagagatggggagactgctgggttatttattgcagactccagcaggaccacaacaatgattcaaagtgatgacactagaaggacaggtgccaatgggtgatgaagccacaatgacgatgtcaagtggtatcactaaaaggacaggtactcatgggtgatgaagcctacatgaccttgggcttacaccaggaccctaggaatgaaagagattccttctcttagtggctatgagggaaggcctatgatg

SEQ ID NO: 18014 - DNA, 601 bp, Human
tctctctttctctctctctctctgacacacacacacacatacacacacacacaattgtaataataataatattttggttcctcactaagccaatctaaatcgcagaagtctattttgttaagtaagcttggccccagccatatgttgctactcagagaatttaatatcagatttcatctgactgtaaacgtgaatcatcaggttgcacaaggaacacagtggcagatccagggggcatttaacttttatagcattttaaatgaaaaaaaaaaaaagtaacacttaaacaagtaatttagaycatgctgtaggccctgaatagctttgatgttgtgttttcatggcaagtctccaacttgagctgaattttcccctactaaaaatgcaaatttttctaagaccttctcttggtcctgctactcatgatacatatttcttttaaaagaaatttcaaactagataatagttgttctcctccccacccccgccaccagtagtgtggtggggcagcagagttgtggctagtggaggagagcagaggaggagagtagggaaaggagaatgccatttgcctacatttccctctgcccatttccccctg

SEQ ID NO: 18015 - DNA, 601 bp, Human
aaaaaggagaatttcaggcagtgataagagtgctgagaaaaacagaacggtgtgaaagaggaaggctgagcctgcagaggcttgaggctgctgccactgggtagcggtaggcctttccgaggaggcggcatttgaagaccggaggaaggttcatcccagcaagtaggaacagcaagtgtaggtcccctaagtcttgggggagcttagttcctttaagggcagcacaaaaatcagtgtggctccggagagcacattaggggagagaggcaggaagagcttggagacatggatggaagctggrccagttgggccttgttgaacatggaaaggcatttagatcgtattctgagttaaatgggaagtgacgtgagagatttaacaatggagcgtcttgaactgctttactcatttaaaatacccactcctgcttggctgaatatctcatgttgtctttttagaagctttggcgatcctatttgaatgcatttaggtcctattggaggggaataggatctcatttgaggccacggaggtccatggaagtcacctgcatagcaaataccctgaaagtggctgcagggagagtgtgagggtgggaccg

SEQ ID NO: 18016 - DNA, 601 bp, Human
atggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacytgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtgggga

SEQ ID NO: 18017 - DNA, 601 bp, Human
ttaagtgatcaccaaaggactgagaatctgggagggcaaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttcttttt

SEQ ID NO: 18018 - DNA, 601 bp, Human
acaatggagaaaataaagtcaaatcccataggaagtgtttatttttccaagttatgttttgtttgtttattttgagggtgggaagaaaactcggtagcattgcctttgcacaagaacattcagattgcttctacagaagttcaggttcaatccgatcaagagaactgattaaagttgtttttccataacttgagaaaaattaagtagagtacagaattatagaatcttagagctgagcaaccttaataagattaacaaactgttcatttcagtgttaagtaaatcaaattctagaaatatyaaatgaaggattaaaatgtatattcatatatttataaggaagcacatctttaattccacatatacagtattcttttttcttaaatgcccctttgtttttcttagtggctttaacattttgaactttatagttctatttgcttcttgtggcatttctttctgacacaaaaatgagaaaattagcaaatattaagccaaaatcactataagaatctacaacttttataaatttaaacttagagttcctaaactgtaagctataattgatgcagatttttcttttaggggaatgacacaaatt

SEQ ID NO: 18019 - DNA, 601 bp, Human
ctaggttgtaattaaaggtgacaccaagttcaaaaacaacttcaatgtttcgaaaagcgcttgattctttgactgtgaatttatttccttcttgtgtaattgtcagcttcaaattgtcatgagctgcaagcttccttttcactatattaacacctgtaaaaggtaagacaatggagaaaataaagtcaaatcccataggaagtgtttatttttccaagttatgttttgtttgtttattttgagggtgggaagaaaactcggtagcattgcctttgcacaagaacattcagattgcttctayagaagttcaggttcaatccgatcaagagaactgattaaagttgtttttccataacttgagaaaaattaagtagagtacagaattatagaatcttagagctgagcaaccttaataagattaacaaactgttcatttcagtgttaagtaaatcaaattctagaaatatcaaatgaaggattaaaatgtatattcatatatttataaggaagcacatctttaattccacatatacagtattcttttttcttaaatgcccctttgtttttcttagtggctttaacattttgaactttatagttc

SEQ ID NO: 18020 - DNA, 601 bp, Human
ttctttatgaataggtctatattcagtcattcaaaagatagttttctaattcttactgttcaattcagattcttcacagatgcgtataaaaataaaagcatatttaaatatcctgccaatttgtgcaatatataatgtagacaaacttcattggcttcttcagttagtgaaggagacctgcattaattaaaccatccaatgaaatagagcagaaatcattttaatattgggtagaaaaatcaagaatgcattgctcataaaaaaaaaaattcttaccctgagttcagttccgtctgctagrttgtaattaaaggtgacaccaagttcaaaaacaacttcaatgtttcgaaaagcgcttgattctttgactgtgaatttatttccttcttgtgtaattgtcagcttcaaattgtcatgagctgcaagcttccttttcactatattaacacctgtaaaaggtaagacaatggagaaaataaagtcaaatcccataggaagtgtttatttttccaagttatgttttgtttgtttattttgagggtgggaagaaaactcggtagcattgcctttgcacaagaacattcagattgcttctacagaa

SEQ ID NO: 18021 - DNA, 601 bp, Human
atttggtaactcactcatttgttcatctattcatttcttttattatttcaacatgttacagttaagttacatattaactctaaaggcttcttttgctgtactgtttaaaaacacagttttaaatttctttatgaataggtctatattcagtcattcaaaagatagttttctaattcttactgttcaattcagattcttcacagatgcgtataaaaataaaagcatatttaaatatcctgccaatttgtgcaatatataatgtagacaaacttcattggcttcttcagttagtgaaggagamctgcattaattaaaccatccaatgaaatagagcagaaatcattttaatattgggtagaaaaatcaagaatgcattgctcataaaaaaaaaaattcttaccctgagttcagttccgtctgctaggttgtaattaaaggtgacaccaagttcaaaaacaacttcaatgtttcgaaaagcgcttgattctttgactgtgaatttatttccttcttgtgtaattgtcagcttcaaattgtcatgagctgcaagcttccttttcactatattaacacctgtaaaaggtaagacaatggagaaaat

SEQ ID NO: 18022 - DNA, 601 bp, Human
taaacatgaaaaggtacactcccaatgacctacaatacatcaaatctttccatttggtaactcactcatttgttcatctattcatttcttttattatttcaacatgttacagttaagttacatattaactctaaaggcttcttttgctgtactgtttaaaaacacagttttaaatttctttatgaataggtctatattcagtcattcaaaagatagttttctaattcttactgttcaattcagattcttcacagatgcgtataaaaataaaagcatatttaaatatcctgccaatttgtgyaatatataatgtagacaaacttcattggcttcttcagttagtgaaggagacctgcattaattaaaccatccaatgaaatagagcagaaatcattttaatattgggtagaaaaatcaagaatgcattgctcataaaaaaaaaaattcttaccctgagttcagttccgtctgctaggttgtaattaaaggtgacaccaagttcaaaaacaacttcaatgtttcgaaaagcgcttgattctttgactgtgaatttatttccttcttgtgtaattgtcagcttcaaattgtcatgagctgcaag

SEQ ID NO: 18023 - DNA, 601 bp, Human
taaaatgtgttatcttaaacatgaaaaggtacactcccaatgacctacaatacatcaaatctttccatttggtaactcactcatttgttcatctattcatttcttttattatttcaacatgttacagttaagttacatattaactctaaaggcttcttttgctgtactgtttaaaaacacagttttaaatttctttatgaataggtctatattcagtcattcaaaagatagttttctaattcttactgttcaattcagattcttcacagatgcgtataaaaataaaagcatatttaaataycctgccaatttgtgcaatatataatgtagacaaacttcattggcttcttcagttagtgaaggagacctgcattaattaaaccatccaatgaaatagagcagaaatcattttaatattgggtagaaaaatcaagaatgcattgctcataaaaaaaaaaattcttaccctgagttcagttccgtctgctaggttgtaattaaaggtgacaccaagttcaaaaacaacttcaatgtttcgaaaagcgcttgattctttgactgtgaatttatttccttcttgtgtaattgtcagcttcaaatt

SEQ ID NO: 18024 - DNA, 601 bp, Human
aatgatgacttcctaaaatgtgttatcttaaacatgaaaaggtacactcccaatgacctacaatacatcaaatctttccatttggtaactcactcatttgttcatctattcatttcttttattatttcaacatgttacagttaagttacatattaactctaaaggcttcttttgctgtactgtttaaaaacacagttttaaatttctttatgaataggtctatattcagtcattcaaaagatagttttctaattcttactgttcaattcagattcttcacagatgcgtataaaaataaaarcatatttaaatatcctgccaatttgtgcaatatataatgtagacaaacttcattggcttcttcagttagtgaaggagacctgcattaattaaaccatccaatgaaatagagcagaaatcattttaatattgggtagaaaaatcaagaatgcattgctcataaaaaaaaaaattcttaccctgagttcagttccgtctgctaggttgtaattaaaggtgacaccaagttcaaaaacaacttcaatgtttcgaaaagcgcttgattctttgactgtgaatttatttccttcttgtgtaattg

SEQ ID NO: 18025 - DNA, 601 bp, Human
tgttaacaactctgtgcttgttttaatttgtgtgattgtggtactaattaaagaaagacataacttatgataaaacattcagtagttaaattgtcattacaaacatgtaatttaaatagaaaaatgttgaggctaaaaaaagtttttaaaaaatttgttgaaaatgatgacttcctaaaatgtgttatcttaaacatgaaaaggtacactcccaatgacctacaatacatcaaatctttccatttggtaactcactcatttgttcatctattcatttcttttattatttcaacatgttactgttaagttacatattaactctaaaggcttcttttgctgtactgtttaaaaacacagttttaaatttctttatgaataggtctatattcagtcattcaaaagatagttttctaattcttactgttcaattcagattcttcacagatgcgtataaaaataaaagcatatttaaatatcctgccaatttgtgcaatatataatgtagacaaacttcattggcttcttcagttagtgaaggagacctgcattaattaaaccatccaatgaaatagagcagaaatcattttaatattgggtagaa

SEQ ID NO: 18026 - DNA, 601 bp, Human
atgttaacaactctgtgcttgttttaatttgtgtgattgtggtactaattaaagaaagacataacttatgataaaacattcagtagttaaattgtcattacaaacatgtaatttaaatagaaaaatgttgaggctaaaaaaagtttttaaaaaatttgttgaaaatgatgacttcctaaaatgtgttatcttaaacatgaaaaggtacactcccaatgacctacaatacatcaaatctttccatttggtaactcactcatttgttcatctattcatttcttttattatttcaacatgttatagttaagttacatattaactctaaaggcttcttttgctgtactgtttaaaaacacagttttaaatttctttatgaataggtctatattcagtcattcaaaagatagttttctaattcttactgttcaattcagattcttcacagatgcgtataaaaataaaagcatatttaaatatcctgccaatttgtgcaatatataatgtagacaaacttcattggcttcttcagttagtgaaggagacctgcattaattaaaccatccaatgaaatagagcagaaatcattttaatattgggtaga

SEQ ID NO: 18027 - DNA, 601 bp, Human
gatgttaacaactctgtgcttgttttaatttgtgtgattgtggtactaattaaagaaagacataacttatgataaaacattcagtagttaaattgtcattacaaacatgtaatttaaatagaaaaatgttgaggctaaaaaaagtttttaaaaaatttgttgaaaatgatgacttcctaaaatgtgttatcttaaacatgaaaaggtacactcccaatgacctacaatacatcaaatctttccatttggtaactcactcatttgttcatctattcatttcttttattatttcaacatgtttcagttaagttacatattaactctaaaggcttcttttgctgtactgtttaaaaacacagttttaaatttctttatgaataggtctatattcagtcattcaaaagatagttttctaattcttactgttcaattcagattcttcacagatgcgtataaaaataaaagcatatttaaatatcctgccaatttgtgcaatatataatgtagacaaacttcattggcttcttcagttagtgaaggagacctgcattaattaaaccatccaatgaaatagagcagaaatcattttaatattgggtag

SEQ ID NO: 18028 - DNA, 601 bp, Human
ttgttttgtagtaatttttgccttttgaaaatagctataaatttgacaactcacctggactagttcatcacctataatttctcggacagtattcagttcgtttccattgtctgtccgtttgaattttccaataagtttatttccctcaaggctccaggtcccctacataataataataataataataataataataataatggcatttattagggtcttacacatgtcaggcactgttctgagttctgtagacacactttttcatttaatcttcatggtgaccctatgaaactgatactaytatctctactttgcagaagaggagactgtaaaatggcacagtgattcacctaaagtcacagagtgaggattgaacctaggccattgggctacagagtatgtgttgataaccattatgcttgttctcttcaataatttccatacgctgaattttaaggcagatgagcagcacttctttctgaatctttcatgttacgtgtccagaaatatagtcatggttaaaattagtttcatggagatgttaacaactctgtgcttgttttaatttgtgtgattgtggtactaattaaagaaagacata

SEQ ID NO: 18029 - DNA, 601 bp, Human
catggacgcaatatttatttttgttttttaaaatgtcacaaattcttttagtaaatatatatcttagagaatataaaacaaattaaatcctaattagcttttacttcttttgctttggcatgaatggaaatataccaatgtttataaaaggaccaatcaatcagtaaccttatacttgatggggtgaaataaatagttctggtacaatatagatcttctgtccaatttgtattttggactgtgcgccaagaataatgctcaatcctttttaaagatccttttggcttctactccttcatayacataagtctgaaaggtgttaacaaacagaagaatttatctttaaggtttacatctaagttaagaaaaagtagtattatagttttatactatatgagtttatactatttttatattatatattcatatatattatatgagtatgagtttatacaattttttcttgtacttgatagcaagatttatacagatatgggatacagccattttaaaacacatgttggtttgtagtcatttatattttcagttaaaataggcattgattatttgacatatataagttgtctttagtaaataggca

SEQ ID NO: 18030 - DNA, 601 bp, Human
acattccagcctgagtgaaagagtaagaccctctctctacgaaaacaatctgtcaattcatattcacatactttttcttttaaaaggcaaggctacatataaagcaacatggacgcaatatttatttttgttttttaaaatgtcacaaattcttttagtaaatatatatcttagagaatataaaacaaattaaatcctaattagcttttacttcttttgctttggcatgaatggaaatataccaatgtttataaaaggaccaatcaatcagtaaccttatacttgatggggtgaaataaayagttctggtacaatatagatcttctgtccaatttgtattttggactgtgcgccaagaataatgctcaatcctttttaaagatccttttggcttctactccttcatatacataagtctgaaaggtgttaacaaacagaagaatttatctttaaggtttacatctaagttaagaaaaagtagtattatagttttatactatatgagtttatactatttttatattatatattcatatatattatatgagtatgagtttatacaattttttcttgtacttgatagcaagatttatacagatat

SEQ ID NO: 18031 - DNA, 601 bp, Human
aggggttcaagaccagcctgggcaatatagcaagaccccatctctaaaaaaaataaaaagaaaacaaaacaaaaattagctgggcactgtggaatgtacccatagtcctagctactcagaagcctgaggcaggaagattgcatgagtccaggagtttgaggttacagtgagctatgatctctccactacattccagcctgagtgaaagagtaagaccctctctctacgaaaacaatctgtcaattcatattcacatactttttcttttaaaaggcaaggctacatataaagcaacatggaygcaatatttatttttgttttttaaaatgtcacaaattcttttagtaaatatatatcttagagaatataaaacaaattaaatcctaattagcttttacttcttttgctttggcatgaatggaaatataccaatgtttataaaaggaccaatcaatcagtaaccttatacttgatggggtgaaataaatagttctggtacaatatagatcttctgtccaatttgtattttggactgtgcgccaagaataatgctcaatcctttttaaagatccttttggcttctactccttcatatacataa

SEQ ID NO: 18032 - DNA, 601 bp, Human
ttagtttatcaaatgtaaagaaaaaaaacaacttgagaggctgaggcaggaggattgcttgaggccaggggttcaagaccagcctgggcaatatagcaagaccccatctctaaaaaaaataaaaagaaaacaaaacaaaaattagctgggcactgtggaatgtacccatagtcctagctactcagaagcctgaggcaggaagattgcatgagtccaggagtttgaggttacagtgagctatgatctctccactacattccagcctgagtgaaagagtaagaccctctctctacgaaaacartctgtcaattcatattcacatactttttcttttaaaaggcaaggctacatataaagcaacatggacgcaatatttatttttgttttttaaaatgtcacaaattcttttagtaaatatatatcttagagaatataaaacaaattaaatcctaattagcttttacttcttttgctttggcatgaatggaaatataccaatgtttataaaaggaccaatcaatcagtaaccttatacttgatggggtgaaataaatagttctggtacaatatagatcttctgtccaatttgtattttggactg

SEQ ID NO: 18033 - DNA, 601 bp, Human
ttcacaaccagttcaagatgttaaagactcatatgcagcctatgcttttagtttatcaaatgtaaagaaaaaaaacaacttgagaggctgaggcaggaggattgcttgaggccaggggttcaagaccagcctgggcaatatagcaagaccccatctctaaaaaaaataaaaagaaaacaaaacaaaaattagctgggcactgtggaatgtacccatagtcctagctactcagaagcctgaggcaggaagattgcatgagtccaggagtttgaggttacagtgagctatgatctctccactrcattccagcctgagtgaaagagtaagaccctctctctacgaaaacaatctgtcaattcatattcacatactttttcttttaaaaggcaaggctacatataaagcaacatggacgcaatatttatttttgttttttaaaatgtcacaaattcttttagtaaatatatatcttagagaatataaaacaaattaaatcctaattagcttttacttcttttgctttggcatgaatggaaatataccaatgtttataaaaggaccaatcaatcagtaaccttatacttgatggggtgaaataaat

SEQ ID NO: 18034 - DNA, 601 bp, Human
actatttcaaagaagaaggtttaaagggatgagaactctggaacttgtaaaaagaaataaaagcagccaaagcataaatgtatatatctgtttattactattttgagtactgtatggcaaatgacatcatagtctgtaacaatctaaaccctgaaatagaaaaaggatcaaccaaatagaaaacagcttaagatttaaaaacacacatgcatgctattgtacaaccggacctttttccacttgttacctttcataaaatttcaaaaataaaagcaaactaggataacatgcaggtaagccracacaatgggcactttctgctactgcagcaaaacatctctcacatgtgtcccagcatcaagcctggtcctacactttttgggaccatataaaggtcaagttacgtatgtctcattaaaaaaacaattctaaaaattagcatcggttgttcacacagactgtatctttccttatagtttctaaagacatatgaactcatattatcaatacaaattattcttcaaatttcctatttactctttgattaagggaagaaaagcttaacacaagaacactttgttaagtgacaattttgcttttc

SEQ ID NO: 18035 - DNA, 601 bp, Human
ccttaaataaggtcaaagcagccaatgtcaaaggcaaagtcacggcaggattcacactctgaagaatgactttacaacatgggaaagagtgtgtgagttatgaaaccgtgaaacaaaattaactcggtatcattagtatagccattttatattgaatttaaaatgaagttatgaaagtgattacaggcaaaagtagatatttaaatcatctgggagtttctgtcctctaatacgaagagctctattttcctgaagatctgcatgggtgcgtgcacgtgtgtgtgtgtgtgtgtgtgtgtggttatctatacaaacctacacacacatacatggacaacagtataggaagccatctttgtaatagaacaatgaatacatttgataagttgttccattaaaaaaaaaaaactaggagaaaggttcataatgtaagcctctgtgaaacaatgcaaagattaaaatagccattttgagaggacacgtttttgattcttaccatatgctaaaataaaaggattccaacaagcttttgccaacagttgaccaattgtggggaatctttcaatgactgtattagaatcctgtgaaagaaaaataaatt

SEQ ID NO: 18036 - DNA, 601 bp, Human
ccttggataaaaccaaaatggcacccttaaataaggtcaaagcagccaatgtcaaaggcaaagtcacggcaggattcacactctgaagaatgactttacaacatgggaaagagtgtgtgagttatgaaaccgtgaaacaaaattaactcggtatcattagtatagccattttatattgaatttaaaatgaagttatgaaagtgattacaggcaaaagtagatatttaaatcatctgggagtttctgtcctctaatacgaagagctctattttcctgaagatctgcatgggtgcgtgcacgygtgtgtgtgtgtgtgtgtgtgtgtttatctatacaaacctacacacacatacatggacaacagtataggaagccatctttgtaatagaacaatgaatacatttgataagttgttccattaaaaaaaaaaaactaggagaaaggttcataatgtaagcctctgtgaaacaatgcaaagattaaaatagccattttgagaggacacgtttttgattcttaccatatgctaaaataaaaggattccaacaagcttttgccaacagttgaccaattgtggggaatctttcaatgactgtattag

SEQ ID NO: 18037 - DNA, 601 bp, Human
accttggataaaaccaaaatggcacccttaaataaggtcaaagcagccaatgtcaaaggcaaagtcacggcaggattcacactctgaagaatgactttacaacatgggaaagagtgtgtgagttatgaaaccgtgaaacaaaattaactcggtatcattagtatagccattttatattgaatttaaaatgaagttatgaaagtgattacaggcaaaagtagatatttaaatcatctgggagtttctgtcctctaatacgaagagctctattttcctgaagatctgcatgggtgcgtgcacgtgtgtgtgtgtgtgtgtgtgtgtgtttatctatacaaacctacacacacatacatggacaacagtataggaagccatctttgtaatagaacaatgaatacatttgataagttgttccattaaaaaaaaaaaactaggagaaaggttcataatgtaagcctctgtgaaacaatgcaaagattaaaatagccattttgagaggacacgtttttgattcttaccatatgctaaaataaaaggattccaacaagcttttgccaacagttgaccaattgtggggaatctttcaatgactgtatta

SEQ ID NO: 18038 - DNA, 601 bp, Human
tgcaaacaggattacatcagttctatttttcttggtgtgagtgatatttccgttgagattcccccaacccccatcttctcatgtttcactctgtcagagtgaaaaggaagcagtgccatgtcacatttactaataattgggattttatgtttaatgtctataattctgcattcctatttaagcaatgaacaatagacaggtcattaatttcctaagaattaaaaccaaatccatttaaagaaaagttagtttacttcttcatttaaaattcagttcatttgaaaaaaaaaaaaaagttgtyattgtacaaagcttccaaaacaccggaatggttaacaaacattaaaaaatctcataacattttttagaagagttacatcaagtttgtaagttaaaatttctcacatttggctataatttaagccagaagaaaacaatgctttaatattaagaggtaaatatttaaaactatgtactgaattttctgttttgctttaacagaaaattccaatcaggttatttgaaatacaagattctttcaacagtacaagactgtgtttataatagctaagaacagctcttctcccaaacatctctgagt

SEQ ID NO: 18039 - DNA, 601 bp, Human
gttcttccccatacagatggactctcctcttagatttctttctttccaaatatttcagacccttggctactctcagcctgcttccacaacccattttagcttttaaaacaggtaagaggccaggaggcaggggaacctgcagaaacagcaacggcagagattttgatttgaaaaccagtctccttttttttttttttgagacagggtctcattctgttgccaggctggagtgcagtggtgatcttggctcactgcaacctccaactcctgggttcaaaagattctcctgccttagcctccygagtagctgggattacaggcacgtgccaccacacctggctaatttttgtatttttagtagagatggggtttcaccgtgttggccaggatggtctcgatctcctgacctcactgaaaaaaaagaaaaccagtctcccttgctacccctacagctgtgaactgctccttctcatctgcacccctcaccgatggcttttaaaatgacactctttatactttttgagcacataatttcagggtcagtgagtcccctcatgaggactagagtactacaggtcaggcatatgtcccagcgacatca

SEQ ID NO: 18040 - DNA, 601 bp, Human
gctcaagcctggaatccaagcaccttgggagggcaaggtgggaggatcccttgaacccagctgtttgagaccagcctgagcaacagagagactctatctctacaaaaaaaaatttaaaaattagctgggcgtggtggcttgaacctgtggtcccaactacttgggaggctgaggtggggggatcgcttgagcccacgaagccaaaggctgcagtgagccatgatcataccactgcactccagccttggtggcagagtaagagcctgtctcaaaaaataaaataaaataaaaatatatttaytgttgctttaaaaagcagaaacaggctgggtgtggtggctcacacctgtaaccccagcactttgggaggccaaggtgggaagattgcttgagcctcagaggttgagaccagcccgggcaacatggtgaaaccccatctctaataaaaatacaaaaattagtgcttcctccagtccgtgcctccaatatgatgaaaaaaagaaggaacaacggtcgtaccaaaaagggccgcggccacgtgcagcctatttgcgacacgaactgtgcccaatgtgtgcccaaggacaaggctattaacaaa

SEQ ID NO: 18041 - DNA, 601 bp, Human
gagacagaagcactgacatgagtgcttctgatgataggagagaatgtggatttatgggatcactcataaactgttgcaggaagtgcagatgagcaccaacacttttgaaatgagtctggcaggatctatgaaagttgaacttttgtattccaaatacacttccactcctaagtatctatcccagagtgtccagagcaacattgtttgtaataaaaaacaaaacctggaagcatctcaagtgcctaccagcaggaggatggctacactgccatacgttttcacaatggactatgcataacartacttccccacagccacacatggcaacgtcaagaagtctctgctgagtggaaaagcaagtctcaaaagattgcacagagtatgctgctcctgtttgttttatatagtgcaaaaacaaccaaaactaaacaaaacattgtttaggcagtcatatatatgtgatcaaactactttcagaaagagcaaagggataataaacataaaattcatttttttttttttttttgagatggagtctcgctctgtcgcccaggctggagtgcagtggcgcaatctcagctcactgcaagctccgcctccc

SEQ ID NO: 18042 - DNA, 601 bp, Human
tcaagcaatcctcccacttcaccccccgagtagccgggactacaggcatgcatcaccatgcccagctaattttttatttatttacttttttgtagagactggggtcccactatgttgcccaggctggtcttgaactcaactcctggactcaagcaatcctcccaccttggcctcctaaagtgctgggattacaggcatgagccgccgtgcccagccaggtcttcattttttttgttcaatctgacgtttctgcctttttattagaatatttaacttccatttaattgctgaaattaatgtmattgttggtagttttgggtttaggtctatcttttgacattggttttcttttttcccctcaatttttttgttcctttggcagcttacacttctattttttggcaccttaagtcaatcagattgtgccaagttctggccctctcctggccccacactgcctgccttccaacctcacatgagggcagctggggggaggcaggagacctctctgtgtgatgtccctttaaagggctgatggcctccagtttctgtccactttttcaggtgctctgtagtgccttcaaatagatttttaaaaata

SEQ ID NO: 18043 - DNA, 601 bp, Human
gtggctgggaacataaccctatgtatgcttgctttcctacctgtttcactctgcactttcctgatggcaaatgacgctgaacagttttcatgtgcttactgccaacttatgtatcttttttgaaagtatatattcaagtcttttgtccattttaaaaactggtttcttaggcagttataagagctcttcatatattctcgacacaagtcctctgttgtatacatatattacaaatattttctcctagctaacggcttgctttttcagttccttctttcttccttttcttttttttttttttaattgagatggagtcttgctctgttgccaagctggagtgcagtggtgtgatcttggctccctgcaacctccacctcccaggttcaagcgattctcctgcctcagcctcccaaatagctgggactaaaggcacatgccactatgcccagctaatttttgtatttttagtagagacggggtttcactatgttggccaggatggtcttgatctcttgaactcgtgatccacccacctcagccttgcaaagtgctaggattacaggcatgagccaccgtgcctggcctgctttttcagtttctt

SEQ ID NO: 18044 - DNA, 601 bp, Human
gaaaatacaaaactctgagtcctctgcccaaaaaagacccaccagtactaacatggtcagaacactttcttaaacatttattttttgaaaaataagctcccaataacctcatattttccagaataattaacctttttaaagtcaccttctgggacttaaaaataataaatttatgctcttgatgtctttatgagttctacttcacatgaacccaattatacaaataaatcttctgttttggaaagacttgccaaagccgttgtgagatgttaggtatttcagcatttttttttttttttttgaaacggagttttgctcttgctgcccaggctggagtgcaatggcgcgatctcagctcaccgcaacctctggctcccgggttcaagcgattctcctccctgtctcccaagtatctgggattacaggcatgcgccaccaagcactactaattttgtactttttagtagagacagagtttctccatgttggtcaggctggtctcgaactcccgacctcaggtgatctggccgcctcggcctcccaaagtactgggattacagtgagccaccatgcccggcttgtttttgtttttttattgaga

SEQ ID NO: 18045 - DNA, 601 bp, Human
tttagtagagatggtgtttcaccgtgttagccaggatggtctcgatctcctgaccttgtgatctgcctgcctcagcctccccaagtgctgggattacaggtgtgagccaccgcgcccggccacaaaaaaatttaaacattagctaggtgtggtggtacacgcctgtagtcccagctactcaggagtctgagtgggaggatcacctaagcgcaggaatttgaggctacagtgagatgtgatcattccactgcactccagcctgaaagacagagcaagaccttatctctaaaaatttaaaacmaaccaaccaacccagaatttatattagaatagattttctcattttagagagatttattagagagaaggaaaagcaagcatttaacattccaccctactgtgtaggagtttcaaatctccttccctagagaggtagagggaagaccacaggacccaaacaagtgccctttcccttctgtgcggccagggaggggttcccagcaggtgggtgctgctttttccaaggcctcttctttttattgttatgcctgtatatttcaaaatctaaaaccagacgttaatgtagaaaacatttcgatac

SEQ ID NO: 18046 - DNA, 601 bp, Human
aggcacccgccaccacgcccggctaattttttgtatttttagtagagatggtgtttcaccgtgttagccaggatggtctcgatctcctgaccttgtgatctgcctgcctcagcctccccaagtgctgggattacaggtgtgagccaccgcgcccggccacaaaaaaatttaaacattagctaggtgtggtggtacacgcctgtagtcccagctactcaggagtctgagtgggaggatcacctaagcgcaggaatttgaggctacagtgagatgtgatcattccactgcactccagcctgaragacagagcaagaccttatctctaaaaatttaaaacaaaccaaccaacccagaatttatattagaatagattttctcattttagagagatttattagagagaaggaaaagcaagcatttaacattccaccctactgtgtaggagtttcaaatctccttccctagagaggtagagggaagaccacaggacccaaacaagtgccctttcccttctgtgcggccagggaggggttcccagcaggtgggtgctgctttttccaaggcctcttctttttattgttatgcctgtatatttcaaaat

SEQ ID NO: 18047 - DNA, 601 bp, Human
tctgaaagaggaagccaaagagtgttatgatacaaggaatttagcaaggcataaatgtgaatgctttcaagaaaatcacacacataagagggtacctaacactactgttaagaaattaacaagccaggcacagcggtccacacctgtaatcccagcacgacgggaggccaaggcaggaggattacttgagcccatgaatttgaagcaatacagcaagacctctacaaaaaaaaaaatttttttttttttttggagacggagtcttactgtcacccaggctggagtgcagtggcacgatctyggctcactgcaagctccacctcctgggttcatgccattctcctgcctcagcctcccgagtagctgggactacaggcacccgccaccacgcccggctaattttttgtatttttagtagagatggtgtttcaccgtgttagccaggatggtctcgatctcctgaccttgtgatctgcctgcctcagcctccccaagtgctgggattacaggtgtgagccaccgcgcccggccacaaaaaaatttaaacattagctaggtgtggtggtacacgcctgtagtcccagctactcaggagtctgag

SEQ ID NO: 18048 - DNA, 601 bp, Human
taacaactgtctttgccacagacagttatccagtcccatacttagctgctctgttatttaggaaatgaccaacttctttttcagaagcaaagtggttaatatcatctgattactttagtaagagatgtaaataaagccagtaatgtgaggatctgttgactgatccaagaaaggagacagtcaagatggaagcaagccctggccgggctgctggggagcgagacagggccctggctgtggccaggctctgctgccggcacacccctcagaacagcccgcctctgcagggcacgccttggargacgcgaccctggggcagatatggcagctgagcaataacagatcaaatgaccttggggaagaagggtcttcgttttgcaggagaatgggctggcagcgtctcgtctctggccacctcggtggggacaggagaacgcctctgaccacaaggctggagatcaccatgcctgcaggttgccatgacatatgccatctgtgggcagagctcaggtgtcatggaagccaagcccacaacagagcccctctctgcaagctcctctcagccccccagagcccaccccaaacacatgcagtggggcct

SEQ ID NO: 18049 - DNA, 601 bp, Human
aagttttaagaacctagcaaatcaatgcttgcaagggaggtgccaatgcctttaatcaaagcattgcttcctgtaattattatattccacataaaataacaactgtctttgccacagacagttatccagtcccatacttagctgctctgttatttaggaaatgaccaacttctttttcagaagcaaagtggttaatatcatctgattactttagtaagagatgtaaataaagccagtaatgtgaggatctgttgactgatccaagaaaggagacagtcaagatggaagcaagccctggccrggctgctggggagcgagacagggccctggctgtggccaggctctgctgccggcacacccctcagaacagcccgcctctgcagggcacgccttggaggacgcgaccctggggcagatatggcagctgagcaataacagatcaaatgaccttggggaagaagggtcttcgttttgcaggagaatgggctggcagcgtctcgtctctggccacctcggtggggacaggagaacgcctctgaccacaaggctggagatcaccatgcctgcaggttgccatgacatatgccatctgtgggcagag

SEQ ID NO: 18050 - DNA, 601 bp, Human
ttcttatacataagcctttgcatggatctctattccccagggtaattcctagaagtggaaccacagggttaaagggtatgaacccttgcctgatttttttttttcctttttttctctaggcatcattgtaccttactgattcttaagggtatctaaacgacttttttttattttgttgtgatctgattcagttgttggcaaaaggagatgaactctggctgctggtggaaagggtggcttgcccatgagtgggacaggccttctcacaggcaggacacatcctgggcggggacacgcttgstctttgcacccatgttcttcacctcaaggacatccacagaggcagtgacgccaggcccagcacacgatgcggggatacgccaccagctgatttaattgtgcctttttaagtaaatgcacaaatgcagagatactgctaatttcaattcaatcacatacgaatcatgctttctaacacagttcacagtttgtctctcaagcctcccaacagaccatcaagggattaaagctcacaaaacccaggaaaacaagaggtacgtatcattcattaaactaaaatccccttcccaggacgccacat

SEQ ID NO: 18051 - DNA, 601 bp, Human
ctcattaggaagactgatgtgtcaataaagatggtttcaaaacatccgaaaggacagcccccaggaggtgctttcaccacgatgggtgcccagatggccagcatccgtccctgacagagtcagtgcatgagcgccacactggcgtctgctctgggaatgggcttctgctgtgtgtgtcttctctgtggcggaactgacttgggggatgtgatgacaaagcactggggccctctgtgctcctgagggttcccgtgtggatccgcagcaggggctgaaccacgtgtcaggagggactgccccrcacaggatgcaggctggcccttgcagcatctggcttactcccagcaatgtctctgggcccagtcttgagggcgatctgctttgaatgtggactgaaagtttcctccgagtagatggaaacatggcatcaggataactgaagcagagacctgggtgtctctagggtgcttgctctgggtgattttctctcacaccctgtcggcagggctggagtcaccaaactcccacgctgacccctgctgctaagccttctccactcacacgggccacagggttggggaggaagtgcctgagctggaat

SEQ ID NO: 18052 - DNA, 601 bp, Human
gcaggctgtgggcagatggggctgcaggaccagtgcgtcctttaggtcagatggagccactcgctcaagccatctccaagagggtgcaagggctctgaagagagatagtggcctttgccttgagctggcactgctctccaaatctggatgccaagatagagggcagagcctgggaccagctgggaggtggctgcgctcgtgctaggtcctgagggtggagagacccaagctgtaggagggaaaggccgtcccaccaaagcaaccatctggccaccacctgctcgtgggccaagcagacccrgctctttccaaggtgctgtcggcagaggaactgacaaaggccaggagaggcaggggtggtgggagggatccttccccagaggccctccctgccacgcggccaccgcagcgaaggcttctcattaggaagactgatgtgtcaataaagatggtttcaaaacatccgaaaggacagcccccaggaggtgctttcaccacgatgggtgcccagatggccagcatccgtccctgacagagtcagtgcatgagcgccacactggcgtctgctctgggaatgggcttctgctgtgtgtgtcttctc

SEQ ID NO: 18053 - DNA, 601 bp, Human
aactgccttggttttcccaggactattctggttttactgcctcaggtccgacagcccaggacacccttcagaactgggccttccacctcctgaccaccactaaagggagcctcttgtcgcatgcgcactgtgtgaatggcagcgtggggacgcagagctaagagtaaacgacgtggtgtggaccatgacgttcgctctcctcggcccccgctggcagcacacagggcctgcagccggcctgcaacgagcccgccagggtcagtgcagccagcacgggggctccggctgtagcccaggcacrtgccagtgtgtccctgggcgtctgtattgctatcacttggtttttactcagaaatgacaggcacatagtgctgatggccttcggtagatgcagcctgtccttcatcaaggaaacaatgtgagcctgctgtggacccctttcagttaatataccacccagaccctgagcgggaggactgtcccccgctcaggggctggccatgcccatgctgatgggcttggccatgtctgaagaaaggccgagttgtcattacaaatccaaccttgcatcttccttacacaccaacactcctgggtgggc

SEQ ID NO: 18054 - DNA, 601 bp, Human
agcatgcagctcctttttcaaccccaacacctctgacgaagcatgtttgttatatgaaggcaaggatcatgatggcacgaagcatgttatatgaaggcaatgaccatgagcacgaagcatgttatatgaaggcaatgaccatgatggcagctgccaccaaaatactttaccagcacacccttctgactgcagcatttctcagaagaaaggctcaggtgaaaagttcctggaattttccagatcttcagtggatctattagcattgccacataccaaaataaggaatttccctaaaggttarcttctaatccagcaaaactttgctcatacctcaaaacggagccaagactcagactaatacacacaaatcaaaatggacaaaagcaagtcttgactcacttgacaaacagaatagacacaaaagaatgtacaaccaatacaattccagaatgtccctgaaaggaaaaagcaccctgtactgacatgaaataaatgttaaccttgagattacactaacaatgcctttttttaagagatggtctcgctctgttgcccaggctggagtgcagtgtcatgatctcggctcactacaactcccacc

SEQ ID NO: 18055 - DNA, 601 bp, Human
cctgtctcagcctccctagtagctgggactacaggtgcatgccacagtggctggctaatttttgtatttttagtagagacagggtttcaccattttggtcaggctggtcttgaactcatgacctccggtgattcccccgcctcggcttcccaaagtgctgggattacagacatgagccaccacacccagccttattcgtatacacatttaattctgagaagcactctatagaaaataagaataagaaaatattgggctcacaggtgacattaataagtaactttatcgagtaccccaaatkttacctatgtttggaagatggggttaaaaaggacacattgaaaacaagaaactcattgtggcttttttttcctcctttttgaacagttttctatttctggaatgttgtcaattatatctgaaaggagaaatgcaacatatctggtgagttgcccgtttctgtctttgtccatccttgaaaagataagaagaacagagttttaagagtcttaagggaaacacatctttgtctcctatattacttgtgaatgtggatatatgattttgtttcaatctattttgtgtcctaaggctttttgca

SEQ ID NO: 18056 - DNA, 601 bp, Human
cacagttgccagaaattttttgagaccaagtgctttatggcttccttttccactgtatgtatttttttttgtgtgggaagactaagattctgggtcctaatgtaagtaagaagccctcttctcctgttccatgaacaccatccttttctgtaacttctattacacagtatagtggttctgtaagttcacacagcccagggagatgctggctgcccactcccctcaacccaggcaaattcctcggggttaaagttatctactgcaagtgacgatctctgggtttttctgtgcctgtgtttgggtgtgtgtgtgtgtgtgtgtgtgtgtgtgtgtatgtgtcactttaaaaggactggtcagatggtagggagatgaaaacaggagatgctataagaaaataaacttttggggcgaataccatgtgactctttttgtttgtcatttgttgctgttcaataggaaattgtagtgatgatgctgtttctcaccattctgggacttggtagtgctgtgtcactcacaatctgtggagctggggaagaactcaaaggaaacaaggtagatagaagcccgatataaaatcttgaatgacaggttaacg

SEQ ID NO: 18057 - DNA, 601 bp, Human
tgaagtcaggagttcaaaaccagcctggccaaatggcaaaaccaaatcttcaattaaaaccaaatcttaaaccaaatctctactaaaaaatacaacaaaacaaaacaacaacaacaaaaacagaaaaggaaacattagcccagcgtggtggcaggtacctgaggttccagatacttgggaggctgaagcaggagaatcgcttgagcccaagagatggaggttgcagtgagccgagatcatgccactgcaccacagccagggtgacagagccatacttcccagcacattgggaggccaaagmtgaagaataatttgaggtgaggatttggagaccagcctggccaacatggtgaaactccgtctgtactaaaaatataaaacttagtggggcatgggggcacacacctgtaatttcagctacttaggaggctgaggcaggagaattgcttgaacccgggaggcggaagttgcagtgagccaagatcgtggccactgcactccagcctgggtgacatagtgagattctgtctcaaaaaaaataaaagaaatttaaaaaatcactctcttccaaagatagataaataagacagcagatatacta

SEQ ID NO: 18058 - DNA, 601 bp, Human
aataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggctgaggcaggagaatcgcttsaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagctcatttttaggctttgattttggggagacaaagggaaatgcagccatagagggcctgatgacatccaatacagagttctggtaaagataaaatttgatacaggtttggtgtcattataagagaaatcattattaaatga

SEQ ID NO: 18059 - DNA, 601 bp, Human
taggattctctttggacagcgtccatactggtgggttttggatactgactactacagcaacacttccgtgcccctgataaagcagttccctgtaacctgtgagactggaccaggtaagcgtcccagcccctgcagacagaagctgagtggacctcgtttacctgttatggatgaaactgaccttgaggggacatgaggagagccattcctttgtacttttgtcatgctcttcaattggcacaaattaattcacttctgcaatactttcctgaatagcacagtagtattggaaatctgcctrttacagaacctggatggagtccagagaggcacgggcatccatgggcaaagggctcgtgagagtcaccgccctgcagcgctgtgtcctgagaaaggagggggcagaagcctgagcttctgggggtccttcccaatggcctggcccactggatgtgccctcctgagctgaccgtccaatcccttgccctctctgtgcctacgttttattagttacagccagatggttactgtcaaatcaaatgatagatttcattttcagtatgtaataggaagcccctccctcaccctaaagtctcagctg

SEQ ID NO: 18060 - DNA, 601 bp, Human
ttgccacaggcattttttttttttttttgagacggaatctcgctctgttgcccaggctggagtgcagtggcgccatctcgcctcactgcaacctccgcttcctgggttcaagctattcttctgcctcagcctaccgagtagctgggactacaggcacgtgccaccacacctggctaatttttttatttttagtagagatggggtttcaccatattggccaggctggtcttgaactcctgacctagtgatccatccgcctcagcctcccaaagtgctgggattgcaggcatgagccaccgcrcctggccttttttttttttttttgagacggagttttgctcttgttgcccaggctagagtgcagtggcgcagtctcggctcactgtaacctccacctcctgagttcaagcaattctcctgcctcagcctctcaaatagctgggattacaggcgtgagccaccccacctggctaattttgtaattttttttttagtagagatggggtttcacctgttgatcaggctggtctcaaactcctgacctcaagtgatccacccacctcggcctcccaaagtgctgggattacaagcataagccacc

SEQ ID NO: 18061 - DNA, 601 bp, Human
caacaggccctaatttacttttcagggaatctgccaaatttaacaaattaacacgatgtcctaggaaagctgttcatttaaatacattcatttgcaaacctaatagataactgcagttgatctcttttataggttcagagttttgaatatgtttttttttgttttttttttttgagatggagtctcgctctgtgacccaggctagagtgcagtggtgcgatctcggctcactgcaagctccacctcctgggttcacgccattctcctgcctcagcctctccgagtagctgggactacaggmgcccgccaccatgcccggctaattttttgtatttttagcagagacggggtttcaccgtggtcttgatctcctgacctcgtgatccgcccgcctcggcctcccaaagcgctgggattacaagggtgagccaccgcaccctgcctgaatatgtgttttcttagatccaattaacaagggtaagacaagatttaagttaagcataagaaagattttgtgggaggcactggaatataagaccttaacaaaactgtggaatttctcccctggagatttgtaagaacggaacatagcagcattcaa

SEQ ID NO: 18062 - DNA, 601 bp, Human
gcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgttyaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattt

SEQ ID NO: 18063 - DNA, 601 bp, Human
ctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccataccacagcgtcccgcgtagctgggactacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggc

SEQ ID NO: 18064 - DNA, 601 bp, Human
cactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccmtaccacagcgtcccgcgtagctgggactacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtc

SEQ ID NO: 18065 - DNA, 601 bp, Human
aggttctcctcgtccgcccgttgttcagcgagggaggctctgcgcgtgccgcagctgacggggaaactgaggcacggagcgggtgagacacctgacgtctgccccgcgctgccggcggtaacatcccagaagcgggtttgaacgtgcctagccgtgcccccagcctcttcccctgagcggagcttgagccccagacctctagtcctcccggtctttatctgagttcagcttagagatgaacggggagccgccctcctgtgctgggcttggggctggaggctgcatcttcccgtttctaggstttcctttccccttttgatcgacgcagtgctcagtcctggccgggacccgagccacctctcctgctcctgcaggacgcacatggctgggtctgaatatctggggtgaggagcaccgtggcctgagagggggcccctgggccagctctgaaatctgaatgtctcaatcacaaagacccccttaggccaggccaggggtgactgtctctggtctttgtccctggttgctggcacatagcacccgaaacccttggaaaccgagtgatgagagagccttttgctcatgaggtgactgatgaccg

SEQ ID NO: 18066 - DNA, 601 bp, Human
tctgccccgcgctgccggcggtaacatcccagaagcgggtttgaacgtgcctagccgtgcccccagcctcttcccctgagcggagcttgagccccagacctctagtcctcccggtctttatctgagttcagcttagagatgaacggggagccgccctcctgtgctgggcttggggctggaggctgcatcttcccgtttctaggctttcctttccccttttgatcgacgcagtgctcagtcctggccgggacccgagccacctctcctgctcctgcaggacgcacatggctgggtctgaatmtctggggtgaggagcaccgtggcctgagagggggcccctgggccagctctgaaatctgaatgtctcaatcacaaagacccccttaggccaggccaggggtgactgtctctggtctttgtccctggttgctggcacatagcacccgaaacccttggaaaccgagtgatgagagagccttttgctcatgaggtgactgatgaccggggacaccaggtggcttcaggatggaagcagatggccagaaagaccaaggcctgatgacgggttgggatggaaaaggggtgaggggctggagattga

SEQ ID NO: 18067 - DNA, 601 bp, Human
ctgccccgcgctgccggcggtaacatcccagaagcgggtttgaacgtgcctagccgtgcccccagcctcttcccctgagcggagcttgagccccagacctctagtcctcccggtctttatctgagttcagcttagagatgaacggggagccgccctcctgtgctgggcttggggctggaggctgcatcttcccgtttctaggctttcctttccccttttgatcgacgcagtgctcagtcctggccgggacccgagccacctctcctgctcctgcaggacgcacatggctgggtctgaatayctggggtgaggagcaccgtggcctgagagggggcccctgggccagctctgaaatctgaatgtctcaatcacaaagacccccttaggccaggccaggggtgactgtctctggtctttgtccctggttgctggcacatagcacccgaaacccttggaaaccgagtgatgagagagccttttgctcatgaggtgactgatgaccggggacaccaggtggcttcaggatggaagcagatggccagaaagaccaaggcctgatgacgggttgggatggaaaaggggtgaggggctggagattgag

SEQ ID NO: 18068 - DNA, 601 bp, Human
tgagttttatcctttgtaataaaccagcaactgtaagaaacgcactttcctgagttctgtgaccctgaagagggagtcctgggaacctctgaatttatacctagttgatcgaaagtacaagtgacaacctgggatttgccattggcctctgaagtgaaggcagtgttgtgggactgagcccttaacctgtggagtctgtgctgactccaggtagtgtcaagattgaattgaattgtaggacacccagccgtgtccagaaagttgcagaattgatgggtgtgagaaaaaccctacacatttratgtcagaagtgtgggtaaaatgtttcaccctccagcccagagagccctaatttaccagtggcccacggtggaacaccacgtccggccgggggcagagcgttcccagccaagccttctgtaacatgacatgacaggtcagactccctcgggccctgagttcacttcttcctggtatgtgaccagctcccagtaccagagaaggtcgcacagtcctctgctccaaggagcttcactggccaggggctgctttctgaaatccttgcctgcctctgctccaaggcccgttcctcagagacgca

SEQ ID NO: 18069 - DNA, 601 bp, Human
ctctgaatttatacctagttgatcgaaagtacaagtgacaacctgggatttgccattggcctctgaagtgaaggcagtgttgtgggactgagcccttaacctgtggagtctgtgctgactccaggtagtgtcaagattgaattgaattgtaggacacccagccgtgtccagaaagttgcagaattgatgggtgtgagaaaaaccctacacatttgatgtcagaagtgtgggtaaaatgtttcaccctccagcccagagagccctaatttaccagtggcccacggtggaacaccacgtccgkccgggggcagagcgttcccagccaagccttctgtaacatgacatgacaggtcagactccctcgggccctgagttcacttcttcctggtatgtgaccagctcccagtaccagagaaggtcgcacagtcctctgctccaaggagcttcactggccaggggctgctttctgaaatccttgcctgcctctgctccaaggcccgttcctcagagacgcagacccctctgatggctgactttggtttgaggacctctctgcatccctcccccatggccttgctcctaggacaccttcttcctcctt

SEQ ID NO: 18070 - DNA, 601 bp, Human
tccaggtagtgtcaagattgaattgaattgtaggacacccagccgtgtccagaaagttgcagaattgatgggtgtgagaaaaaccctacacatttgatgtcagaagtgtgggtaaaatgtttcaccctccagcccagagagccctaatttaccagtggcccacggtggaacaccacgtccggccgggggcagagcgttcccagccaagccttctgtaacatgacatgacaggtcagactccctcgggccctgagttcacttcttcctggtatgtgaccagctcccagtaccagagaaggtygcacagtcctctgctccaaggagcttcactggccaggggctgctttctgaaatccttgcctgcctctgctccaaggcccgttcctcagagacgcagacccctctgatggctgactttggtttgaggacctctctgcatccctcccccatggccttgctcctaggacaccttcttcctcctttccctggggtcagacttgcctaggtgcggtggctctcccagccttccccacgccctccccatggtgtattacacacaccaaagggactcccctattgaaatccatgcatattgaatcgc

SEQ ID NO: 18071 - DNA, 601 bp, Human
gcagaattgatgggtgtgagaaaaaccctacacatttgatgtcagaagtgtgggtaaaatgtttcaccctccagcccagagagccctaatttaccagtggcccacggtggaacaccacgtccggccgggggcagagcgttcccagccaagccttctgtaacatgacatgacaggtcagactccctcgggccctgagttcacttcttcctggtatgtgaccagctcccagtaccagagaaggtcgcacagtcctctgctccaaggagcttcactggccaggggctgctttctgaaatccttscctgcctctgctccaaggcccgttcctcagagacgcagacccctctgatggctgactttggtttgaggacctctctgcatccctcccccatggccttgctcctaggacaccttcttcctcctttccctggggtcagacttgcctaggtgcggtggctctcccagccttccccacgccctccccatggtgtattacacacaccaaagggactcccctattgaaatccatgcatattgaatcgcatgtgggttccggctgctcctgggaggagccaggctaatagaatgtttgccataaaat

SEQ ID NO: 18072 - DNA, 601 bp, Human
acttcacggtgggcagggcaggggcgggggcggcggccagggcagagggtgcgcgtggacatcgacacccacgcacctcacaagggtggggtgcatgttgcaccactgtgtgctgggcccttgctgggagcggaggtgtgagcagacaatggcagcgcccctcggggagcagtggggacaccacggtgacaggtactccagaaggcagggctcggggctcattcatctttatgaaaaggtgggtcaggtagagtagggctgccagaggttgcgaatgaaaacaggatgcccagtaaacccraattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggggtgcgggttgttctctggagagtaagggggctgtggggaacat

SEQ ID NO: 18073 - DNA, 601 bp, Human
aagggtggggtgcatgttgcaccactgtgtgctgggcccttgctgggagcggaggtgtgagcagacaatggcagcgcccctcggggagcagtggggacaccacggtgacaggtactccagaaggcagggctcggggctcattcatctttatgaaaaggtgggtcaggtagagtagggctgccagaggttgcgaatgaaaacaggatgcccagtaaacccgaattgcagataccccaggcatgactttgtttttttgtgtaaggatgcaaaatttgggatgtatttatactagaaaagctgsttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggggtgcgggttgttctctggagagtaagggggctgtggggaacatcaataaacccccatctcttgtagatcaaagatccagctaacaggcgctacgaggtgcccttggagaccccgcgtgtccaca

SEQ ID NO: 18074 - DNA, 601 bp, Human
tggggtgcatgttgcaccactgtgtgctgggcccttgctgggagcggaggtgtgagcagacaatggcagcgcccctcggggagcagtggggacaccacggtgacaggtactccagaaggcagggctcggggctcattcatctttatgaaaaggtgggtcaggtagagtagggctgccagaggttgcgaatgaaaacaggatgcccagtaaacccgaattgcagataccccaggcatgactttgtttttttgtgtaaggatgcaaaatttgggatgtatttatactagaaaagctgcttgtygtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggggtgcgggttgttctctggagagtaagggggctgtggggaacatcaataaacccccatctcttgtagatcaaagatccagctaacaggcgctacgaggtgcccttggagaccccgcgtgtccacagccgg

SEQ ID NO: 18075 - DNA, 601 bp, Human
gctgccagaggttgcgaatgaaaacaggatgcccagtaaacccgaattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggsgtgcgggttgttctctggagagtaagggggctgtggggaacatcaataaacccccatctcttgtagatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgtgagttctgggctctgtgccagcatgatggggagggcgacgcgcatttctcacacggcagggagggccacacgcgtttgtttctcac

SEQ ID NO: 18076 - DNA, 601 bp, Human
atgcccagtaaacccgaattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggggtgcgggttgttctctggagagtaaggkggctgtggggaacatcaataaacccccatctcttgtagatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgtgagttctgggctctgtgccagcatgatggggagggcgacgcgcatttctcacacggcagggagggccacacgcgtttgtttctcacacgatgggcagggcgacacatgtttgtt

SEQ ID NO: 18077 - DNA, 601 bp, Human
atgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggggtgcgggttgttctctggagagtaagggggctgtggggaacatcaataaacccccatctcttstagatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcgtttctca

SEQ ID NO: 18078 - DNA, 601 bp, Human
aaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggggtgcgggttgttctctggagagtaagggggctgtggggaacatcaataaacccccatctcttgtagatcaaagatccagctaacaggcgctacgaggtgcccttggagaccccgcrtgtccacagccgggcaccgtccccactctacagcgtggagttctccgaggagcccttcggggtgatcgtgcaccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcgtttctcacagggcgctccctgggtcttttactcacataggtctaaatcccatgtaaacac

SEQ ID NO: 18079 - DNA, 601 bp, Human
gcgtcctcctcctggctctgcagatgagggagccgaggctcagagaggctgaatgtgctgcccatggtcccacatccatgtgtggctgcaccaggacctgacctgtccttggggtgcgggttgttctctggagagtaagggggctgtggggaacatcaataaacccccatctcttgtagatcaaagatccagctaacaggcgctacgaggtgcccttggagaccccgcgtgtccacagccgggcaccgtccccactctacagcgtggagttctccgaggagcccttcggggtgatcgtgcrccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcgtttctcacagggcgctccctgggtcttttactcacataggtctaaatcccatgtaaacacgtgttcaggactcaccaagcccctgcttgtcatttaactcaggaaaactctcaggaacgacagcacttggat

SEQ ID NO: 18080 - DNA, 601 bp, Human
atctcttgtagatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcrtttctcacagggcgctccctgggtcttttactcacataggtctaaatcccatgtaaacacgtgttcaggactcaccaagcccctgcttgtcatttaactcaggaaaactctcaggaacgacagcacttggatttgccttaatcttaagagaagttgccttcggaaatgcgtttttctttttttgctcattcatttactcagtgtccacgcactgaccctccgtgccgggtggtttggatcctgctcccggggacagacacacagtgaggggaagccataagcaagtccatgcagacacag

SEQ ID NO: 18081 - DNA, 601 bp, Human
tgtgggtagggcctgctccctggccgcggcccccgccccaaggctccctcctccctccctcatgaagtcggcgttggcctgcaggatacccgttcatgccgccatactggggcctgggcttccacctgtgccgctggggctactcctccaccgctatcacccgccaggtggtggagaacatgaccagggcccacttccccctggtgagttggggtggtggcaggggaggcaaggggctggccgggacgcgtctcctcaggccccagcagacggtcccgtgttgtggctgcaggacgtccartggaacgacctggactacatggactcccggagggacttcacgttcaacaaggatggcttccgggacttcccggccatggtgcaggagctgcaccagggcggccggcgctacatgatgatcgtggtgtgtgcccccacactgtgggtctttgggaagggggccgcccggtgcccagtggctccttctctgtgcagcgtcatcctcgtgcctgtgtggtcgccgaggatgttttctgagggtctttgtgatatcgagggaatatcaagaagtttgcaggcttggccccagctgtccagggag

SEQ ID NO: 18082 - DNA, 601 bp, Human
tcaggccccagcagacggtcccgtgttgtggctgcaggacgtccagtggaacgacctggactacatggactcccggagggacttcacgttcaacaaggatggcttccgggacttcccggccatggtgcaggagctgcaccagggcggccggcgctacatgatgatcgtggtgtgtgcccccacactgtgggtctttgggaagggggccgcccggtgcccagtggctccttctctgtgcagcgtcatcctcgtgcctgtgtggtcgccgaggatgttttctgagggtctttgtgatatcgarggaatatcaagaagtttgcaggcttggccccagctgtccagggaggtcgggtttgagggtccccagaaatggccgggtgctactcagggttctgtcagatgtaggttacttgaactgccttaaagcaaaaggccaggggcatgataaactgatgtcacctggtcctggaaagtggagggcccggtgggcctgggcatgggtatcgctggaactgtggaggctccgtgtgccttctggccgtgcctctccttctggccggctctgaatccctggaaaggacggcgtgagtgagggcagctt

SEQ ID NO: 18083 - DNA, 601 bp, Human
tcccacagccagaaggatgcagtttgggggctggtccagcccgagtctggtgtccggcacgatggccagaggaggaggtgggaggcagggcgagctgaaaagatccaacagttcctgcccggaagatccacttcagcagaggaagcacagatgagatgtggggctgtgctgatgctgcctgtttccatccctgccttctgcaggcagcaaacagtagtagcccttaagagcaggagtggaaacacagacttttttctttctcacatttttttaattataaaagaaaagtgattactgtagracacttgggaaactctagaggtttaaagaaaaggtaaaggtaaagcttccattccggcgcgcccctcatcagccagctggtcctgactcgcccggccctggctcctctccaggcaggcgtgtgcaggcatgtgcaggtacacaggcaggcatgctgtacacacgcatgatgtcatccccagcctcatcctctcactgtctcagttttccccgtggctggcgccagggctctgggccaccctcaccttgacgggtttccctcttcccaggatcctgccatcagcagctcgggccctgccgg

SEQ ID NO: 18084 - DNA, 601 bp, Human
gtggctcctacaaggaatggccccgtgagttcttccatcagcaggcctttgacttcatgggcagctgggcctggcccaggcacaagccctgcagaccctcagtgaggccttagggtcctccttgtcctcccagccccccaggggcctccaggcagggcccccgctgagggagcagctagggagggtctggtgcggatgtgaggctgcctggcagggcttgcacggggccgtctccgctgcccttctccctgacgctctctggttctgcagcccagcccctgggtggacgtgttgggggtgrcccctcgttttcccagggttgaggccccttggccccgcatcagtgccttgtggagaaagagctgctcattgacctccagggtgcaggtctctcagatttgcaaatgtgggcgtccactaagagtgaggctgcccctctgctcaggctgaggctcagtggggcttccatgcaggccctgggtggggccgggtctccccactccagcctctcgttgtccaggtatggcccgggtccactgccttccccgacttcaccaaccccacagccctggcctggtgggaggacatggtggctgagttc

SEQ ID NO: 18085 - DNA, 601 bp, Human
gggtcctccttgtcctcccagccccccaggggcctccaggcagggcccccgctgagggagcagctagggagggtctggtgcggatgtgaggctgcctggcagggcttgcacggggccgtctccgctgcccttctccctgacgctctctggttctgcagcccagcccctgggtggacgtgttgggggtgacccctcgttttcccagggttgaggccccttggccccgcatcagtgccttgtggagaaagagctgctcattgacctccagggtgcaggtctctcagatttgcaaatgtgggcrtccactaagagtgaggctgcccctctgctcaggctgaggctcagtggggcttccatgcaggccctgggtggggccgggtctccccactccagcctctcgttgtccaggtatggcccgggtccactgccttccccgacttcaccaaccccacagccctggcctggtgggaggacatggtggctgagttccatgaccaggtgcccttcgacggcatgtggattgtaagtgtggccccctcctgagcatccccaaggcctctggggactaccacaccctcctcactctgggcagagtcaccta

SEQ ID NO: 18086 - DNA, 601 bp, Human
ggctgcctggcagggcttgcacggggccgtctccgctgcccttctccctgacgctctctggttctgcagcccagcccctgggtggacgtgttgggggtgacccctcgttttcccagggttgaggccccttggccccgcatcagtgccttgtggagaaagagctgctcattgacctccagggtgcaggtctctcagatttgcaaatgtgggcgtccactaagagtgaggctgcccctctgctcaggctgaggctcagtggggcttccatgcaggccctgggtggggccgggtctccccactscagcctctcgttgtccaggtatggcccgggtccactgccttccccgacttcaccaaccccacagccctggcctggtgggaggacatggtggctgagttccatgaccaggtgcccttcgacggcatgtggattgtaagtgtggccccctcctgagcatccccaaggcctctggggactaccacaccctcctcactctgggcagagtcacctaccagcagcgcttctcttgcaggacatgaacgagccttccaacttcatcagaggctctgaggacggctgccccaacaatgagctggagaa

SEQ ID NO: 18087 - DNA, 601 bp, Human
taagtgtggccccctcctgagcatccccaaggcctctggggactaccacaccctcctcactctgggcagagtcacctaccagcagcgcttctcttgcaggacatgaacgagccttccaacttcatcagaggctctgaggacggctgccccaacaatgagctggagaacccaccctacgtgcctggtcagctcgccccccacctaccctggggacttaatcaaatcagagactcccttgtctggcctgggagacttagcaccctcatctctgagaagcagatgggccagcggggaaaggggygggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctagccagggagcagggtgggctcagaggcaggaattaccaagaagaagcatgggggt

SEQ ID NO: 18088 - DNA, 601 bp, Human
ccccctcctgagcatccccaaggcctctggggactaccacaccctcctcactctgggcagagtcacctaccagcagcgcttctcttgcaggacatgaacgagccttccaacttcatcagaggctctgaggacggctgccccaacaatgagctggagaacccaccctacgtgcctggtcagctcgccccccacctaccctggggacttaatcaaatcagagactcccttgtctggcctgggagacttagcaccctcatctctgagaagcagatgggccagcggggaaaggggtgggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctagccagggagcagggtgggctcagaggcaggaattaccaagaagaagcatgggggtcagggggat

SEQ ID NO: 18089 - DNA, 601 bp, Human
gaagcagatgggccagcggggaaaggggtgggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctagccagggagcagggtgggctcagaggyaggaattaccaagaagaagcatgggggtcagggggattctggctgaactgacccagcaggattcttgctgaaggcaggccagggtgaccagacatcgcctgaggggtggtggaggttggggcttctcgccaaactgtcttagcaggaatggcagaaactgggttttacaaggaagtacaaggatgggcctgggagaaggtttgggggcctgaggctatagtttggcccagcaaagaatcagtgagaggatggggttttgggcttaggtaaacaggcaggggagtgcttgaaatgggccaa

SEQ ID NO: 18090 - DNA, 601 bp, Human
aagcagatgggccagcggggaaaggggtgggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctagccagggagcagggtgggctcagaggcrggaattaccaagaagaagcatgggggtcagggggattctggctgaactgacccagcaggattcttgctgaaggcaggccagggtgaccagacatcgcctgaggggtggtggaggttggggcttctcgccaaactgtcttagcaggaatggcagaaactgggttttacaaggaagtacaaggatgggcctgggagaaggtttgggggcctgaggctatagtttggcccagcaaagaatcagtgagaggatggggttttgggcttaggtaaacaggcaggggagtgcttgaaatgggccaag

SEQ ID NO: 18091 - DNA, 601 bp, Human
gcggggaaaggggtgggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctagccagggagcagggtgggctcagaggcaggaattaccaagargaagcatgggggtcagggggattctggctgaactgacccagcaggattcttgctgaaggcaggccagggtgaccagacatcgcctgaggggtggtggaggttggggcttctcgccaaactgtcttagcaggaatggcagaaactgggttttacaaggaagtacaaggatgggcctgggagaaggtttgggggcctgaggctatagtttggcccagcaaagaatcagtgagaggatggggttttgggcttaggtaaacaggcaggggagtgcttgaaatgggccaagagacggtggatgtg

SEQ ID NO: 18092 - DNA, 601 bp, Human
tttgggggcctgaggctatagtttggcccagcaaagaatcagtgagaggatggggttttgggcttaggtaaacaggcaggggagtgcttgaaatgggccaagagacggtggatgtgaagtctgggggtctgcagagcccaggctccagcacccgcccagccctgtcttagaagcagtggagatggttacccaggttcccgggtaacgccagccccacagaggcgtggggagcggctgcaggtgcacctccagggccagcctgaagaggcagcgacctgcacaggggctcctgggaggtggrgggcagggagggcaccttggagcctgccgggaggaagctccctggaaaccagcccccgcctcttccaggggtggttggggggaccctccaggcggccaccatctgtgcctccagccaccagtttctctccacacactacaacctgcacaacctctacggcctgaccgaagccatcgcctcccacaggtgagggccacgtcccgccccactgggctctgccctcacagcctgtcctacaaggttggggcctctgcagggcctcagggaggaggaaaagcggaggcccagaccacccggggc

SEQ ID NO: 18093 - DNA, 601 bp, Human
agagccgggggcctctatgggaggcttgccggggccccccacccacttagcaggtggggctctgggtcacttggcctgagctggctctgctgcagcagcctgaggaccagcctgactctgccctcccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctggtagggtgggggtggcggcrtggcaggtgggcgatcccacccacccaagactctcccctgggaatcccacccctgctggagaagcaccccatgctgggtggctgagaagtgcagctctcccgaggcggggactccaggggaccgcggccccagcacccaagtgcttcctttgcccccgcctgccctgcagccccaggagccgtacagcttcagcgagccggcccagcaggccatgaggaaggccctcaccctgcgctacgcactcctcccccacctctacacactgttccaccaggcccacgtcgcgggggagaccgtgg

SEQ ID NO: 18094 - DNA, 601 bp, Human
atggtggaggttctgccgggcccggcctcgggcagccgtgggatagcacttgaggtggggaaggtcttgggtcatcaccacggggttccagcccctgcggccgcaggtgttcctgcagatcctagttactggcagcctggtgctgtaccagcctagcattcccgggccctggaggcctccacctccaccagggtggggatgatgacatcacgtgtccttccctttccagggccctggcctcacaaccacagagtcccgccagcagcccatggccctggctgtggccctgaccaagggtggrgaggcccgaggggagctgttctgggacgatggagagagcctggaagtgctggagcgaggggcctacacacaggtcatcttcctggccaggaatgtgagtcctggggctgctcaggctggtgggcaggggccggctcggggttgagaaggggtgaggggacctgggcttgggggtcccacgatggctacctgccactaggacactctagcaggtggcctggggtcctagagtgagcagtggggccgtgcactctgccctttcgtgtacacagagggaggtcacctccctgatgccatcatg

SEQ ID NO: 18095 - DNA, 601 bp, Human
actaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctkcccggctgcccagagggctggatgcctgccggtccccgagcaagcctgggaactcaggaaaattcacaggacttgggagattctaaatcttaagtgcaattatttttaataaaaggggcatttggaatcagcttctgcgggtctctctgggattcagggcagggaggatgtatccaggggccctggaacagaggcagctcctttgtcctcagcaggcccccagacattcccacagtgggtgtgcgccgtcctctgtctcaagccggcatccatcacgtcatgttcccatgtcacgaggcc

SEQ ID NO: 18096 - DNA, 601 bp, Human
gtaccataccgctttccctctctgacatgaagattaaatgacagcactctaaacacttactggcacaacctgggctaggaaccaaggactccacaaagaagtttaaagtggtatgcaaatataatgttgcaagaattttcattatttagtgagttcctatgaggagtaatgaactatatagggatactaataattgtatattctatcagattaggtaggagtttcctactttgaattacgaaatgattcttctcatcttagtaattttaaactgggcttaataaacctaatggaaacaaakacttccatttttcggtaagctcttaccctagatatagtatcacaagtaaagctataaaaaagatggggcctcactccatgaaatattggctgtttcaggtttagcccaaaaacataaaaaggagaatagtagtagcaaagaataaatgcattaactcatcggcccacaggtttcccctgaaatacacatcagcacggctggagagattgcaaattagggaatgaaaacataaaaatcaaaaaggatcagctaactccagggggaaaaaaatttcccctagcagaaggttatatcttgtgg

SEQ ID NO: 18097 - DNA, 601 bp, Human
aactgacccataatctatcctttgggaggcaatataagcaaaaaataaataaaaagaggccggtttttggcatgaaacagtagcctcaggcttgtaaaccagacagtcctaggttcaaactgctgacactttgccaggtgtatgtatgatggttgggacaaaatacttttatggggttcaactttctattttatattctcatatatgctaccactgacattctggtaagtgcccatatctactctgtcacacccaaaacatccccagtccctaccagtgaggcaaacacccatggagctgstctctagccactctttccatctacctcaatatatcccaaaccaaacatagcacttttgcatgtatctgctccttttcctgaacttgctgtctcagtaaccaacacttgccgaaaccataaacttgggccaccttttgtccaaacttcccatgtaccctcagtcaccaagatatcctcaatagctctcaaatccctcctctactcttcaaccccactgacttacccaggccctcctcacttatgagaacagtataagtggtctcaggacatcccttctgcctctccctgtattctatcttc

SEQ ID NO: 18098 - DNA, 601 bp, Human
ttggtattgtttacacatattctgaaatcacagtccatatgctgaggtatagattaaaatgttgatgggagaaatcctatctcccaaattctcctacctgttgtctgcccatcaccacctatttccacttttaaaatatgcaaagaggcaccaaaattcggctgtgaaaagaagtaacagtattaacatagtgttgtattgtatgaagcttcaagacaattactaattactgccttaggttttacagacgcaaaaacaaaagcaaaacttcaaatagcaatttattccaaaagtaatgtgycattttttcaaaaactagaattgtgaggctaataaattctatggtgaaattcaccatccaatttctaaaatatcacaggtaccatgaaataattatgttttcattaccttaaagagataatccaatatctgagaacgatagggctctgggtaatttactagaagtcgggaggttgcctaaaaaaaaaagttttcaaaagtatgaataaaagaaatccagtcatgaatatctgtctacagtgttcacgcacaccacctggtatacacatatttagcctcaggcaaggtcaggctgaggaaa

SEQ ID NO: 18099 - DNA, 601 bp, Human
ggtggcgggtgcctgtaatcccagctacttgaggcaggagaatcacttgaacccaggaggcagaggttgcagtgagccaagatcacaacactgcactccaatccgggtgacagtgtaaaaaaaaaaggaaagttctcaaatataaactaatttttcagtcataatttggaaaaggatagcaaaaactagtatattctttcttctgacttcctccagcccttggctcatcctcatgccctgtatcatcatgtagtattacagtttatatgttccagcatctacttctcttactgaacacaasagcttattaatcttagtagccctcaaatattacagtcacagttcctgcaacacagtaggaactcaataattgtttgctgataatctaagtcatgattgcatgaaaatgtttaagtattagttttaactgatggtatattaataagcaaatgattatggagacccactatgtgtgtgttaaggccctgtggggtacgatgcagcctggggcatgcctccacccagccaagagacaagctggacatgatatcatttttcatacttttcaaatccttaaaaggtgttaactaacagtttgtga

SEQ ID NO: 18100 - DNA, 601 bp, Human
agctccaattaaatccatggtatacttttcaacagacagtttcttaaaatagatatattataggattttagaaaacggggtgaaaattagaggtggcagtctaagttcatctttcaaactggatcagttgagttctaggacaccctagaagtctacagcatgaacagatcctttgtagcaaaccgagaccaactctcaagattcagtaggattgagaacccctatccctctagcaggaggatcaatcctgaatttcatcaccctgaagttcttccttttctttgagacggagtttcgctcytgttgcccaggctggggtgtaatggcatgatatcggctcactgcaacctctgcctcccaggatcagcaattctcctgcctcagcctctcgagtagctgggattacaggcatgtggcaccatgcctggctaattttatatttttagtagagacagggtttctccatgttggtcaggctgatctcgaactcctgacctcaggtggtccgccactttggcttcccaaagtgctgggattacaggcgtgagccactccacccggcctctttattcttacagagaagaggaagagcaacttagtc

SEQ ID NO: 18101 - DNA, 601 bp, Human
ccatagaaatatgggggggggggaatgaaacaaaaataatcaaatggtactaccctgaaataaccaccattattttgctatgcattcttccaggaagtctcctatgcagacacaataatcaaatgggtaacatactaatcataccatttggcaaaatgctttaacttatcattttaagtattttccacggtcttcaaatattctgccattattaaacaggagagcaaataaaatttacctgtaggactgtccacccacaaaaattaaaagtaacaagctaaattttaacaggaaataaacraagcacaaacagtacctactttactactcagtactatgcttgggccccatgaggactctaaaagaagtatcagagggagccctcacccttaggtggcaaacacactcaacaggacaccaaaactaacagggcatactagaaaatcaaagggcaagtacataccaaaatgtatggattgcctatatgtaaatcaagagcagagaaaaggagacatcattttactcaggatcaggaagatcagatttcataccacaagcagttcttgatgaatggatacaaataagcccactactatagccc

SEQ ID NO: 18102 - DNA, 601 bp, Human
agctgggattacaggcacgcgccaccacgcctggctaatttttgtattttttagcagagacagggtttcgccatattggccaggctggtcttgaactcctgacctcatggatgataatttcaatactatattttctcaatagaaacatccctcctatggaaaataaaagcattacctttaagataacctacttcactaggaatgtaaaaagaaaaaaaaaacacaaggggtaaaatgttttagaggattttcactttgactttaaaattacgtttaaccatagaaatatgggggggggggwatgaaacaaaaataatcaaatggtactaccctgaaataaccaccattattttgctatgcattcttccaggaagtctcctatgcagacacaataatcaaatgggtaacatactaatcataccatttggcaaaatgctttaacttatcattttaagtattttccacggtcttcaaatattctgccattattaaacaggagagcaaataaaatttacctgtaggactgtccacccacaaaaattaaaagtaacaagctaaattttaacaggaaataaacgaagcacaaacagtacctacttta

SEQ ID NO: 18103 - DNA, 601 bp, Human
tagctgggattacaggcacgcgccaccacgcctggctaatttttgtattttttagcagagacagggtttcgccatattggccaggctggtcttgaactcctgacctcatggatgataatttcaatactatattttctcaatagaaacatccctcctatggaaaataaaagcattacctttaagataacctacttcactaggaatgtaaaaagaaaaaaaaaacacaaggggtaaaatgttttagaggattttcactttgactttaaaattacgtttaaccatagaaatatggggggggggkaatgaaacaaaaataatcaaatggtactaccctgaaataaccaccattattttgctatgcattcttccaggaagtctcctatgcagacacaataatcaaatgggtaacatactaatcataccatttggcaaaatgctttaacttatcattttaagtattttccacggtcttcaaatattctgccattattaaacaggagagcaaataaaatttacctgtaggactgtccacccacaaaaattaaaagtaacaagctaaattttaacaggaaataaacgaagcacaaacagtacctacttt

SEQ ID NO: 18104 - DNA, 601 bp, Human
tgtaggaataagagcatctactttttagtttaaaaattatttacaaaaaacaatgcaagcaaaataatggagattaagttatatcataattctaatctttgtagtttggtgtagtagtatttataacatcaaaagaatgattgtgaatacttgttttactttttagttatttaattcccttttaggtcacaaatcttttaggaaaaaatcctatttggtaattctttatacctagtgaagatgaattagggcacaatatcaatttggcatcccaggatttcatgagtaagaaaataatatmcaatatatactggagaacataaaaagaagtattagagaaaaatgaggttccactaagattttactgagtcactaaactcaggtgaaagcaggcatctattcaatattgcaaatctacactacaaagataccaacagaaatctagcatctaacagggttaagcaatcattgttctggaactataacgcccaacctgaaaaatctggctactagtcttttaaataatataaattcaaaaaattacactttagatttattcttctatcccacaactccattctatttccatgaaattcagctt

SEQ ID NO: 18105 - DNA, 601 bp, Human
aaatgtatacatgccaatataaaacaggaggacattcactaaaattgtttaggatggttagctctggatcataagactgtaggtgattttgcttctttctttgtacctatcttcagttttctaaattctctgccatgaagatgccttacctttaagaccaaattaagttataaccaaactctcctaagtgtcttttctttcacaaagagaagaaaaagaacaaatacaatatacagcaacccacattaacatcacaacaaatacataaatattggtttgtttttgttctatttatcattgkttaaaaaaagctaattggaatctattcacaattcaagtgtttttcaaagcatttaagaaatgcttcccttaggaacaaaaatagttgtgttctcccttaagaacatctgttttttaaacaaacaattacacatatcaagtgatgccatgaggaatcaatcagacaggctgggaagcagacagtccacaacacaaccagcctggtcttttcaacagatcactgtcatcaaaaatgaggaataaggaaaccactctagattaaaggagacttgaggggtgtaacttttaaatgcaatatgtg

SEQ ID NO: 18106 - DNA, 601 bp, Human
tcaacctcatgtttaaatttttaaataattaatctagataaatggtacaattgcaagaagattcctggaatgatgggtaaaaataaatgaacctgtcagttcaagaatatgatcagtcttttttttaagaataaaatagttattccccccccaaacttggttcatcactatttaatccatcctaaaatagctaccaaaaaaaggtttaaaaagttaataatgaatttcagaaactaactttatggtttcaaacatatttatttccaccacatgtacatttattggtcacctcctaagctcrtcctgaaaatgcactaagcaatataccatgtcccaacccttggaaaaatcacaaaattaagagtacattagttcatctagataatgtggggccaacaatttcaacattcaaggcgctgatatacaagtctaaccttaattttctcatataattctcaatattagaatatacaagtccaatatacaagtctaaccttaattttctcatataattctcaatattagaatatacaagtccaatatacaagtctaaccttaattttcttatattttttggaggacaatttaaggagtttagaat

SEQ ID NO: 18107 - DNA, 601 bp, Human
gaagcgtcagaggaaaagacacttgaattgagtctcaaaagatgacaaagatgaggagaggccattctaggtgaagaacacagtatgtgcaaagtcacagaggtaaataaacaggcatgctatgctttgaaaaatgtaagtttagtatgtgaagagaggccagtttagtaggacacatctctaggaagaagaccagtcttctaccttctgggaggataatgagggccatgtgctacactaaggaatgttaacttctaagaaaataatcactgaggtcctctgagcacagtggtcacaaaartcagatctgcatttttgacatttcactctgtagcagtgtgatgggtgacctggaaagtcagactggaaaaacaagaggcagtttctgaaatccaggagagcgataatgaagaactgaaacaagaagtaacggtggtaatggagaataaggagtgagtaagagaaatgtgtggatacaactgtctatacttgaccactggcgggatacagagggtgagtgggaaagacagagagtctcaaatgggacttaaatttccaacctgggaaaccaggtgatggcgtcaccatccaccaagacaaa

SEQ ID NO: 18108 - DNA, 601 bp, Human
gctaaatgtagatctctgaagacactggaatccttttatgaaatttgaacagtttttttctattttgaataaaaggagttattatccttgttttaatggtaaattgatgatcagatctatgaaatacctgacgttatattcaggttgaagaataaccccaaatgacattatttttcttatgaggaaaatcaattttattatgccattcctagcaatttgttacacaaaaagtatgaacttttttttcagaacttaatatataataaggtgttttatcactgttagtgactagttggttatsagaacattaataataaccagaaaaagtggtagacttgtgtcaattaagtgaaataatgtgcttgtttgggccaattcgttctttgaaacctttccccagaaagcaccatggatgaggcactgtgggaagcacctgggatataaagctaaataaggcaaggctcagtcttcaaggtgtccagtggtgcaggaaaagcatttaactaggtaagcacatggccctaggtgaatatgagctaagactggtgaggaagcgtcagaggaaaagacacttgaattgagtctcaaaagatgacaaaga

SEQ ID NO: 18109 - DNA, 601 bp, Human
ctctcagtaatttactaaggtaaaaaaattcataaaatatcactgtcgacccagctgttaatcacagaaatccttttacaattaagagagaaaaatcctgctcattttatgatcaatatatatttcaactagcaagttaggcttatgtcacacttacgatcttggcaacttaatctctttaagtcacaatctcctcatctacaaaatgaggaaaaaatacatacctcatagactgctgtgaggattaaaccagataatgcttttaaagtgctaagcctagtgtgtgaccaatggaaaacgytcccagtatcaaagttgttctatgctaaatgtagatctctgaagacactggaatccttttatgaaatttgaacagtttttttctattttgaataaaaggagttattatccttgttttaatggtaaattgatgatcagatctatgaaatacctgacgttatattcaggttgaagaataaccccaaatgacattatttttcttatgaggaaaatcaattttattatgccattcctagcaatttgttacacaaaaagtatgaacttttttttcagaacttaatatataataaggtgttttatc

SEQ ID NO: 18110 - DNA, 601 bp, Human
atttgtaaaatattcaaatacaccagtttgatcagcaaagtttggagcttcactaaaaaatgggtaatctgttcagaatgtaagaaattctctgtttagtatcaaatccttcagaagctctccttgctgatattttatagtatgtctgaaacacttctgaaagcttttaaataaataaataaaatctaaaccaaagtttagggcctaggtctaataaagatacattaatttttgtatcatcattactaaatatcaagatgatgagttcgacatatagatgctgcataatatttaatccagrcatctggtgtagaggaaaggtcatgagttttgaagtaagacctagattcaaattcgagttcagtctgtcgccctggacaagctatttaactgccctgcatctaaagtttcttcatttccaggtttgcaggaggacaagagaattaaagaaaagataacaggtacataagccagcacctggcaagggctcaataagggatagctttattatttctaatatctgtcaagcaaggttccaaatcatgcgtcacaatcatctgccaaaagagcataagaaaggtttactatatcaagcataaaa

SEQ ID NO: 18111 - DNA, 601 bp, Human
aagattcaaatatatgaagatttgggggagtaaatctttggatggtgctatatctcacttctatactacaattaaggggcttctcaatctttttggagtcccagccagaaataagattgagtttgagtttagaaagagccctctatggtattcaagtgcatggggtataggggatgtcacagaaaaaaaagtttcctatacggcgacttcaaaactggagatcaaaacaatgggacccaggccttggacacttaaacccagccactggacttaaaataagaccatcagtcacaaataaggmtgccaagaactccactgccataatcggaaaatctaggtaaagtttccacctcagagacaatgggacaagcagaaattctgtgtaaaaacacaagccacaaatgtcatcctaaattaggaaagaattcttcactgcacctcaataactcttcatagtgttataagggttccaggggctctggataactaaaagtttcttaagacttatgtcagagcttgggactagaatcaggatttctaactgggagtaaggcacttcaggagggataaacactttctgcacactccatagacaggcaat

SEQ ID NO: 18112 - DNA, 601 bp, Human
atcaagatagaagtagccagttatagtacaatctatcccatataatcaaattactgtgctggtaaattactaaatctaggtataagagaggaaattctactcaaaacacaagtctaaaaactgtgagtagtgtgcactcattgagagcagatttactaaaatagcactacagataaactaaacaaatttcccatttcctacctttaggaagaagatgattaaaatgaggctgtgagatgtactccaaagagaatgggctactcagtcacacagacccggcttctagccctggttctgccayttacaagtgaaatattgggtacatcttattccaaagatgcagtttctcagtctgcaaggtggggacgatgatatctccaccataaagtggttgtgtgggaaatccatcaaagtgcctactattacccaatttttattccctccttttcccacaataagtgggcacagcagccagacaacagaaatgaacaagggatttgtgtggatctctgagcagatctggctgcctcaaatagagggtggagtactggaaaataacacatagtagatgagaccaaattataaagggtcttggaaatca

SEQ ID NO: 18113 - DNA, 601 bp, Human
aggtaattttgtgattgtctttaaaggattccaaccaatgctcactatcaagatagaagtagccagttatagtacaatctatcccatataatcaaattactgtgctggtaaattactaaatctaggtataagagaggaaattctactcaaaacacaagtctaaaaactgtgagtagtgtgcactcattgagagcagatttactaaaatagcactacagataaactaaacaaatttcccatttcctacctttaggaagaagatgattaaaatgaggctgtgagatgtactccaaagagaatrggctactcagtcacacagacccggcttctagccctggttctgccacttacaagtgaaatattgggtacatcttattccaaagatgcagtttctcagtctgcaaggtggggacgatgatatctccaccataaagtggttgtgtgggaaatccatcaaagtgcctactattacccaatttttattccctccttttcccacaataagtgggcacagcagccagacaacagaaatgaacaagggatttgtgtggatctctgagcagatctggctgcctcaaatagagggtggagtactggaaaa

SEQ ID NO: 18114 - DNA, 601 bp, Human
catcagaacttgccaggcaatttcacagataatgaatgaaatggaataaaagtgtggtttattcttccacagccacaatctctcagtaatgcttaaagaacaaaaactagccaatacataaggcaaatttgatcaaagagagttcatctgtgtgcagggaaaggtaattttgtgattgtctttaaaggattccaaccaatgctcactatcaagatagaagtagccagttatagtacaatctatcccatataatcaaattactgtgctggtaaattactaaatctaggtataagagaggaarttctactcaaaacacaagtctaaaaactgtgagtagtgtgcactcattgagagcagatttactaaaatagcactacagataaactaaacaaatttcccatttcctacctttaggaagaagatgattaaaatgaggctgtgagatgtactccaaagagaatgggctactcagtcacacagacccggcttctagccctggttctgccacttacaagtgaaatattgggtacatcttattccaaagatgcagtttctcagtctgcaaggtggggacgatgatatctccaccataaagtggttg

SEQ ID NO: 18115 - DNA, 601 bp, Human
ctaagtctaagcctgtagcagagatgggcttcaagaatctttattgacaacagttttaaatgttacatgacttaagtcatttcattgcctctttaaatgattactggacaataatagttatgatttttaagtttcctgagaaaattttttttctacaataaaacaacttctcatcttaagaatacaatattttaaaatgccactattgtctatgaacacattaaaaagtaaaaagttccacacaattctgagggaaaatgtttattcaaacttccatcaacaaagagaggcaatgaaggcatgctaggagcctttgggagaacataagctattccggggccaacttttacatttaaatctaacaaaactttaaaactccagaagaaaagatctaaaattatttttctgcaaagaccacagagttgactctctaggagggcttctcacacctgaacagcactgaaatcacctggagggcttcttaaactcagttcactggccctaccccacagcgtgattcagtacatctggggcagccccttgaatgtgcatgtctaacaagttcccaggtgatgctgatgctgctcatccaggaatgcca

SEQ ID NO: 18116 - DNA, 601 bp, Human
ttggtcacatggtaatagtattaacttagagggagaaaatagtaagttaatttttggaattagtgttatttgaatgcctatgagaaccccaggacaaaatttcaagtaggcggtttaaaacagacaatagggactgcagacacagatttaaattcctagttccagttctgccactaactagctttgagtcattaggccactcaattaacctcactggttctatgttttcgatttcaatatcactgaggtaagttcagattggtaatgctatgaatatgtaactcttgttctaatatccttrctacctacttcctctttaatttttattttatttatggagtcaaagcaaagagcagaaaactataaaagagatatttttaaattaaggtaagacgaaagtcaagagactgagaatcaagaaaagtcactaccagtaaggtctagcttcaaaggagtggtgtgtatcaaaaccaatctgaagtggacacagttcaatctgaacatatttgaagcacctattctggataaaatattatcctacctaacacaaaggctgtaaagatgactgagaaaagtcaagctattttcaagtattaactaa

SEQ ID NO: 18117 - DNA, 601 bp, Human
tttagccatgcatttaatagcatatactgagatcctactctgagccatatactatatgtgagctcacaacagaaccagtgaaataaacttaaaaaccagtgatagtatgaggtgttagcatctgtagttcaagtacacatttatacatgactggattgaatatggaagacaagagagacagaatataaaatttccagccagtctaattggtcacatggtaatagtattaacttagagggagaaaatagtaagttaatttttggaattagtgttatttgaatgcctatgagaaccccaggayaaaatttcaagtaggcggtttaaaacagacaatagggactgcagacacagatttaaattcctagttccagttctgccactaactagctttgagtcattaggccactcaattaacctcactggttctatgttttcgatttcaatatcactgaggtaagttcagattggtaatgctatgaatatgtaactcttgttctaatatccttactacctacttcctctttaatttttattttatttatggagtcaaagcaaagagcagaaaactataaaagagatatttttaaattaaggtaagacg

SEQ ID NO: 18118 - DNA, 601 bp, Human
cattcaggtctgcactcaagtactacccactcagtgaggtctttcctcacctccctggttagagaatcagggtaacagagctactttatctcatgactctattttttcttcataatcatttataaacttatttacaagtttattatctcaggatagggctcagcaaactatgacctacatgccaaccgccctttttttaataaataaaatcttactgaaacacagccacatccattgtctatggctttttttctcattattgtctattgtctatggcttttttactcattacaatagccgwactgggtagccacagcagagaccacatggcccacgaagtctaaaatatttactatctggccctttacagaaaaagttgccaacccctgtcctagaagaatatatgctctaagagagcaggaatcttgtctgtttcgttcgctgctgtatccctaggacttagtaaagtgcatacagtaggggcttaataaaaatgtgttgaatataagaatgaaacacatttaaccctcaaaacaacctcacagaagttatctccattttgcagataaggaaatggatactcaaagaggtggaataactt

SEQ ID NO: 18119 - DNA, 601 bp, Human
cacattaagcacaaaacctgtctaacaggaccttatctctcctgactccccagacttcagccaccccagcctccaggctgctcttcacacaatgtcagctacacctgccttttgcacctgccacttggtctgctcaaattgttcttcccagcattcaggtctgcactcaagtactacccactcagtgaggtctttcctcacctccctggttagagaatcagggtaacagagctactttatctcatgactctattttttcttcataatcatttataaacttatttacaagtttattatctcrggatagggctcagcaaactatgacctacatgccaaccgccctttttttaataaataaaatcttactgaaacacagccacatccattgtctatggctttttttctcattattgtctattgtctatggcttttttactcattacaatagccgaactgggtagccacagcagagaccacatggcccacgaagtctaaaatatttactatctggccctttacagaaaaagttgccaacccctgtcctagaagaatatatgctctaagagagcaggaatcttgtctgtttcgttcgctgctgtat

SEQ ID NO: 18120 - DNA, 601 bp, Human
cccctccttccacacataaggagagaaaagcattcatcagctgtgtgagtctgttaccagtgcacatgtgaggacagaccacagcacagtgagatgaggctgaggaaacgactacaacagcattggctatatcaggttttcttccttcttccagccacctggaaaaacgttcacagagagttatagtggttacaagaccaaaacttggaatcaaaaaaattaaataatgcaaataacccaattaatctgctaatatctattaccgcagaaatagtgttagaggtagtttattaaagaggcrtttttaaaatcatcccactcatcatatcctgcatttcaaaagtatcatcttaaaaaggaaaataaaaaaatactttttagagcataaagcataacaggttgaagtggttttcaaaaagctacttctagtgttcttcagctttctattatggcagcatcatcttgtgatgaagacactggctcacttggacacacggtcagcatgcataaatacatctcagtgatgatcaagttactgccatctacaggaccgcttgcaaataagatgaagagagctacctcagtgttagcagcaaggctt

SEQ ID NO: 18121 - DNA, 601 bp, Human
gatccaattctgggagttagcaaatgtctaagtgctcccctccttccacacataaggagagaaaagcattcatcagctgtgtgagtctgttaccagtgcacatgtgaggacagaccacagcacagtgagatgaggctgaggaaacgactacaacagcattggctatatcaggttttcttccttcttccagccacctggaaaaacgttcacagagagttatagtggttacaagaccaaaacttggaatcaaaaaaattaaataatgcaaataacccaattaatctgctaatatctattaccrcagaaatagtgttagaggtagtttattaaagaggcatttttaaaatcatcccactcatcatatcctgcatttcaaaagtatcatcttaaaaaggaaaataaaaaaatactttttagagcataaagcataacaggttgaagtggttttcaaaaagctacttctagtgttcttcagctttctattatggcagcatcatcttgtgatgaagacactggctcacttggacacacggtcagcatgcataaatacatctcagtgatgatcaagttactgccatctacaggaccgcttgcaaataag

SEQ ID NO: 18122 - DNA, 601 bp, Human
aatgcttagtataaatcatacaacatgatgaacatgctcacgtatatttaaatataaacatatttggactttaaaaagtaagtacatcttaggagatgatccaattctgggagttagcaaatgtctaagtgctcccctccttccacacataaggagagaaaagcattcatcagctgtgtgagtctgttaccagtgcacatgtgaggacagaccacagcacagtgagatgaggctgaggaaacgactacaacagcattggctatatcaggttttcttccttcttccagccacctggaaaaaygttcacagagagttatagtggttacaagaccaaaacttggaatcaaaaaaattaaataatgcaaataacccaattaatctgctaatatctattaccgcagaaatagtgttagaggtagtttattaaagaggcatttttaaaatcatcccactcatcatatcctgcatttcaaaagtatcatcttaaaaaggaaaataaaaaaatactttttagagcataaagcataacaggttgaagtggttttcaaaaagctacttctagtgttcttcagctttctattatggcagcatcatcttgtga

SEQ ID NO: 18123 - DNA, 601 bp, Human
cggccctgatgtgatataatatgaagtcttcagcacccttatgaagcactactctttttttttttttttttttttttggacacggattcactctcttgccaggctggagtgcagtggtgtgatctcggctcactgcagcctcgacctcctgggttcaagcgattctccaacctcaccctcccgagtagctgagaccacaggtgcatgccaccatgctagctaatttttgcctgtttttttgtttgtctgtttggttgattggttttcgttttttttttttttggttggtttttttttttttggtagagacagggttttaccatgttgcctaggttggtctcaaactcctgagctcaaagcgatacatccaccacctgccttggcctcccaaagtgttgagattactgacgtaagccaccgtgcccagcccttacgaactacttttatcagaaatgtttagccctagtcttatgaaactttagatctaatctagtttataggaaatccagaggctgaaggaaacaaatctggaaggtggggcactctgctgaacagctggcctattttcttttcagtagagaatgttatgggtgggagcact

SEQ ID NO: 18124 - DNA, 601 bp, Human
aggtcttgttctgtcacccaggttggggtacagtggcatgatcatagttcactgtaacctgaaactcctgagctcaagcaatcttcctgcctcagactcccaaaaagtagctaggactacaggtatgcacccaccatgcccaattaattttaaaaaaaaatttattttgtggtagagacagtctcacttgctggtcttgaactattgacctgaagctatcctcccaccttgacttcccaagtcgctgggattacaggcatgagccacctcactcggccctgatgtgatataatatgaagtyttcagcacccttatgaagcactactctttttttttttttttttttttttggacacggattcactctcttgccaggctggagtgcagtggtgtgatctcggctcactgcagcctcgacctcctgggttcaagcgattctccaacctcaccctcccgagtagctgagaccacaggtgcatgccaccatgctagctaatttttgcctgtttttttgtttgtctgtttggttgattggttttcgttttttttttttttggttggtttttttttttttggtagagacagggttttaccatgttgc

SEQ ID NO: 18125 - DNA, 601 bp, Human
agaggctgaagcagaagaattgcttgaacctgggaggcggaggttgcagtgagccgagatcgcaccactgcactccagcctaggcaacaagagcgaaactgtctcaaaaaaaaaaaaaaaatcactaaataatatatttttaaaacaaaggtagcaaaaacacaaacactgaggaagtaatagcagaaagtaacaggataaaatggtgacaggctgagtacagaatcagtgccttggatctggctgcagccaagccactaactctctctatcctcttgaacaagtcacaggctttctgtgyctaatttgctcaccaatagattccctttcaaagattccttcattatcaattgcaggatttccagatacgatatggcttctgatgtgatgtatctgggttttctgattgctttctcttcttttctttttagagacaaggtcttgttctgtcacccaggttggggtacagtggcatgatcatagttcactgtaacctgaaactcctgagctcaagcaatcttcctgcctcagactcccaaaaagtagctaggactacaggtatgcacccaccatgcccaattaattttaaaaaaaaatttat

SEQ ID NO: 18126 - DNA, 601 bp, Human
atcctaggtaatttaaatgtccatttcacaaaatcactagataggccaggagtggtggctcacacctgtaattccaacattttgggtggattgcctgaggtcaggagttcaagaccagcctggccaacatggtgagaccccatctctactaaaaatacaaaaattagccaggcgtggtggcgggtgcctgtaatcccagctattcgagaggctgaagcagaagaattgcttgaacctgggaggcggaggttgcagtgagccgagatcgcaccactgcactccagcctaggcaacaagagcraaactgtctcaaaaaaaaaaaaaaaatcactaaataatatatttttaaaacaaaggtagcaaaaacacaaacactgaggaagtaatagcagaaagtaacaggataaaatggtgacaggctgagtacagaatcagtgccttggatctggctgcagccaagccactaactctctctatcctcttgaacaagtcacaggctttctgtgcctaatttgctcaccaatagattccctttcaaagattccttcattatcaattgcaggatttccagatacgatatggcttctgatgtgatgtatct

SEQ ID NO: 18127 - DNA, 601 bp, Human
tagagagtgcaccatcttccttttttttttttttttttttgagatggagtctcactctgtcgcccaggctggagtacagtggcccaatcttggctcactgcaagctccgcctccaaggttcaagcaattcccctgccttagcctcctgagtagccgggactacaggcgcctgccaccacacccagctaatttttgtatttttagtagagatggtgtttcaccgtgttagccaggatggtttcgatctcctgaccttgtgatctgcccgcctcggcctcccaaagagttgggattacaggcrtgagccaccacgcccggccccatcttcctaactggagaaaaagggcactgctaccaccatggcttggcaagaacctgcaccctaagaactaagttttaaaggacccaatatacagccaggccatttctgttatcttaaatggcaccaattaatatcaaatataaaagttactcttttggggccaaatactacatacgaaaaacattagttctctgaaaagattaatagagtaaatggtcacttgtaggcaattaattaaccgaatataaaattagagactcaacggcatcatggtttgct

SEQ ID NO: 18128 - DNA, 601 bp, Human
taagatcccaccgcaaagccctgcagcacagaaggtctccacacccttttgtgcttggcttcctggtttctaagctgctagagagtgcaccatcttccttttttttttttttttttttgagatggagtctcactctgtcgcccaggctggagtacagtggcccaatcttggctcactgcaagctccgcctccaaggttcaagcaattcccctgccttagcctcctgagtagccgggactacaggcgcctgccaccacacccagctaatttttgtatttttagtagagatggtgtttcaccrtgttagccaggatggtttcgatctcctgaccttgtgatctgcccgcctcggcctcccaaagagttgggattacaggcgtgagccaccacgcccggccccatcttcctaactggagaaaaagggcactgctaccaccatggcttggcaagaacctgcaccctaagaactaagttttaaaggacccaatatacagccaggccatttctgttatcttaaatggcaccaattaatatcaaatataaaagttactcttttggggccaaatactacatacgaaaaacattagttctctgaaaagat

SEQ ID NO: 18129 - DNA, 601 bp, Human
atgaaacatttatatatgtatttttaaaattacataaatgcagtaaaagcaaaatatataagtatgagtctattaatcaaataacaaacttgtacagttgtccgttggtaaatgcgggagattgcttccaggacccctgtgtatacccaaatcctgcatactcaagtcccgcagtcggccctgcagaacctgcatatatgaaaagttgcccctccatctatacaggttttgtatcctgcaaatactgtagaatttttgatcagtgtttgcttgaaaaagagccatgtctaagtggacccaygcagttcaaattcatgttgttcaagagtcaattgcatggccctgacacttacctgtgaagttgaactcttgacacaaatctgaaagtttcttctttatggaggagaaacattctcaaggaaaggcaaatgatctcatagcaacactaaaatgtatacaggaaagcctcctttaaatggcaaaaactgtaagcataagtattgccattccacacatcacagcagccttaagatcccacctcacagccttaagatcccaccgcaaagccctgcagcacagaaggtctccacacccttttgtg

SEQ ID NO: 18130 - DNA, 601 bp, Human
agcactatgctagcctaggtgttcagataaatgctcaagtatactgatgtcaccaggcagaattcagataatggtgaccagagatcctgtctgagcaacctggtgacattagataccagacatagaacagagttcacaccacgtcacagaacacatatgaactttgtccacacaacagctgcaattctcttaactcatcctaacttaaagaaatgtaccaattcttggctttattttttaaatgtgtgacaaaatattagaaaaactcggcttggagcaacagagagctaaagaagaaatyaagagaagacataaaatcaagagaagacataaaaatggctattggcgtggtggctcacgccagtaatctcagtattttgggaggctgaggtgggcagatcacttgaggtcaggagtttgagatccccagcctggccaacatggtgaaatcccatctctactaaatacgaaaattagctgggtgtggtggcgggcacctgtaatcccagctatttgggaggctgaggcaggagaatcgcttgaacctgggaggcagaggttgcagtgagccaagatcacaccattgcactccagcctgggt

SEQ ID NO: 18131 - DNA, 601 bp, Human
actaacattacgactgctaaaaatatatttttaaatgtcactggtggtttaataaacatgaccaaagtgaagtctgttgaacttgaattcacagagcaataccgcactaaatattttagcactttcggcactacaccacttttattggaggaagaaaaaaaacagtatactgggcacagttccctctcattcccaatgctcctatgcttatgaggcaaattactgtactatttgaaaaaaatacactaattcttctcccttcccaggcccctctggttatctggcagtggttttgtgcacrtacttacactattagcagttcactttaatattgccacaaaaaggtggcaagaagaaagtagagggctcaaccctttattatatttatttgacttcctagaaataattttaaatataattagtgacaaggaataaagttcacatctgtaacaattgaaaatggaatgtacaaacaagaccggacagacagacaatgctactggcagtacgatcggcaaccaacgcacacacactgaatgaagctcagctcctaatgagagtcaggaactcttcccgagtctttggatcctcccggaacaca

SEQ ID NO: 18132 - DNA, 601 bp, Human
aactacttagtcatcatcaagtagaaataaaacaagagttcccaagagaagggtatgtttcctaatttaatatgtaaagacacattatgtttgttagtccatctcacccaacttgccctgtggatttgtaaagtaaacttggtcagacatcctcctgaaaacatttgaaaggttgttattagtcaagaaaatatgcaataacttggtatgtcttacatgtgaggaattgatggcttaggaattcagttaaagataaggaatgaataataaagtaataaagcaaaagagtattaaatatcasaaatttcacattaactttgaagtcatttagttttgtgttcctattattgcaaaaatgctgctttgctgatttgagtgtcaggtttgttttataataaaggtatctttttaaaaaagtattcacatatcttaacatctaatactaaaatcacatttttgggaatagtattcataagtagtaattgtgattaaatatgatgttaagtatattatttaaaatttaatgatttttatgatataaccactttgaaaaactgtgttgcaggttattgcaaagctaaccatacacctgcagcatttc

SEQ ID NO: 18133 - DNA, 601 bp, Human
gatatatgataatggttatgatgtccgtaaatgaaagactttgaggccaggaaatacatgttttatgcatgtgactttcatattatcttaaacagtgcacatgaggaggagtggagaattataaaacctgaatgtgttattccaagaaagaaggaattaaaattaggaaccattaggaatggcacatgtgctgagattagcagttggcaacgttttctttaaaaaacatagaggattttagggtaggaatgacaagacactggaacattgaaaaagttcagagataagttcacacataagrcttgtgtgccctggggagaaataggtagtaaagacatgtttgtggctggcagagaatcctgggaagctgtttcactggactttgcctgcaagcaaagcaattttacttggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagctta

SEQ ID NO: 18134 - DNA, 601 bp, Human
ggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagcttattgatggtaaaattaacatagtgaggaggaataggagattttagttgactataagttcattgtgatcccatgttgtaaagttgtcacacgcacaaaaaaattacattcrcaatatgtacccatagagctgctgcagaattcctttatttgccctccttagctcagtcccattctctgaaactgttactctactctcttctcaataataatgaccatggcagcagcagtaggtaacatttattgagtgcttactgtgtaccaggcatgtgttttaatatacattgactcctcactgtaaccctgtaaagttggaactattattctctccattttacaagacacaaaactgagacccagagtcacactgctaggaagcacaggaattggaatttgaatcccagctatctgg

SEQ ID NO: 18135 - DNA, 601 bp, Human
ccaggtcagttacattggaatgttttgaccagggcttggtcattggtattttttaagagctcctcagttgattctaaagtacaatcaagtctgaaaacctccaatttagctcaaccaagctgaattgaataagatagtgtgggttagtgtttttttacactaaatatagtacttgttttatgtaggtcaatataatgtaaatgccattatatattatatttatgcctgattcaaattcttatgtattgtgacatattaaaaatacaggaataaaactgaatttctaacaaaccataatatraggatgctcagcatgaaggattttgtccatagctattttcttaaaatgtaggcatgtacatgtgcacacacacacacacacacaaatgcacacacatagggaggaaaatttcttgtagcaattggtaaacaaatgaatgagttgattattggtctgctcagaataataaattgggtattataaatttgtgaagttattgcattccttaaagcaaccagtgtgccttttatttgggtattgatctgggtccatcattgtgtgctagtagtaaagctggaaggagtatgtagaaatgaaaag

SEQ ID NO: 18136 - DNA, 601 bp, Human
agcctcccaaaatgctgggtttacagacgtgagccaccgcgcccggcctccttccattatttttgtgcattgattttttttttttaaagaaagctagaaaaccttgagttaagatttttaatttacaggttgcattaaagtattaaatcctttggtttgagttttcttacaaaaccatactcatatgagataggagggaaaaagttatcactttctgtagttaggtgataaataagaatacagatggggaggggaatcatagttgcattatttttgtgtatgtattttctttttcttttcyttttttttttttttttttttttgagacggagtctcgctctgtcacccaggctggagtgcagtggcgtcatcttggctcactgcaagctccgcctcccgggttcatgccattctcctgcctcagcctcctgtgtagctgggactacaggtgcccgccaccatgcctggctaattttttgtatttttagtagagacggggtttcaccatgttagccaggatggtctccatctcctgacctcatgatccgcccacctcagcctcccaaagtgctgggattacaggcatgagccaccacgcctg

SEQ ID NO: 18137 - DNA, 601 bp, Human
cccagactacagtggtttccctctggttgctgacaccaatagcttttatgttggaaatatcaatattgagctgtccaagtttctcacatgttttctctatacactcatagacagaatgtagaatttccttagggtcctgttccacccatccttctcttggggactcttgttttatttctacttgatgatgactaagtagttcagctgtttttgaattgaaaaccaaaaagctcgtcgaactggtgccctggtccaccgcccccaccaatggccccaaaactgccttctttgaggctgccaygaaaccagcttcaggtcggccggcgattgcggccggtttcctgggtgacggcggcgggagggggaggggcaggtgacgagtccagagatcgaggccgcgcgcgtccgctgaacctacttattttatttttaaaaccagaaagtttgcacagagggcaagggaaatagccaaatgtgaacagttgctctcttagctatttttaagtgtttcctgttgtttctgatggtattctctcagtgtttcagcagcctcttcaactcagatctggtcttaaatgtggtccatttctgccccctcaac

SEQ ID NO: 18138 - DNA, 601 bp, Human
tttccccccatttccatcagagcgatgtggtcagtagaaaattgcatacctgaagaatacaatggtctcccaaaggtagagtcgaagagtattgaagctgtacatttttcaggtccttgtgctttgtagtccacgagttatgggggcaaaaatgtttcaaattggcacttacaaaaccagaaagcgctattgcaaaaaataatccagatgttaaagggaggcggggaacaggggcgcggagggagagccccaggggaaattggagcgagggggtcgtagataccacggacagcggcggctrcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcc

SEQ ID NO: 18139 - DNA, 601 bp, Human
atgactttgaaggtgaataggacttggataaatggtcacagcccttcacataaagattgtaatttgcaatttgtgatttgcttttcaggtccactttcttgattcctatgaggtactgaggtagacagggcagaattcttgttcctacttgacaaaggtagcaccaagagttttagtaactcacctaggctcattcaactaacaagtggtagaaccaggacttgaaccaaagttttctgattgtggaaagaagaaagtagatatgtccttatgccctctggcacccattgcattctgtccctcttgaaaaagtagcccaagcattttgctcaaactaagctaggatcagaagtcttggcatataggaggggactcagtcttgggatgagaaactaggtttttccttcaagggattatcaggatttctgggttttggacataactccagcactcactggttgtttacctcggccatgccttttctctgtcctgggcctcaatttcctcatcaatctggagagagagtaagtagctcttgatctaggcggtcattctcagcttcagtggtttggaattcctttatggaagctatccatttaca

SEQ ID NO: 18140 - DNA, 601 bp, Human
atttacctgcaagaaattgcagtgagaaggcagtgtagcctggtgaataggacaaaaggctttaggattagaacaacctcggctagagtcctggttcagtctcacactacctgtgtccttagacaagtatttgaattgttctgtatctgtttccttatgtatagtaaactggggataataacaataatacctccatcatatagttacttatatgattaatgtgaggataaaatgagatgatgcttatgaaaaacttagcagtcctcatacattgtaaatgttcagaattgtcaattgccarcatcactgttaccatcatcatcatcatcatcatcatcaatattttcttgctaagaatgggcctgactaagtagaactttctctacctttctgccagttatcttcccaaaacatgacttgttcctgttatttcctcttgtaaaacctttggtctcatccttctttcctcatacaaggcagttcccattacctacaggaaaaagtttaaactctttagcctgccctttataatcaagctctaaccagtctttctatccccttccccatctttcttcaccctaatcatgactccctatatgcc

SEQ ID NO: 18141 - DNA, 601 bp, Human
ggcagggtcctttgtcacagcacattgcgcctgggcagacaactattttgttttgttttattttatttttgagctttactgattaatagacaacgattttaaataggtcagtctaaagcttgtaggacctggcatattgcaggtatgtactgtgacctgcaacactatgacaggtcataatgtgtgggtccctggttgccctaatctgtcagtggaaaaacttcagactctctgtctgaaggcttcttctttattgcttttaatggcaaaaactgcaattatttttgcaccaacctaatcktttgtttatccctttgttcatttgtttaacaaatacttattgcatgctcactatatgttaggcattgtgttaggcaccagggatatagcacagagcaaaaccaaacacggtctctgcctttatggagcttgcgatttggtggaagagatcggctttaaaaaaatcacatcattgaatttatgcttttaaatcaggatacatttttagaagtttagaaattaagttcaagtagaacgtggcatttgctaggacacacagtgcactggaagagcagtacagggaaagagaacaagatattta

SEQ ID NO: 18142 - DNA, 601 bp, Human
ccctgtggtaaactgccagaagttaattgaatcagattgctgatgtttaagaaacatactgatggaaatgtgtgtatatgtaatcattttaatccttggcacttgtgcggcaggaacaaaacttaaagctactttggcatcctctgatttaattctcaccagaatttccctttatacgcattttgcacatgaagaacctgggcccaagtaggctagctcaaagtctcatactaaagaaaactaaagaggcagggtcctttgtcacagcacattgcgcctgggcagacaactattttgtttygttttattttatttttgagctttactgattaatagacaacgattttaaataggtcagtctaaagcttgtaggacctggcatattgcaggtatgtactgtgacctgcaacactatgacaggtcataatgtgtgggtccctggttgccctaatctgtcagtggaaaaacttcagactctctgtctgaaggcttcttctttattgcttttaatggcaaaaactgcaattatttttgcaccaacctaatcttttgtttatccctttgttcatttgtttaacaaatacttattgcatgctcacta

SEQ ID NO: 18143 - DNA, 601 bp, Human
attaaatggacaatatagagtaactaaaactaggggtcatttaagaagttctatctggcttgctgaacccaagacaatttcctccttcaatgtagtttagaaggatggtgatatcttaattcccatggacatcttctgtattggaacgtcggcctcctccctgtggtaaactgccagaagttaattgaatcagattgctgatgtttaagaaacatactgatggaaatgtgtgtatatgtaatcattttaatccttggcacttgtgcggcaggaacaaaacttaaagctactttggcatccyctgatttaattctcaccagaatttccctttatacgcattttgcacatgaagaacctgggcccaagtaggctagctcaaagtctcatactaaagaaaactaaagaggcagggtcctttgtcacagcacattgcgcctgggcagacaactattttgttttgttttattttatttttgagctttactgattaatagacaacgattttaaataggtcagtctaaagcttgtaggacctggcatattgcaggtatgtactgtgacctgcaacactatgacaggtcataatgtgtgggtccctggt

SEQ ID NO: 18144 - DNA, 601 bp, Human
gctagtagtatgcctgctgagtctggtgctcacagatatggtttcctgataatttgcctaaggaggctggccagagaattcgagaaccagatgctttgtgcacaacaaatgaggcaacatgggaagatggtgggagttgggaaagctgtccaagatcacaggctctgagaaattcaggcatgtagctagttcctctccactcaccatctgggacttaaaatcccttctgcaaacttcctgttaaagagagtttctgcagaagaagcttgtacacctctagggtacaaatcacttccagagyggcttactctaaggaaactattctttatggtgagctcacttctgcatcattgtaatttctgacatttgggccaacttaagagcccttatgaatgagattacgttaattcaaatgcatagaaggaggcaggcaggagaaatgtgagtggtaaagtgagttggggctgaaaaatatccctggttagaagggatggtattaactggaaaatgcattccctacctaaaggcagttccagtgcaccaataccttatgggaagcacattcagtgtggctggatgctgtgattttttttctagtgaa

SEQ ID NO: 18145 - DNA, 601 bp, Human
aagtctgactctattgcatttcaatgaaaatctccccttgctggagctggggtgttgttctatttttatttttattttttattttaaactgggacctagttacgtagggggaagcaccaaattaactttttatgctgctttgggtgaattattctttgcctttctcatctgttaaacatgggagtaggaggagtagaggtttggattgaaggccccatctagctagaggattatcaatttcatattgtgtctgggagaaaaattccctaggaatgactggtaaaaggcttgctattcttaytggaaccagcaggtggcaggaaatgcatgcccaactgcatctggagctgcttagagctggagcaggggaaatctggtagtgtactctggagctcagggaagttgctagtagtatgcctgctgagtctggtgctcacagatatggtttcctgataatttgcctaaggaggctggccagagaattcgagaaccagatgctttgtgcacaacaaatgaggcaacatgggaagatggtgggagttgggaaagctgtccaagatcacaggctctgagaaattcaggcatgtagctagttcctctc

SEQ ID NO: 18146 - DNA, 601 bp, Human
cctggaccctgcctgcttttgcagtctcatcttgtgccatttctatctggtgttctatgctttagtcactgaaatatttccttatatttgaaaatgtcatggttcttttcttgaactctgggcctttgtgcaagttgttctccctgcctagaacacactctgaaccccatctcttgtctccaactcctctttcacctaattcttccttagaagccttctctgagctcccaagtataggctagccgctcctgctgtgtgctccataagctctctgtatatatctccgtctttttttaaagcwcttatcacattgtatggtaatttcttgattagcgtctgtctcttactagattataagctccgtgcaaagtctgtcatgttcactgcactctcaacactgaacatatgaacatagtccctggttcataagctcaaaacttggtatatgtttgttgaacaaatgtttacttgtatatcttcaccagctttagtgtccttttttgttgttgttgtttgtttaaatggagttgtatttttagcaccagaagggtttgagacatatggtaaatgctgaagaaatccttggaaaatgaatgaatct

SEQ ID NO: 18147 - DNA, 601 bp, Human
tcgggacagtagtgtcacctgcgccctaatttatcatcacaagttaacgaagtctgggggtgtgggggtgtgtgtgtgtgtgtgggtgtgtgtgggcgtgtgtgggcgtcggccttaatgtaaccctggtctgcgtagaagtgtgtgttgtttcgcctgcttcccctgtacccaggtcggcggctatagagattgtggacggcgccatgggtttgcccgatttctgctgtaaagaataagactaggtcaggtgacctttcggggcttgagtgtgggaggaacggagacaatcctccatccsgctccgttatccagataatcctgcgctctcgggggttttccgatctggatgattatctatctggtcgttcacacctcagctcacttaagcggtgaagaaactgcctacgaatcagagagagtgattttacccatggccatatgtagtagaaataagactggagcctaagtctactaactcctagtgaagagttcttcattgcatggtagctgtttttgtgctggaatgatgggctggagtcctggaataaagtgattgatttcaaaaggaagtcacattgagagcctgctgtgctctggt

SEQ ID NO: 18148 - DNA, 601 bp, Human
cagagagagtgattttacccatggccatatgtagtagaaataagactggagcctaagtctactaactcctagtgaagagttcttcattgcatggtagctgtttttgtgctggaatgatgggctggagtcctggaataaagtgattgatttcaaaaggaagtcacattgagagcctgctgtgctctggtcaccttcatacctttttgtttagtcctcacattccccaaattattatcatttgcattttctagatgaagtttgggaagctcagaatatatacattttctagtctgtgacagasctagcattcagacataagtctgagtctcactactcgccagactgacagctctgcaggacaggaaacaaggggcatcgaagttaagactgaaatgagtatagagacagagtagagaggtttctgtttaaagctcaagttgcatagtgagtgctcatcatgtgagcactttaagcagaaactggatgacctgaccacttctgaataaattgcaaaaaggattcttgataatcttacaaggtttttacagttcagagcctgcctcctgcccatgtaatgctttcttcaacacctaactgcgtg

SEQ ID NO: 18149 - DNA, 601 bp, Human
tgcatagtgagtgctcatcatgtgagcactttaagcagaaactggatgacctgaccacttctgaataaattgcaaaaaggattcttgataatcttacaaggtttttacagttcagagcctgcctcctgcccatgtaatgctttcttcaacacctaactgcgtgtaacacttattatttaggtcagaagtggtaaattttgttgttgttgttaaaggtccagacagtaaatagttcaggatttgcaggatcactttggtctctgttatatattgtttcttttgttttgttttgtttacaacttttttttttttttgagacagttttgctcttgttgtccaggctggagtgcagtggcgcgatcttggctcactgcagcctcctcccgggttcaagtgattctcctgcctcaggctcccgagtagctgggattacaagcgcacaccaccacgccgggctaattttttgtatttttagtagagacggggtttcaccatgttagccagcctggtcccgaactcctgaccttaggtgattcgcccagctctgccccccaaagtgctgggattacaagtgtgagccaccacgcccgaccttacaact

SEQ ID NO: 18150 - DNA, 601 bp, Human
tataaacagtgctatagtgaacaccttgagtatttctttttttttttttgagacggagtctcgttctgtctcctaggctggagttcagtggcgtaagccaccacccctggcccaccttgagtattttacgctagagacctatatatgctatacatacattttgaatatttctataggttagagaccaataaaaggcattattggactcaaaaattcacattttaaattctgatctataactacaaaattgtcatcccaaaaggccttagcattttacatgtcttctagtgtatggaagtgmctatttagttagatgcattcttactagaattatatattaaccatattttcaatgtttgccaatctgaaaaccacaaaatgataccttgctttgatttaaaaaacaacaacaacaacaacaaaaaggctggacgcagtggctcatgcctgtaatcccagcactttgggaggcagaggcgggcggatcacctgaggtcaggagttcaagaccagcctggccaacatggtgaaaccccatctctgctaaaaatacaaaaattagacaggcgtggtggcacgtgcctggagtctcagctactcg

SEQ ID NO: 18151 - DNA, 601 bp, Human
tagagacctatatatgctatacatacattttgaatatttctataggttagagaccaataaaaggcattattggactcaaaaattcacattttaaattctgatctataactacaaaattgtcatcccaaaaggccttagcattttacatgtcttctagtgtatggaagtgactatttagttagatgcattcttactagaattatatattaaccatattttcaatgtttgccaatctgaaaaccacaaaatgataccttgctttgatttaaaaaacaacaacaacaacaacaaaaaggctggrcgcagtggctcatgcctgtaatcccagcactttgggaggcagaggcgggcggatcacctgaggtcaggagttcaagaccagcctggccaacatggtgaaaccccatctctgctaaaaatacaaaaattagacaggcgtggtggcacgtgcctggagtctcagctactcgggaggctgaggcaggagaatcgcttgaacccaggaggtggaggttgcagtgagccgagatcgcgccattgcactccaacctgggggacaagagtgagactttgtctcaaaaaaaaaaagaaaatcacaact

SEQ ID NO: 18152 - DNA, 601 bp, Human
agatacaaacattccacaaagccttctacataatcatagtacagccttcagaatcgtgaaactaatactaatggttttattatcacgcctagcagtctctctgcttctttgaccctaaaggagaggagcacacactctagaggtagacttcctaggttcaaattccagctctgggcctggtgcggtagctcacgcctgtaatcccagcactttgggaggccaaggcgatggatcacctgaggtcaggagttcgacaccagcctggccaacatggcaaaaccccatgtctactaaaaatacraaaaattagccgggtgtggtggcacgtgcctgtaatcccagctactcgggaggctgaggcaggagaatcgactgaacctgggaggcaaagattgcagtgaaccgagattgcaccactgtactccagcctgggcaacaagagcaaaactccatctcaaaaaaataaataaataaataaataaataaataaataaataaataaataaaaattccagctctgccactcactagttgtaggtcttttggcaagtcactcaatcctactatgcctcaatttccttatctcttacaaaggatgtaa

SEQ ID NO: 18153 - DNA, 601 bp, Human
aatttgtaaaataaatatttctgatttaaatgttagattccagattctatagtttgtgaactctgaataaaaaccaaaactaatttgctaattctcccctttttatgagcacatgaacatctctgttgccttcaaattaaaaaattataggtccaatcaataatgatactacattatttaggattaggcttgaggatgttaatgggaggctgttttctgggatttgaacctgctggagtcatggaggttccataaacctcgttggtcagtttatttatcctcttgctgtccgtcctggagrtgaatggcatacaaatgctcttgagacctgctatggaaccaaaagttaactttaaatttgcaatttgtgaaatgcttctctattgatgaatatcttcttctcccatgtgcaagagggcccattcctgaaatagaagtgattaggaactagttaataacagaaagttgtttagttaatatgaaatgaaagagtaaggaaatgtgttgattttatatggtcatttacacccttagtaaacccaatgaattaggcttctttactgcagatttttgtagaatctgctgtaggtttttatcttca

SEQ ID NO: 18154 - DNA, 601 bp, Human
ttaggagccagtgtgcacatgaagcagaatgagagtccttaggtgactattgaatacataattggccattattagaaaggggtcatatggtagttttctgctgtggcctcaatcagtcctctcgtaaatgtgctagtggctctgttttctctaatgctttttcttatttatttataagtgttgaaagtaatgggttcatgtacctgattgccttgttgatcttgcgtcactgggaaggctaagagctccccttctttttttttttttttctttttttttgagacagagtctcgtgctgtcrcccaggctggagtgcagtggcacagtctcggctcactgcaagctctgcctcccaggttcatgccattctcctgcctcagcctcttgagtagctgggactacaggtgcccgccaacacacctggctaattttttgtacttttagtagagatggggtgtcaccgtgttagccaggatggtctcgatctcctgacctcgtgatctgcccacctcggcctcccaaagtgctgggattacaggcatgagccaccacacccggccaagagctccccttctaatgctgcttgcctaagacagggtcc

SEQ ID NO: 18155 - DNA, 601 bp, Human
tccccctgtgctctcagatgatagatgatttgagtatttctttacctcctgcttttaacctaattgatattttagtgagccttctttaccacctgattggtcgagtgtgagctgagttacaagccccgtgtttaaaggtgggtgcagtcaccttccccagctaggcttaggaattcttagtcggcctaggaaatccagctagtcctgcctctcaccatgatgaaaccctctcaccatgatgaaaccctagcttgaacatcatgtcccatgatgaaaccctagcttgaaaatcccctcgaasttggaaatcctgagtgggcaccaattacttactgcacggtcacttcactttcattttcaagggttctgtcgtgatccattgcagcatgtctcacacggggcaccacctgccgggtctgtcccacagaccctggctgactgacagatgaaatgagtactcagacacaggtatgcagtgtaagagcagctaggggtctgcctggctctagtggccaaagtgcagcagccctgagaagctggagctccttgcttttattcagtgtaggcacagtgatgaaagcctggagcaaacacaatctgt

SEQ ID NO: 18156 - DNA, 601 bp, Human
accacctgccgggtctgtcccacagaccctggctgactgacagatgaaatgagtactcagacacaggtatgcagtgtaagagcagctaggggtctgcctggctctagtggccaaagtgcagcagccctgagaagctggagctccttgcttttattcagtgtaggcacagtgatgaaagcctggagcaaacacaatctgtgggtaattaacgtttatttctccccttccaggaacgtcttgcatggatgatcaaagatcagctcctggtcaacataaataagctagtttaagatacgttccsctacactcccttgtacctactccttgccctctgcctcagggttatagaacagctgccttcagctattctcccccagggctctgcagaaccttctgaccttttagaaggcctgcatctttccctatagtttctcccaccactccgactgatctcctacatataataatgaatattttttaaatgtgccttgtagagttagtttaattactttataatatgctaaattatttggaatggccagtgtgccctagaggttgcccagaggtttagaggcaggaatcatcagtaactgtagttatc

SEQ ID NO: 18157 - DNA, 601 bp, Human
gcagccctgagaagctggagctccttgcttttattcagtgtaggcacagtgatgaaagcctggagcaaacacaatctgtgggtaattaacgtttatttctccccttccaggaacgtcttgcatggatgatcaaagatcagctcctggtcaacataaataagctagtttaagatacgttcccctacactcccttgtacctactccttgccctctgcctcagggttatagaacagctgccttcagctattctcccccagggctctgcagaaccttctgaccttttagaaggcctgcatctttmcctatagtttctcccaccactccgactgatctcctacatataataatgaatattttttaaatgtgccttgtagagttagtttaattactttataatatgctaaattatttggaatggccagtgtgccctagaggttgcccagaggtttagaggcaggaatcatcagtaactgtagttatcagggaaggctttactaggaggtagaatgtgaacgaggcccaagagacaggtaagaattcgatgggcaaaaaaggggccaggcagatgggaggtccataagtaaaggcaaggaggctgacc

SEQ ID NO: 18158 - DNA, 601 bp, Human
actgtagttatcagggaaggctttactaggaggtagaatgtgaacgaggcccaagagacaggtaagaattcgatgggcaaaaaaggggccaggcagatgggaggtccataagtaaaggcaaggaggctgacctgagcaaagctgtaaaggactgggggctggctcatcttgttctattttgagaagtagtggaaaatacttaaggtggaaccgagtaaaacaagctatttgttagaagagttaagaatttgaattttatctgaaagtatataaaaggaatatatggtcagttttttctggttttttttttttttttttgaggcagagtcttgctctgtcacccaggctggagtgcagtggcatgatctcagcttacggcaacctccacctcctgtgttcaagccattctcctgcctcagcctccccagtagctgggattataggagcgtaccaccgtgcccagctaatttttgtatttttagtagagacggggtttcaccatgttggccaggctggtcttgaactcctgacctcaaatgatctgcctgcctcagcctcccaaagcggtgagattacagcgtgagccagcacgcctggcttg

SEQ ID NO: 18159 - DNA, 601 bp, Human
tagcgagtttaaaaatgaggccaggcgcagtgccttatgccggtaatcccaacactttgggaagccaaggctggcggatcacttgaggtcaggagttcaagaccagcctggcaaacaaggtaaaaccccatctttactaaaaatataaaaactagccaggtgtggtgtcgtgtgcctgtaatcccaactgcttgggaggctgaggcaggagaattgcttgaacctgggaagtggaggttgcagttagccgagatcgtgccacagcactccagccttggcgacagagcaaggcatcatctcaaaaaaaaaaaaattaagtccccttttttttccaaaaccagttctcactttgtttcgggtagctaggtattcttagtctctaagattcctttataatcctgttttcctctttcctttctttctatatctgattggttgccaacataccttgttttcttttataaacttcctctttactcatgttgatactgcctttatcctggccttttgtgccacatgcttgggtttgccacagtctctttgcttacctccttgttgcctttatctccttcaccagcagcacttctccatgaatgctgcc

SEQ ID NO: 18160 - DNA, 601 bp, Human
tagcttgcttccaacagagctgtcctttccttttctggagacaagtacattgtccctgtttctcctcagaagtttgagtgctgaagatgtgggccatgggcattctgaagggcctatataatccactggtttggcctcctggaaattattaaaattggagttgatagggctggtccaaacccccagcatagcacaaccccaagtgtgtgggaccagaatggtcctagaccagctccagaattccctagatccaaattgctcttctccttggccttttgtgcttcttttctgtccccgagtraaggttagtctatccaaaagctgataatggactttgataacaaggtttaaactgttcattctattctgtttagattgttttaatgtttatattttgaataggtagttgccagctttaaaaaaatgctgcggaatgttaggcatctgttaaaaagaatgagacctatctttatatactaatatggaagacctaagatcttgaagatatgttaagtataaaaagcaaggttcaggctgggtgcagtggctcacacctgtaatcccagcactttgggaggccaaggcaagaggattacttgag

SEQ ID NO: 18161 - DNA, 601 bp, Human
gtgcagtggctcacacctgtaatcccagcactttgggaggccaaggcaagaggattacttgagcccaggagttcaagaccagcctgggtaacatagcaagaccttgtctctgcagaaaataaaaaatattagctgggcatggtggtacatacctgtagtcccagctactcaggaggctgaggtgggaggatcacttgagcctgggaggtcaaggctgcagtgagccgtgatcatgctactacctatactccagcctgggtgacagagcaagactccatctcaaaaaaaaaaaaaaaaaaargcaaggtgcacagtattgtgtatagtgtgcaatgacttatgaaagatacacatgtgtgtgtgtgtatgtgtgtatacacacacaacaaaggttcatttttaaacagatggtttgggacctacaaatatattttcttacagaagtaatgctatatgttggccaggcacgtggctcatgcctgtaatcccagcactttggaaggctaaggtgggtggatcacttgaggccaggagttcatggcaaaaccctgtctctactaaatacaaaaattagctgggtgtagtggtatgcacctctagt

SEQ ID NO: 18162 - DNA, 601 bp, Human
ttatttggaaggccaggttcttatgggtaggggcatttgggaagcactcccgggaatagactctagcagtggaattcagaagtctgtcaatcattcaggtagaggagtgtgagagtatgagaataaagattgtaaatgataagttggctgggcgcagtggctcacgtctgtaatcccagcactttgggaggctgaggcgggcggatcacctgaggtcaggtgtttgagaccagcctggccaacatggcgagaccctatctctactaaaaatacaaaaattagccaggcatggtggcgtgcrcctgtaatcccagctacttgggaggctgaggtgggagactatcttgagcccaggaagcacgttgcaccactgcactccagccctccagccttggtgatggagtgagacactctctctcaaaaaaaaaaaaaaaaaaaaaaaggattgtaaatgataaataatttatggcttaggcattttcaaattgacacatgacttttccccaaataattctgtcctaaatttgaggaaactggatttacctatgaaaaatttggaaaactactcatggttctcctgtgattctgagtgaaaatgaca

SEQ ID NO: 18163 - DNA, 601 bp, Human
tgagagtatgagaataaagattgtaaatgataagttggctgggcgcagtggctcacgtctgtaatcccagcactttgggaggctgaggcgggcggatcacctgaggtcaggtgtttgagaccagcctggccaacatggcgagaccctatctctactaaaaatacaaaaattagccaggcatggtggcgtgcacctgtaatcccagctacttgggaggctgaggtgggagactatcttgagcccaggaagcacgttgcaccactgcactccagccctccagccttggtgatggagtgagacwctctctctcaaaaaaaaaaaaaaaaaaaaaaaggattgtaaatgataaataatttatggcttaggcattttcaaattgacacatgacttttccccaaataattctgtcctaaatttgaggaaactggatttacctatgaaaaatttggaaaactactcatggttctcctgtgattctgagtgaaaatgacagtaaaaatattttggagtttttaagttttaattttcagggacttgaagaatgaatcttcttatttaatccaatgattaaatctctgacttaaaaataaagagaatttat

SEQ ID NO: 18164 - DNA, 601 bp, Human
caatagtattggaacataacccaaagaataaaacaaatgcctacgagtctaatctgatataaataagtgaataaataaatacacattgggaggccaaggtgaatggatcgcttgaggtcaggagttcgagaccagcctggccaacatggtgaaaccccttctctactaaaaatacaaaaattagctggatttggtggcaggcgcctataatcccagctactcaggaggctgaggcaggagaatcgattgaacccgggaggcagaggttgcggtgagccgacatcgtgccactgcactccakcctgggcaacagagtgagactctgtctcaaaaaaaaaaaaaaaaaagagtaaataaatgagaaagaatgaacaagtcttccttacagaagaattttgattaataaatataggaggactgtgtacagtggttcacacatgtaatcccagcactttgggaggctgaggtaggaggattgcttgaggccaggagttcgagaccggcatggacaaagtgagactccatctctgcaaaaactaaaaatgaaaaattagctgggtgtggtagcagacaccggtagtcctacctacaagggaggccg

SEQ ID NO: 18165 - DNA, 601 bp, Human
ctgggtgtggtagcagacaccggtagtcctacctacaagggaggccgaagtgggaagattgcttgagcccatgagtttgaggctgcagtgacctgtgattgcaccactgcattccagtctgagtgacagagtgagaccctatctcaaaaaataaaaataaataaagaatgagaaaaataaccattagaataccacataatacttgctgcgagatctacaaatgaatgctaaaattaggtgaaatgctaagaagaaacagaatatttgcatagtctcagagaatctcccccaaaatatttaycaattactatgatgatttcgacatacgtccgcaaagtctgtgttattcctgccactggaaggtggaacttaattctcccctcagaatgtgggctagacttagtgactcacttctaacaaattgagataagaaaggaaaaaatagtaactttatagtggagtaaactggcagacatcacttgacccaaatcatcactttaacatcactggtagtaagtcatgttgatatcatgtgccccctgatacgaagctaagagaaatacagtttacctctgtgatattcttcccctaaatccataac

SEQ ID NO: 18166 - DNA, 601 bp, Human
ctaaaattaggtgaaatgctaagaagaaacagaatatttgcatagtctcagagaatctcccccaaaatatttatcaattactatgatgatttcgacatacgtccgcaaagtctgtgttattcctgccactggaaggtggaacttaattctcccctcagaatgtgggctagacttagtgactcacttctaacaaattgagataagaaaggaaaaaatagtaactttatagtggagtaaactggcagacatcacttgacccaaatcatcactttaacatcactggtagtaagtcatgttgatrtcatgtgccccctgatacgaagctaagagaaatacagtttacctctgtgatattcttcccctaaatccataaccccagtcttcaaaagtgtcaaggtcatgaaagacaaggaagactgagaaactgtcacaaattggaggagactgaggaggcatgacaactaaatgcaacatggtatcttggattgaatcttggaacagaaaaaggacattagtggaacaactggtgagactcagataggtagtagcttagtgaatagtattgtgccaatgttcatttcttagttttaataagtatatc

SEQ ID NO: 18167 - DNA, 601 bp, Human
gaaaaagcaggggaaggctgggcgcggtgactcacgtctgtaatcccagcactttgggaggccaaggcgggcaaatcacctgaggtcaggagttcaggaccagcgtggccaacatggtgaaatcccatctctactaaaaatacaaaaaaatcagctgggcgtggtggtgggtgcccgtaatcccagctattcgggaagctgaggcaggagaattgcttgaaccctggaggtggaggttgcagtgagctgagattgcgccattgcacttcagcctgggcaacaagagcgaacctccgtcttaaaaaaaaaaaaaaaacagcagggggaaagaggaactctgctctctttttccaattcttatttatgtatttacacagggtcttgctctgctgcccagactggagtgcagtggtgtgatcctagcagcctcaaattcatggccttaagcagtcttctcacctcagcctcccaagtagctaggactacagatccatgccaccacgcctggctaatttttaatattttttgtaagagacaaggtcttgcttgctctgttacccaggctggtcttgaactcctggcctcaagtagtcatatcacc

SEQ ID NO: 18168 - DNA, 601 bp, Human
tcatttgattttaaatattgctctggagaatgttaaactgaaaccgtttccagatgactatgaagattagtgctcaaagcatcatttacatgatgcccttcccttatagtgatcatttcattcactctatttcctaaaggctgcccttggagctggcttctctgacaagactcctgctcacactgtcaccatggcttgtatctctgccaaccaagccatgaccacaggtatgtttaaatggaaacagacagtacatgttaattattctcctttgtcttttacttgattataaaaatgtacttttttttttttttttttttttaacacagaacctcactctgtcactcaggctggagtgcagtggtaccatcatagctcactgcaggctcaaactcttgagctcaagagatcatcctgccttaggatcccaagtagctgggtctacaggtgctccaccacacccagctaatttttaaattttttgtggagacgggatctcgccatgttgcccaggctggtcttaaacctctggcctcaagtgatccttctacctcagcctccaaagtgctgggattacaggcgtgagccaccatgctcatcc

SEQ ID NO: 18169 - DNA, 601 bp, Human
cgtttcaacagctgtaatttctctgctttgcagcagaagttaacattctctttataggataaaaaatctttattaaaactaaagctgggagcatataaatatgcaagatgttctggtttggaatatgatttgttcaagagttggtccaatggatattcctagaagttgacgtccatatggcaggaatgaaacttgtttttctctaacgtgttgaatgtgtttttagtcatttaagaaaattaccttaattcttctgaaaagttgaaaactttaattacagatgttgtacaaagctgataaytgtcattcagctttttaatcaagaagcttaaattggaatggtatgttattttctgtaaaagatattcatgaagtataacctgtgccctgtaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgaggtaaggcttgtgtttgcagg

SEQ ID NO: 18170 - DNA, 601 bp, Human
atttcctagcacctgaggtaaggcttgtgtttgcagggcatcccactgcagagatttagaattaggtatggcagtgtggactctgctatgctgtaataggtgtagattctgtagttacaggaaagggttaattacttgctcaagatggaaaaaaaagatagtggttagaaaactttaatttgtgagccctctttagagatcctctttagagatcctctgcttgtcttggacttgattgattaatggtagacaaatagattttaacttttccaaataacacagaacaatcctaggtgttagmataacaccggttaacagtgtacctgctccttggatatctcctttcccagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggtgaaatgaaatgcttcatgacacttattagggagttctgaattgctcctaaaactcaaaaacatcccga

SEQ ID NO: 18171 - DNA, 601 bp, Human
tcaacagcgtgagacttcatctctaattaaaaaaaaaaaaaagaaaaacagagtctccttttagatcttgctgatatattttagttcttacatacatgcctgtttttaaaattcctgaatcgtctgacttctgtatagaatagccaactgtgaatgaatgtcttaagaaaatagggtgtcctatttttagtaaagcatttagatgatttcccaattgtcttttaagactttagtttaaaatttgataatatgataattataaaacactttccttctagtgaataggtaaggtttatatttyatttgtttttgtaatttttaaagcatatttctgtggagaagatatataaggcttgtggttccatagagttaaaaaaattcatttttttaataggaaaagatacagttaccaaagataatggcatccgtccttcctcactggagcagatggccaaactaaaacctgcattcatcaagccctacggcacagtgacagctgcaaattcttctttcttggtaactgtcaatgttatttgtatttagtagtgacttttctatttctgtactctctgtagaaaagcctaatataactttttgtgtg

SEQ ID NO: 18172 - DNA, 601 bp, Human
aaaattcctgaatcgtctgacttctgtatagaatagccaactgtgaatgaatgtcttaagaaaatagggtgtcctatttttagtaaagcatttagatgatttcccaattgtcttttaagactttagtttaaaatttgataatatgataattataaaacactttccttctagtgaataggtaaggtttatatttcatttgtttttgtaatttttaaagcatatttctgtggagaagatatataaggcttgtggttccatagagttaaaaaaattcatttttttaataggaaaagatacagtyaccaaagataatggcatccgtccttcctcactggagcagatggccaaactaaaacctgcattcatcaagccctacggcacagtgacagctgcaaattcttctttcttggtaactgtcaatgttatttgtatttagtagtgacttttctatttctgtactctctgtagaaaagcctaatataactttttgtgtgtgttatgaatagagggttaaaaatatagttattcattttaatgtgaaagtggagtcattaaaaaaaaaatagaatcacggttttaaggcccgagaagtcacctaatc

SEQ ID NO: 18173 - DNA, 601 bp, Human
tcttcttggaagaggtaacacttgagcagcaaatcttgaaggaagagtaaaagccaactcaggaaggattttaaaaggcatttcgggccgggtgcggtggctcacgcctgtaatcccagcactttgggaggttgaggcaggcagatcacctgaggtcaggagttcgagaccagcctgagcaacatggagaaaccccgtctctactaaaaatacaaaattagccagatgtggtggcacatgcctgttaatcccggctactcgggaggctgaggcaagagaattgcttgaaccctggaggcgyggaggttgcggtgagccaagatcgcaccattgcactccagcctgcacaagagcgaaactcccatctcaaaaaaaaaaaaaaaaaaaaaaaaaaaggcattttggacaaagggaatagcaaatgcaaaatcaaggaagtatgagagcaaggggttctttggggaaaagttaggttggagcataaggtatgaactgggaagtcgcagaagacaaggaaaagcaggcagaaagagtaacaggatacctcttccagccctgattgttagaaaactgctttacactgaccccaatattattttcc

SEQ ID NO: 18174 - DNA, 601 bp, Human
ctcaaaaaaaaaaaaaaaaaaaaaaaaaaaggcattttggacaaagggaatagcaaatgcaaaatcaaggaagtatgagagcaaggggttctttggggaaaagttaggttggagcataaggtatgaactgggaagtcgcagaagacaaggaaaagcaggcagaaagagtaacaggatacctcttccagccctgattgttagaaaactgctttacactgaccccaatattattttcctgtaagcatcatggaacaaatctaccactgtttgttttgtgttttttttttaacttatcaacatttagcttcatatccttccatgcttttctgactcctcaattaaacatctttattgattctgctgctgcttgtaagatgtgatttctcttctcttaccaccttgggtatagtcttctggatataggccatctggtcagagtttctcttacaatgtaactctcctacctggccataaagtcttgaaaacatacgcagatgtttgacatatttgcccatggtaaatgactaattaatgcctgctcttgataggctaggggagtggaatctggagtagttccaacaggatggaacaccaccctgtt

SEQ ID NO: 18175 - DNA, 601 bp, Human
aggttcaagcaattttcttgtctcagcctcccgagtagctgggacaagcaggcgcctgccaccatgcccgactaattttttttatatttttaatagagacagggtttcaccatattggtcaggctggtcttgaactcctgacctcagatgatccacccgccttggcctcccaaagtgctgggattacagatgtgagccactgtgcctggccgatttgttcaactttaaaccatacctaaagttgttaaactttcacaaaccattcctataagaaagcgtagaggaacatgaataacgaggytcttattcgattattttctcttccagggtcagattttggcaaattttaaagccatggattctgattggtttgcagaaaactacatgggtagaaaaaccaaggtgagtttctaattttaaaaaatgcgtgaattttcaaagcacgttaataattggatcttagttacctgttcttaagaatatgaagggaaagcttctctttcttttgaagaattttgtctttcattaaagatatttatttcttagtgtaaaagtagaaattcttgtatttcattaaatatatttatttcttagtttaaaa

SEQ ID NO: 18176 - DNA, 601 bp, Human
ataaccaaaagtatctccaggtgttgccaaatctgatctagagcaagaaaaaacatggaacatgaaaacagtgtgtttaaaataaagccagagagggctgggtgcggtagcttatgcctgtgatcgcagcattttgggaggctaaggcagctgggtggcttgaacgcaggaattcgagactagcctgggcaacatggcaaaacctcgtctctaccaaaaatacaaaaattagccaggtatgatggtacgcacctgtggtcccagttactcaggagggaggtgagaggattgcttgagcccrggatgttgaggctgtagtgcgctgtattcacgccactgcactttagcctaggtgacagagttgccttgtctcaaaaagcaaataaagaaattaaaataaataaaaaataaaataagcaagccagagaggagtagtctaccttattatgaattctttcaggacaacccccaagtcagtcaaaccttcctatccctgctctttttttgtctgcttgtgccttttcaatgtacttaacatgccaggtgtggtagctcatgcctgtaatcctagcactttgggaggctgaggtgggcagattgc

SEQ ID NO: 18177 - DNA, 601 bp, Human
catcactaggaattagattctgtactagacagagcctgatgcatatatgtatacatgtatatatgaatgtatataaatatatatgtgtgtgtatatatatacacacatatacaaatatactgtatgttatgtgatgcccacaaaaactctatgaagtagacactatgagccccattttgtagaggaaattccagtttagactgactacaaactttcccaagatcacagtgattgattggcagagccaggatcccactccaaagcctgtacttttctccttgttctctgctgtccctgtackaggtggattcatcaccattcattgctctaattggactttgttttctttacagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccac

SEQ ID NO: 18178 - DNA, 601 bp, Human
acagtgattgattggcagagccaggatcccactccaaagcctgtacttttctccttgttctctgctgtccctgtactaggtggattcatcaccattcattgctctaattggactttgttttctttacagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatastttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaac

SEQ ID NO: 18179 - DNA, 601 bp, Human
aattcccataaataatcttcaggcccctccagagaggaaaaatctggactctcccaggtaatagcccagccagatttgcttagctcattgagcacagatggtctgggccaccaagcaaaatagggattttcaaacctttcgagagaatccattcttgccaggtgacacacgaagccattcttatttcgttcatgagaagcagcagcacagcaagagaagattcagcaagactaagacggggtgaaaagccaaggagggccaagtgcaaagagaaacctatttcccccctcagtcctccagkgtgaaactcacctccaactatcccacctcttctttggagcgcaaaagccaggagtgcgcctcgctggagagcagggctcaggtgaagactttgaaaaggaccaccaaaagagacctctttaggccaggtcttcttccaacgtctgtcaagaagagcacgtacctcccagctcaaggttggtttgtggtctccgacaaattaaatattactgtttattaccaggcataccccagtaaaataaagaggcaaccaggcgatagcgactatctcaccagccgctgcacctataggacttggaga

SEQ ID NO: 18180 - DNA, 601 bp, Human
tcggaagaaggctgaaccgctacatctccagtagagggaaagggaaatccagaaagaccttcccaatccctttaagttctcagagatttggggataaaattaattcccataaataatcttcaggcccctccagagaggaaaaatctggactctcccaggtaatagcccagccagatttgcttagctcattgagcacagatggtctgggccaccaagcaaaatagggattttcaaacctttcgagagaatccattcttgccaggtgacacacgaagccattcttatttcgttcatgagaagyagcagcacagcaagagaagattcagcaagactaagacggggtgaaaagccaaggagggccaagtgcaaagagaaacctatttcccccctcagtcctccagggtgaaactcacctccaactatcccacctcttctttggagcgcaaaagccaggagtgcgcctcgctggagagcagggctcaggtgaagactttgaaaaggaccaccaaaagagacctctttaggccaggtcttcttccaacgtctgtcaagaagagcacgtacctcccagctcaaggttggtttgtggtctccgacaaat

SEQ ID NO: 18181 - DNA, 601 bp, Human
tatattcttacagtccagaaggataattaatcctaaatatctatattaacaaaccttccaggctctctctacaagtagttccattcacatccagctattttgattataggacacgcctgatgccatttaacattttggctttcagctaaaactaaatttacagaaccgatgcaaatgtatatatatacatatatatacatatgtgcacacacacatacatgcacacacaaactcttcattttggaataatttacaacagtctaaaaagtgggtttgcttttccttaaaagaaaaaaaaaaatccctaagtttcctaaactgtgttcacgctctctgcttctctacaaatatacacacgttttcctgaaacttaaaggccaaagagagaagccgggaaaagccaggaagggatcgaaatcccaaggcaggattttagccatgtgtaagtgtctcttctggtcgtcaccccgtttcaccccatgtgacaccttatttaaaaattaccaggatctactgaggggccgacttgagcgcccagtgcgtcctgggttttgggcgcagagcgcaaggtgaggctcctccctctgcctgggcccaggtt

SEQ ID NO: 18182 - DNA, 601 bp, Human
tcccccaaaacacagagactgctcctccttcccgctggagcctgtggtctcagagagtaaaaagtggcttcagcccactgcagaattatctggagcacccaacagcctctgcccagggatccctatgtaggctgaatccctgagggttgcaacaaccacttgaacccacagtgctgtattgtctgcttctaatgccatcagcacaaggctatggagtgatcacccaccatcagggtgctccggaatgtcactgaggaggaccggaataagaaaaaaccaaccaaacaaacaaaccaaaaamaaaaaaccagagccaatttcaatccacttcacctgagatgggtgggggggatagataaaaaacctaatttagaaaaactaggaacctaatctagaaaaccactcagaatattctcatgtagacactcagatgcccacacatcaaacatacagatgtgcaaatacttgcttattctcgaccatggtgagtgcaaacctgaacatacatgaattttgaaacctaaaaatgtttgtattatcatatattcttacagtccagaaggataattaatcctaaatatctatattaacaaaccttcca

SEQ ID NO: 18183 - DNA, 601 bp, Human
aatcaccagttctctgcacagcctttttctgaggcttagggtgggtgatcagacctcaaatctggggcctttgtttggagaacaagcaaagcagagttcgtgaaaagagaagatatttgggggtcacgggtgatctgccctccaaggatgtcggctcataaggtgtggggaggaagcaccacccacacccctcaaagaaggggctggttgccttggaaactccctttctccagctttatcacgtttcaggatccacaaccagaattatctccacgcttggccccagacagaacggctacayctgctttttcgggaatattctctttctacttcctatcttccccatatttaggggtgttcccagggacaagaggggtcctaactgctgtagttgtgctgtaatttttacaaccaccattatcattaggaagaggaggaggaggaggacttccaggctgcacgttcttgctggagccagggctagtcacagatgagcatcctcaccaataaaactgggtttgttgttctgatgacgctagtatttaccagaacgctctgacacatccccaccgaacgtgcgaatcgccgcgtttaacagcct

SEQ ID NO: 18184 - DNA, 601 bp, Human
cattaagcaacctttcttcccactaggcatttcataaggtcagtgggatgccttcttgtggtatttgagtgtgtggcccatctatggtttgacaagtttgtttctaactggtgtgggtgcatatgtgtggtggtgactgtcaagccaagctcgtggatatagtaaaaacagctgaaactcttaggctgcagctttgtccccaccccagcaccctggggtcgaagttggtgactgctgccattcagaggagcaaagttccagcaggaaaaccttgcagattcatgcaaaagaaagagcagamggccccaggcactggttcctgggcttcaggcttaccttgtggttctggtaggaagtcactgctataaacgcagtctcaggaaagacgtgagtgcagaacgctgtattttttgagccaaatccattattttcatccgctttcacgatgtgtaatctaggctggtatttgtgcatggaatttagaataatctaaaaataataaagaaaatgagattgtaagaaaatcaaaactccctttgtctccagataaaaccctgctccccgccctctaaattcgccttgttatatcggctctcgaaaa

SEQ ID NO: 18185 - DNA, 601 bp, Human
cagtgagccatgattgtgccactgcactccagcctgggtgacagacagagtgagaccctgtctcggagtgaaaaatattaaaaaggcagagaggagaaaactgaccccagcagaaacagttgcccagaaatgaaatggcagcaccagagccattaagcaacctttcttcccactaggcatttcataaggtcagtgggatgccttcttgtggtatttgagtgtgtggcccatctatggtttgacaagtttgtttctaactggtgtgggtgcatatgtgtggtggtgactgtcaagccaagcycgtggatatagtaaaaacagctgaaactcttaggctgcagctttgtccccaccccagcaccctggggtcgaagttggtgactgctgccattcagaggagcaaagttccagcaggaaaaccttgcagattcatgcaaaagaaagagcagacggccccaggcactggttcctgggcttcaggcttaccttgtggttctggtaggaagtcactgctataaacgcagtctcaggaaagacgtgagtgcagaacgctgtattttttgagccaaatccattattttcatccgctttcacgatgtgt

SEQ ID NO: 18186 - DNA, 601 bp, Human
ttccagagccttctaagcccaaatcactgcttaatactcctaacagtctacaaccgcacgagggcaggggcccctcccccagcacctattgctcgcctctccagattctagaacttttcataccaaggcttagaacattaaatccctcctgccacccacaataaaatgaatccacatgcactcgggtatctaaggaacagaggtgaatcctgacaagtcgagacaaactttctcctgaggaaaaagagaagatcctcccccaccctccaacctgccgctataggcagcctgctccaaagtyattgtcaagctttgaaatgccaaaaccagtgcctggattttgaacctcatggggtctgactttcacacaatccatgcgacagcatcccgcccctacaccaaactgcagccaccttctcccaagcaatgcaggtctgcctcccctcaccaagctgtggttctgcaggctctttgtctaagtccagcttgggagtgttatcccaagctgctggtggtgcaggttgctctgttttcattttaacaaggcaaacctttcccaagaatgtggtctggagtcagtgatttctgaaacaattaggga

SEQ ID NO: 18187 - DNA, 601 bp, Human
cttgctggttcaacaggtggaaggatactcggaaaaatcctcctacccatttaaaaaggaatggtgtcttgaggggaatgagttttctttccgagggcaggaagctctctctcgacctgggttcccagacaggctttgtggcctggaaaggactgtctatcacagcttggcctgttcacagacaatctggatttggagattagccacagcattttggaacagtcccggcctcagttggggtattctctgccaagccagcctgcactggaatgaccttcgaggggtgaggggaggatttggrgtgctaagccttcctctcatccttctccggcctctcctgtccagtccccagctcctgcagttccccctccaccccagccttgctggtggggactgtagctaagaaaagggaggggcacaccatctccacatccatctaggtgacctgccctcacagatcccatatggacccccctcccactttgcccttccagagccttctaagcccaaatcactgcttaatactcctaacagtctacaaccgcacgagggcaggggcccctcccccagcacctattgctcgcctctccagattctagaa

SEQ ID NO: 18188 - DNA, 601 bp, Human
cagccatggtggctcatgcctgtaatcccagcactttgggaagccaaggtgggtggataacttgagatcagaagttcaagaccagcctggccaacatggtaaaaccccatctctacaaaaaatacaaaatttaaaaaaaaaaatagcctggcatgatggcaggctcctataatcccagctactccagaggctaaggcaggtgaatcacttgaacccaggcggcagagattgcagtgagccgagatcacaccactgtactctagcttgggcaacagagcaaaattccgtctcaaaaaaaaamcaaaaaacaaaaaaacaaacaaacaaaaaacactttctctgtgatttcatcatattcaagtatccctaaaaatcatctcgagtctttcccagtagtatagttacagatttgagaaactgtgcttgataaatgaatgtaccctctaatttcttcatttgaagagaggaattcttatctattctgccttctggaagagatgacctatgaggtttacctctaaccccaaaattattgaaaataaaattattatatgtatgtgcacctatgtgtattcaccataaaaaatatacatacaattaa

SEQ ID NO: 18189 - DNA, 601 bp, Human
aaataaatatatgtaattgtctttactcatatccaaagcttgccttctctttgttgcaagtggaaattagacacttttagagaactagttaacacaaaccagtactgaactgagactccctctctaatagaagactagaaagataattttaaaaagaacaactttcagccagccatggtggctcatgcctgtaatcccagcactttgggaagccaaggtgggtggataacttgagatcagaagttcaagaccagcctggccaacatggtaaaaccccatctctacaaaaaatacaaaatttaaaaaaaaaaatagcctggcatgatggcaggctcctataatcccagctactccagaggctaaggcaggtgaatcacttgaacccaggcggcagagattgcagtgagccgagatcacaccactgtactctagcttgggcaacagagcaaaattccgtctcaaaaaaaaaacaaaaaacaaaaaaacaaacaaacaaaaaacactttctctgtgatttcatcatattcaagtatccctaaaaatcatctcgagtctttcccagtagtatagttacagatttgagaaactgtgcttgataaat

SEQ ID NO: 18190 - DNA, 601 bp, Human
gactttctagagcccaaaagaaggaatgggggaagagatctggggagtagcgtgaatgtggctggttgatgggtgtggtggtagtggggggtgggactcatctttttgtgtttgtttttttaagttttgagacaaaacaagaaagtcacatttttaaaattgtggtttcaagctactgattagatcagcatccagcgaccttgagtgcagatgtgaacattgggtgaaatgaaaaatcttgtccgtggggttctcttggctactgtctctctccttctctctctttctcctctctctctcyctttctctaggaaatgtctgttgtgaagcaggcctcactttagctattgtcgctccactctggcaccatgccaactccgtgcacagagtggtactgatgaggggatagagtccttggcacgccatgagagtagaggaactcagggggctgaagggtgccaggggactgcaggccagtctgaggcccacactgcctgaccacaggctggtgggccacggaggtctggtgctggaacattccctctcccagctgtggggagccatggttggccatgccagccagccgagggaccaggggccc

SEQ ID NO: 18191 - DNA, 601 bp, Human
cctctttgccgttcagcacgggaactgcttccagaggcagctgcccaacatctgggccacattaacttcatttagcaaatgaaacattccctggggctagggaaggggtgtaaggggggcatggatgagaccttctcccccacccccgcaggttctcctcccctctgggctgagcgggctgctcagtgtgatgtagcctcctccctccttattcactatgtcctccttcctcccatcgtgatattactaaagcttcttttaccaggaagttgcaattctgcaactgaatgctggaagaagrgagagctgaatggggaggggggccttgggtagccgaaagccttcaggagcagaggaaggtcaggacagaagccctagtgtcactcaaagggtgcttcccccttttcctccttccctcctttccaacccaaagcaagagaaaatgcaggtatctctggcccagagaatctggggaaaaagaaaaccttcttggagggtctgtcctgctccctatcccccatttttcatccctcttgatctgtatagggactagccatgcagctgaggtgggctggggcctgaccagacaaagcccttaggt

SEQ ID NO: 18192 - DNA, 601 bp, Human
ctttgccgttcagcacgggaactgcttccagaggcagctgcccaacatctgggccacattaacttcatttagcaaatgaaacattccctggggctagggaaggggtgtaaggggggcatggatgagaccttctcccccacccccgcaggttctcctcccctctgggctgagcgggctgctcagtgtgatgtagcctcctccctccttattcactatgtcctccttcctcccatcgtgatattactaaagcttcttttaccaggaagttgcaattctgcaactgaatgctggaagaagagasagctgaatggggaggggggccttgggtagccgaaagccttcaggagcagaggaaggtcaggacagaagccctagtgtcactcaaagggtgcttcccccttttcctccttccctcctttccaacccaaagcaagagaaaatgcaggtatctctggcccagagaatctggggaaaaagaaaaccttcttggagggtctgtcctgctccctatcccccatttttcatccctcttgatctgtatagggactagccatgcagctgaggtgggctggggcctgaccagacaaagcccttaggtcac

SEQ ID NO: 18193 - DNA, 601 bp, Human
cattccctggggctagggaaggggtgtaaggggggcatggatgagaccttctcccccacccccgcaggttctcctcccctctgggctgagcgggctgctcagtgtgatgtagcctcctccctccttattcactatgtcctccttcctcccatcgtgatattactaaagcttcttttaccaggaagttgcaattctgcaactgaatgctggaagaagagagagctgaatggggaggggggccttgggtagccgaaagccttcaggagcagaggaaggtcaggacagaagccctagtgtcactcaaagggtgcttcccccttttcctccttccctcctttccaacccaaagcaagagaaaatgcaggtatctctggcccagagaatctggggaaaaagaaaaccttcttggagggtctgtcctgctccctatcccccatttttcatccctcttgatctgtatagggactagccatgcagctgaggtgggctggggcctgaccagacaaagcccttaggtcacataaccagatttcaaagatgcaaatgtagaatatttatgggtgactgttgtgctccttgtcccctggggcaggcctgggga

SEQ ID NO: 18194 - DNA, 601 bp, Human
tgacttcaaaaaaccaaaggtgaactggctggtccattttttaggtaattttttgaataatcaaaccttggagagccctctgttcttcttcctcccctgagttggctgttccaggcaagctggcagtgcctggaaaaacaactggttgggctcggctttccccttggtcctagaggaccggagctcttgggtgtgtatagtgagagcttggctgggtaagaggaaaacagccaacgtggatgagcacggagttttgggcccatctgcatagggtgtgttcttggagggttggataccgacrcgggttgggttgctgtgctctctctggtccataaatctagcaaagaggcgggctttatacagagactcaacgcgtagtcttagtctcaacagtgacatgctggagtctagaacctcccaaactcatttggtgttgagaattgcctgaggtgcttgttaaaaataaagcttcccgggatggatcctgggtctgttacatcagaatggatatttatgatagcaagtttggcaaacattgctaattgaagggccactggggttgggtcaaggtggatggaggtggagttaaggttgccagata

SEQ ID NO: 18195 - DNA, 601 bp, Human
ctgggtaacacagggagatcctgtctctaaaaaataaatctagattacagaacatccacttaaatttgaattaaaaaataatttttagtataagtttgtcccaaatatttgctaaatttggcaaccctacagtggagggaaatactaggaattcttatataagcctgagtacaccctggaaggtgggccagcttcccacttagcctgacaaccaagggtgacagaggaagaaggagtttgagtctagcaaagtagaggaagactctaataggatttccttctcattttcttctctgcaacygcaggagcaagatataggccatgatttacatttctttataatcacaaacataattttattctgacttgtcttctttctatttatttttaatctggaggacaaatgttcatcttgagagttttgctccaatttattattgtaaaaggaagtataatattaagagtgctcctcttcttgtaaacaatgaaatgtgaataccaacaactataaacaaaaatgcttcatgttcctcccctcctcctttctgccctcttcattcttttctctttgcatgttcaagtgatttcttgtcctcaccag

SEQ ID NO: 18196 - DNA, 601 bp, Human
atttccttctcattttcttctctgcaactgcaggagcaagatataggccatgatttacatttctttataatcacaaacataattttattctgacttgtcttctttctatttatttttaatctggaggacaaatgttcatcttgagagttttgctccaatttattattgtaaaaggaagtataatattaagagtgctcctcttcttgtaaacaatgaaatgtgaataccaacaactataaacaaaaatgcttcatgttcctcccctcctcctttctgccctcttcattcttttctctttgcrtgttcaagtgatttcttgtcctcaccagatgagttaatcaagacagcaatggatgggagatgttttggtggtgctctggggtaaaaaaagtactggggcatattgactctcgctctccaagaagagtatgaaataatagtagttattgtggtaactgtaaaaaagagtcacctgccaggtgtggtggctcactcctgtaatcccagcagggccaaagtgggcagatcacttgaggtcaggagtttgaaaccagcctgaccaacatggcaaaaccccgtctctactaaaaatacaaaatta

SEQ ID NO: 18197 - DNA, 601 bp, Human
gaataccaacaactataaacaaaaatgcttcatgttcctcccctcctcctttctgccctcttcattcttttctctttgcatgttcaagtgatttcttgtcctcaccagatgagttaatcaagacagcaatggatgggagatgttttggtggtgctctggggtaaaaaaagtactggggcatattgactctcgctctccaagaagagtatgaaataatagtagttattgtggtaactgtaaaaaagagtcacctgccaggtgtggtggctcactcctgtaatcccagcagggccaaagtggrcagatcacttgaggtcaggagtttgaaaccagcctgaccaacatggcaaaaccccgtctctactaaaaatacaaaattagctgggcgtggtggcgcaggcctgtaaccccagctactagggaggctgaggcaggagaattgcttgaatccgggaggtggaggttgcagtgagccaagatcgtgccattgcactactctagcctgggcaacaagagcgaaactccatctaaaaaaaaaaaaagagtcacttatatttgcatttatttgcttatactgtgtcctaaagcaggggctccaatt

SEQ ID NO: 18198 - DNA, 601 bp, Human
tccctgtccatggaaaaattgtcttccctgaaaccagtccctggtgcctaaaaggttgggaacctctgtcctaatggatttcagtatagttaacttatgttgagatttttatattttgaaagcatttcacattcacagtcttcttttacttcctgaccaaccctgtgaaataggcaggataatgacaactattcatgttgtactttcccaatttccaaaatgggattaatggagaatggtaccaagagcgtgtgtcaccctcccaggagagggaggtaattcagccagctcgcagggcgcyggctggaacctcccacctctgtgctcaggcccttcccctgggtcttggctatttttgccctttttgtgtaacatccggtttccctgggaactgaaactttaatatccacccctcccccttctagctttcttcctgcataacctggagacattctttctaccttctcagcctgggttaccaagaaagggaatgttgcccaagtatgttgaggtcactgccttggtgctcttctggaacagagggctctcgtggagagcttggctgacgagcaggcctgttatattcctgacctctgatgtc

SEQ ID NO: 18199 - DNA, 601 bp, Human
gggattaatggagaatggtaccaagagcgtgtgtcaccctcccaggagagggaggtaattcagccagctcgcagggcgctggctggaacctcccacctctgtgctcaggcccttcccctgggtcttggctatttttgccctttttgtgtaacatccggtttccctgggaactgaaactttaatatccacccctcccccttctagctttcttcctgcataacctggagacattctttctaccttctcagcctgggttaccaagaaagggaatgttgcccaagtatgttgaggtcactgcctyggtgctcttctggaacagagggctctcgtggagagcttggctgacgagcaggcctgttatattcctgacctctgatgtcagcaaccacaaagggagggagggaggcagttttgtttttcagtgtttaatttttctaaggaaactcataacaaaccattaggactgtcagcacatcttagcgcttcaaaccctcttctcattaggactgccacattagaaaataggagtcaggaaactcccgtctaatgcattctctccctctgctgatggagcctgaagatgcatgaaggccttgctgct

SEQ ID NO: 18200 - DNA, 601 bp, Human
ctccttgtggcccagtccctcttctggcattatggctgccaggttgcttgagggggctgaggaggcagatgtcatccatccttctccatccctcgcacatgcccaccttgcatcctgttccctacctggggcattctctgttgtggctcctccctaggaccattccttccacacttttccttttccgtgccttgactctcactctatacggaatgtagtaaagcttattttatgatgataattacagtcagacaatctagctggcctctcagttctgccacttcctagctctgcaactttsagcaaattccttaatttatccaagcctcagattccttacctgtaagattgggttccttatttgtgaagcctccaaaccttaggtttctcccttgtaaaattataatagttccagcattatggaactgtcaggcatattgcaataatccatgtaaagtgctcaccacagtgcctgacatacagtaagtgttcaataaatgtcaacactagttgttctgggatattggtgtgggttatccagcagacatttggaagtgctggttggggatgtgggtaggggtggggttgaggagagcccgaa

SEQ ID NO: 18201 - DNA, 601 bp, Human
cctctgtgccaggtgctgtccaatgcattttatgtggattgtcttatttagcctgtgtgacatccctgtgagggaggtaccataattactattattttaagtaacttttattgtgggaaaatatacataacatagaatttaccatcttaaccattttgttttgttttgtgagatcaagtcttgctctgtcacccaggctggagtggagtggcacgatcttggcttgctgcaacctccacctcccaggtttaagcgattctcctgcctccgtctcccaagtagctgggactacaggtgcacrccaccacacctggctaatttttgtattttcagtagagacggggtttcactaggttggccaggctggtatcgaactcctgacctcaggtgatctgcccacctcagcctcccaaagtgctaggattacaggcataagcaactgtgcctggcccatcttaaccatttttaagcatacagttcagtggcatgaagtacattcataatgtcatgaaacccctcaccaccatctatctccttaactcttttcatcttgtaaaactaaaactctgtacccatcaaaacagtaattctctattcctcc

SEQ ID NO: 18202 - DNA, 601 bp, Human
tgggaaatgagaggggccaagacacacacagtccctgactacatggatctcacagtctagcccgtgtcaaatacagtagcttccaaactgttttgactctgacctacagaaagaaacacactgtactgggtatagttatttattatatgtgttattctccactctcctccaacaatataagaatttcacaaaacaaccctttgactatttgtacactttcatattttctattctattctattgtattttatttaacaaaatgatggttgacacctgctaaattgattttgggacccacaartgtgtggtattccacagttaaaaaatgctggtctaccaggcatcttactgtacaggctctccttctagctacaactccatgaataggccttcttgatatctcaatttctcttttctttttcctttttttttttttggtagagacggggtctagctatgttgcctaggctggtcttgaactcttggcctcaagcagtcctcatgccttggcctcccaaagtatcaatttcccctttctgtacaacggtcctaagggattatcccaggaaagaccacaacaatttgtttatgctccaatgta

SEQ ID NO: 18203 - DNA, 601 bp, Human
agtgctttgtgtgtatgaacttacttaagtctcacaactcttatgggatatgtgctatcctggcccctctttcataggttggattgagaggcttgccaaaggtcccatgactagtacagagggcacctgggatctaagctcagggagtcttgtttccagctcaatctcttatcttctaggttagctggatgggggtaatgttgatggggagcttcagataatttgaggattttggagtctgaactgtctgggtaactgtggttgtatggaactggccttggcataccactatctatatttktcccctctctttcctcccaattcccatgctgccttttccatgaaggtgtctgcttaaattatctcccatccctccccagtatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgtgagtttggaggacttggagtgccaggtgtggctggcatagatcaaaatgggaaagg

SEQ ID NO: 18204 - DNA, 601 bp, Human
acagtctgtgatgtgagtttggaggacttggagtgccaggtgtggctggcatagatcaaaatgggaaaggaagtgactgaactctggggatttctggtgtaaaatgagatgagaactaagcagggcttcctgcagttatgagtagtaagttgctcctgatattcagccttggcttagatccactccctggcctgagctgacatttctttgaacctcagtggtctcagatgttcccaggggagagcatcttcccatcttcagagttacttcagagttaaggctgagttaacttaacctcagsaaagtaggcagatgttcagatgagatttcttctagcccagatcagctctgtggatgcacgtcagtttctagatgagcaatgtgactgtcattagaagagttaagtttggagtttaagaagatctcattcagctgcttgaactaatcagctatgagactgttttctgaagagaatgaaactcctgaactggaaagcttcagcttcggttccaaggactgggactgagacccttgttttgaagaaaaataagctgtccagccctttagccagggagcaccttgggtctctgttctctaccag

SEQ ID NO: 18205 - DNA, 601 bp, Human
aagtaaaatctaaaatgtaaaacactccagtctctccacgactttccttattggtcgtttctcctccgcttctgcctaaggggagaggggttggtgggaggggaggaaggaggggaagaaaatagatctttggatacgctgatcctttctattgacctatctgtctctcaggcacttgtgcaaacatcccatgttagaaatattgtcctgaaacatgctttattgcataagctatgaaatgtgtgggaactgaagtagatcctgagcttatgattgaccaccatgtgggattgtgtggtgsaaaatagtgctttgtgcatcttgctgataattataatcaggccaaagcagggtgtttatatgatcacaggttctgttcagtttgagctggtctatttcatatgtggagtgaaaaaacagccttttattatttattgactgtaaaccatgtctctgcatccagctagatatgtcacaacgatactattcccgtgcttgtgtttttgctttgcagaccttcatatagggaaggctgaggaactccagattgcaaaagcataagacacccaatttgggtattccttggcagggcagggaacaa

SEQ ID NO: 18206 - DNA, 601 bp, Human
aaatggtgtaatgctcttgttaatgttagcactattttgttaatcactgttactactattggtgctactgttattttttggattctagatctttgctatccaatatggtaggctttagccacatgtggctatttaaattaaccaaaattgaaaaattaaaaattcagttcttcagctcatcagtggccacatgtagctagtggctgctatattggacagatctagaacatttcaacgtgatagaaagttctcttggatagcactgccacagagagtccctgctgacagattggggattatrattttaagtccttctactcagcagggtactgagttgtccttctcattgcaaaattcagtaaaatcttgaggcccactgataatctcaaactagtttctccttgccccaagaaccactcctggggtactttcccagctagaagttgaactaatgttaatgtagtctttatccgcagacatgttggcaacactctcagagggcaaatagtcttgagttgttcctggggcactgaggatgggtttttactgggccataatcactgtggcttaatccctcttgcgacagacacaagttggttgg

SEQ ID NO: 18207 - DNA, 601 bp, Human
ggccacatgtagctagtggctgctatattggacagatctagaacatttcaacgtgatagaaagttctcttggatagcactgccacagagagtccctgctgacagattggggattataattttaagtccttctactcagcagggtactgagttgtccttctcattgcaaaattcagtaaaatcttgaggcccactgataatctcaaactagtttctccttgccccaagaaccactcctggggtactttcccagctagaagttgaactaatgttaatgtagtctttatccgcagacatgttgrcaacactctcagagggcaaatagtcttgagttgttcctggggcactgaggatgggtttttactgggccataatcactgtggcttaatccctcttgcgacagacacaagttggttgggactgggttacgggtgtattgtgtggccaaacagagagattataattgttttctggggatgacccttgactcagattggcttcattggcattggggttcttttttttttttgagacggagtcttgctctatcgccaggctggagtgcagtggtgcgatattggctcactgcaacctctgcctcc

SEQ ID NO: 18208 - DNA, 601 bp, Human
tggggcactgaggatgggtttttactgggccataatcactgtggcttaatccctcttgcgacagacacaagttggttgggactgggttacgggtgtattgtgtggccaaacagagagattataattgttttctggggatgacccttgactcagattggcttcattggcattggggttcttttttttttttgagacggagtcttgctctatcgccaggctggagtgcagtggtgcgatattggctcactgcaacctctgcctcccagttcaagcaattctcctgcctcagcctcccgagtarttgggactataggcatgcgccacgatgcccagctaattttggtatttttagtagagatggagtttcaccacattggccaggatggtctcgatctcttgacctcgtgatcctcccacctcggcctcccaaagtgctgggattacaggcatgagccactgcgcccagccagcattggggctctaatcagttgagctaatccatgcagatactcacttcgatactgatattaacctttaaaaaagctcacttagaaaggtcgatctgtgtctttctaaagcatgtcagtaacataaaaatgac

SEQ ID NO: 18209 - DNA, 601 bp, Human
catgcagatactcacttcgatactgatattaacctttaaaaaagctcacttagaaaggtcgatctgtgtctttctaaagcatgtcagtaacataaaaatgactgctttttttattatctacgacattgtttcctttactcatgctgtcaaaattttagagagagtttggaaggaagtgttatcagaatgattaggggagagcaagagatcagatacacacagatgaaagcacaaacagcaaccatttgaattagggggtgaggcaggagtttcacttcattttactatttaaagtatttayatctaattcaaagtaccaaaggaaatgggtaaatttgaagtgggagacccctgggaagaaggttggggactgagggagagagggtggtcccaggagaggagtacggctggaccacgggggcacccccagtcctcctccatggcctgatggttcctggtctggtgtgaggcactgcggcaggatcccagccagagcatgtttcttttggctgctgccccactaaagccacaaaacaaagctgactgggtcagaagccccagttcctgcctctcaccagtgcaagaacagctcctcctcagt

SEQ ID NO: 18210 - DNA, 601 bp, Human
ctgcggcaggatcccagccagagcatgtttcttttggctgctgccccactaaagccacaaaacaaagctgactgggtcagaagccccagttcctgcctctcaccagtgcaagaacagctcctcctcagtgcattccagtctaatccatgagggaaccagggcagccattgccgcctccctctaccatgtcttgctagggtgtcaggtgcccacccagcctcaggtctagaccctgtggtgccatcatcacatcctccagtgacagatactcaggggcgcacatcattgagcacttgctctrtgccatcatttggtccatatgagtgaacaaggggtcatgcatgatccctgacctctccaagcttaaagccccactcaccattgccccttgccagagctgctggctctatgcttcattctttgctataagcaggggctcaggaggcaggtgttctgtgactcggccatttccctagcccatggcctgtaagcatggcggctggttccctggccatccccgttgtcccctccctactttgggcctggtcttcatggttgctcatgatcaacattcctgcctcaaacatcaagaagtgcatca

SEQ ID NO: 18211 - DNA, 601 bp, Human
cctgacctctccaagcttaaagccccactcaccattgccccttgccagagctgctggctctatgcttcattctttgctataagcaggggctcaggaggcaggtgttctgtgactcggccatttccctagcccatggcctgtaagcatggcggctggttccctggccatccccgttgtcccctccctactttgggcctggtcttcatggttgctcatgatcaacattcctgcctcaaacatcaagaagtgcatcatcctcaagggagttttccacttgccacagccacagatcagtcaggcrgcttctgtgagccagattctgtgctgttgtggagtaggatagagaggcgtgaataagacagttaaccaaggataattcccaacatgaggttgaatctgacagatccaggaagtgtggagtgctcagggaatgttataggagtccactggagcgagacttgactggggacagggtaggcctgggtggcttcatggaggaggtgggatgtctgacagatctcagaggaggggcaggctcaggacagacaggagtggagcgagcatcagcccagaaggtctagctgtggggctcgtgttccca

SEQ ID NO: 18212 - DNA, 601 bp, Human
tttgctggaagggtgccagtcctgtgacattaccacactgtggctaccttttaagggctaaccctaccaaggcttggggtcagcctgctggctctgacctgtcacttccactcccaacctcactccctggctggcccatcttgtcaaagatcactttgtttagcctcacaaaggaaacactatgggacaagagtttctgaggaggcggaggcctctgagtgctgccaggcccctgtggtgtcggtctttcccatccaggagccgtggccaaatgcagggtgtagtgaaaggccggggggcrggtgggggggcagctctgctggctggcgcactcctcccccagctgctgtgaggttggccgatagcagctcacagctgccccttctgtgaagaactgccctcggctgacaggagctgtcttgcccctagatgttggccaatgactgatggagaaggggttactcaaggctagactcttcgcctcagggtgggcctggctttgtggtgccattcacgtaggatcaggctggagggcatctggctgagaccacattcctgccagctctgcctcttgccatgtcctgtttccctccctcctctc

SEQ ID NO: 18213 - DNA, 601 bp, Human
cagcccaacatctctactttccagatatacttggcagctggggcagcttgggttatgtccgccatccttcctgggaagcagacatttctttccatgcccagcccatagtgcagtggcatgatcatggctcactgcagccttgaactcctgggctcaagtgatccttctgccttagtctccgaagtagctaggactacaggctcttgccatcatgcccggataattttttaaaaatttgtagagacgggatctcgctatgttgcccaggctagtcttgaactcctgggctcaagtgatcaayctgcctcggcctcccagagtgttgaggttacaggcatgagccaccatgcttggcctttgaaggtttttaagcaggtgagttacatgatcaagttgactcatactttaaaacggtggttctcaactgggaggaaggagctattttgtctcccagggcacatttggcaatgtctggtgatatttttgattgttataactggaaaggtgctactgatgtctagagggtggagctcaaggatgctgctaaacatcctaatgtacaggacagtcctccccaacaaaaaattatctggccccaaat

SEQ ID NO: 18214 - DNA, 601 bp, Human
aggagctattttgtctcccagggcacatttggcaatgtctggtgatatttttgattgttataactggaaaggtgctactgatgtctagagggtggagctcaaggatgctgctaaacatcctaatgtacaggacagtcctccccaacaaaaaattatctggccccaaatattgaaaagtaccaaggttgagaaatcacattttacaaagagaatcctggccacagaggaattgacaatcacctggagaaggggagatgacttacttatctagagacaggaccaggctgaggacagggcatgkaaatatctacagtgaggcccatccacccttcgcttaaatagttcagaacatttgactcctaaaatgttccttccttgaaatttctcattgagatcaagcctagttactggactttccataacttctttcttactactttggtctcttttcttcctccactggtcaatttgaagaatattccattaaaactggctccatcttctgttggttaaggccattttctctgtaagttagagacatcttctggaaagaccatattagtataaatagggaaaagcattgcttatgacactgcataga

SEQ ID NO: 18215 - DNA, 601 bp, Human
ttttctctgtaagttagagacatcttctggaaagaccatattagtataaatagggaaaagcattgcttatgacactgcatagaggctaagcacttgggatctgaagtcacagtgacttcagtttgagtcctgaccctgccatttacaaggcatatggccttgggaaagttacttaacctctctgacctcaaagggttgttataacaaatgaaaaggataacatactaaagaacttgcggctgggcatggtggaccagctggccgggcctgtagtcacagctctttcggagggcaaggcacrtggatcacctgaggtcaggagttcaaggtcaggctggccaacatggtgagaccccatctctactaaaaatacaaacattagccgggcatggtggtgcatgcctgtagtcctggctacttgggaggctgaggcaggagaatcgcttgaacacgggaggtgggggtttacagtgagtcaagatggcgccactgcactccaacctgggtgacagtgagactctcaaaaaaaaaagaaagaacttggcacaagcccacaagcctaggcaatataacaagactcccatctgtacaaaaacaaaaa

SEQ ID NO: 18216 - DNA, 601 bp, Human
cctcaaagggttgttataacaaatgaaaaggataacatactaaagaacttgcggctgggcatggtggaccagctggccgggcctgtagtcacagctctttcggagggcaaggcacatggatcacctgaggtcaggagttcaaggtcaggctggccaacatggtgagaccccatctctactaaaaatacaaacattagccgggcatggtggtgcatgcctgtagtcctggctacttgggaggctgaggcaggagaatcgcttgaacacgggaggtgggggtttacagtgagtcaagatggcrccactgcactccaacctgggtgacagtgagactctcaaaaaaaaaagaaagaacttggcacaagcccacaagcctaggcaatataacaagactcccatctgtacaaaaacaaaaataattagccagctgcagtggcacatgcctgtagtcccagctactcaggaggctaaggtgggaagatcacttgagcccaggagtttgaagttacagtgagcaatgattgcaccactgcactgtagcctgggtgatagggtgagactctgtctcaaaaaaaaaaaaaaaaaagcaaataaataaaaa

SEQ ID NO: 18217 - DNA, 601 bp, Human
tataacaaatgaaaaggataacatactaaagaacttgcggctgggcatggtggaccagctggccgggcctgtagtcacagctctttcggagggcaaggcacatggatcacctgaggtcaggagttcaaggtcaggctggccaacatggtgagaccccatctctactaaaaatacaaacattagccgggcatggtggtgcatgcctgtagtcctggctacttgggaggctgaggcaggagaatcgcttgaacacgggaggtgggggtttacagtgagtcaagatggcgccactgcactccarcctgggtgacagtgagactctcaaaaaaaaaagaaagaacttggcacaagcccacaagcctaggcaatataacaagactcccatctgtacaaaaacaaaaataattagccagctgcagtggcacatgcctgtagtcccagctactcaggaggctaaggtgggaagatcacttgagcccaggagtttgaagttacagtgagcaatgattgcaccactgcactgtagcctgggtgatagggtgagactctgtctcaaaaaaaaaaaaaaaaaagcaaataaataaaaagaaaaagaacttgg

SEQ ID NO: 18218 - DNA, 601 bp, Human
ggtgctctgtgtgcactttccctctctgcatttggaataaccccatgccctggatctctcctttccttctttccctatgctacaattttcctgtcttgtgcatgtgccctcagagccctgcttctcatcctgcaaggtaacacctagctgatttgagaaatggaagtggtggctgctttgttagtgggacgggaccagctcttccaaactggaccctatgttgttgtctaacccaactgggtggccacgatgacgacaatggtagtaggcctctcaggtcaggtaggagaggcgagcagckctgtgtcaggtcaaagggagagagttttggggcctgtgaggccttttgccatcatcaagtcacaccgtcaaggctactgagtgccctgtgtaggttcagggctgtggctttgtgctgtgtcagccaaactagaagggctaaagagcttgcttctagttcttagactagaaggaactaagtcttctaagcctcctaccctttctcttgcctttctcagaaggcagaggtattcagaaaagggcaagagagagggcaagaggcccaggagacttagttcctgagaatcttttgctctacagt

SEQ ID NO: 18219 - DNA, 601 bp, Human
cctcatgcttgttttaatgctctgccatcactgtcttgacattcttagtaatctttgaacaagggagctgacattttcattttgcactgggcccccaaatgacatgactggttctgactttatagttctcagaaatggcatagggttcaccatcctggcacagccctggatgggacgggaagtttaatgaaggacctgggaggcttctggctgccaggtgctgcctacaggtgagggggacactcccacccctgaactccacacttgccattcaggtccccaggattgtcttacaggcgctcgcgcgcgtgtgtgtgtgtgtgtgtgtgttttaatggaggtggagcagctttctgaatgcatggagatcagagctggactgggatacgcttaggcttgctccttctttgccttaatcactgtgtcctctctccttcagagaatgtgtggagtgtaagaagtttgaccggggagccctacatgacgaaaatacctgcaaccgttactgccgtgacgagattgagtcagtgaaagagcttagtaagttcagcacatcttagagttgcacacacccaggttctaaatgtttctaattcaatcc

SEQ ID NO: 18220 - DNA, 601 bp, Human
cttgttttaatgctctgccatcactgtcttgacattcttagtaatctttgaacaagggagctgacattttcattttgcactgggcccccaaatgacatgactggttctgactttatagttctcagaaatggcatagggttcaccatcctggcacagccctggatgggacgggaagtttaatgaaggacctgggaggcttctggctgccaggtgctgcctacaggtgagggggacactcccacccctgaactccacacttgccattcaggtccccaggattgtcttacaggcgcgcgcgcgygtgtgtgtgtgtgtgtgtgtgttttaatggaggtggagcagctttctgaatgcatggagatcagagctggactgggatacgcttaggcttgctccttctttgccttaatcactgtgtcctctctccttcagagaatgtgtggagtgtaagaagtttgaccggggagccctacatgacgaaaatacctgcaaccgttactgccgtgacgagattgagtcagtgaaagagcttagtaagttcagcacatcttagagttgcacacacccaggttctaaatgtttctaattcaatcccagaacc

SEQ ID NO: 18221 - DNA, 601 bp, Human
tatagttctcagaaatggcatagggttcaccatcctggcacagccctggatgggacgggaagtttaatgaaggacctgggaggcttctggctgccaggtgctgcctacaggtgagggggacactcccacccctgaactccacacttgccattcaggtccccaggattgtcttacaggcgcgcgcgcgcgtgtgtgtgtgtgtgtgtgtgttttaatggaggtggagcagctttctgaatgcatggagatcagagctggactgggatacgcttaggcttgctccttctttgccttaatcacygtgtcctctctccttcagagaatgtgtggagtgtaagaagtttgaccggggagccctacatgacgaaaatacctgcaaccgttactgccgtgacgagattgagtcagtgaaagagcttagtaagttcagcacatcttagagttgcacacacccaggttctaaatgtttctaattcaatcccagaacctatccaactcccacctgtaaaatggaagcgtgacttctacctcagggaatgttgtgcaggcttgaggaacaatggacacttgatgtgagctggtgtctctgagagttgtcctc

SEQ ID NO: 18222 - DNA, 601 bp, Human
cagagcccacagactcagcaagagcctgcaaagcaaagggagcaagtgcctccctaaggaagggaagagaatgtatcccattttacagatgaaaaaactgaggcacagagctgggaagtggttgcctgtgatagtcatcatcttagctcagtaggctagtaagcgtttaccaagtttacttaactaaaagtgttatgcagtgcccaagattttgcttaaagctttgcagtttggagggaaaccttcaaccttatggataggcaaccaaaagctttatctgaagtccttctgcctctctggrgccccttttgaaataagacagacagaaatacaaacaatagggagaaaaaaaatcttgcctgcaattattcttgaagtattctctgtccttcatcttaacttaaaaggagatgatctttgctgctgtcatcacatctgatatagttatgtgggccagcgaggcattgagatggtactctagtactagagagatggcaatctctccatagatagcaatctcccatgaaggcagaaacacatttcagagagagccacagtaagacacagccagccagtcagcttcctggtgggcgtgttatag

SEQ ID NO: 18223 - DNA, 601 bp, Human
aaatagaacagctgcataagcaaactattaagaatcactaagcaagcagagaaaggaaagagagggaagagtacacctactatatgttaggcactgttcactttatgctgtttagttcaccgaccttgtgaggtgggggtatcattttctttttatagatgaagaaagacttgatgaggtcaggtaacttacccaagatcacacaacgggtaggtagtgaagccaggatttgaattaaattgtgtaatactgttatatcatgtccctttcagaggaaggattaggaaccaaaaagggcctrtgcagtacaaaatacatcagtgagtgtcagtgagtggcaactgccagacacaacagccaccttgaatctaggcatcgtgcacatgaggcacagggtttcctgtcacatacttccctggaagtcctgtgataggggtttggagtggtcccatcttccagtagttgtctcactttttattcctccattttccctactcccagaggacactggcaaggatgcagtgaattgtacctataagaatgaggatgactgtgtcgtcagattccagtactatgaagattctagtggaaagtccatcct

SEQ ID NO: 18224 - DNA, 601 bp, Human
tcaccgaccttgtgaggtgggggtatcattttctttttatagatgaagaaagacttgatgaggtcaggtaacttacccaagatcacacaacgggtaggtagtgaagccaggatttgaattaaattgtgtaatactgttatatcatgtccctttcagaggaaggattaggaaccaaaaagggcctatgcagtacaaaatacatcagtgagtgtcagtgagtggcaactgccagacacaacagccaccttgaatctaggcatcgtgcacatgaggcacagggtttcctgtcacatacttcccyggaagtcctgtgataggggtttggagtggtcccatcttccagtagttgtctcactttttattcctccattttccctactcccagaggacactggcaaggatgcagtgaattgtacctataagaatgaggatgactgtgtcgtcagattccagtactatgaagattctagtggaaagtccatcctgtatgtggtagaagagccaggtgagtgaaccctgacggctcccggccctgccccaggagggagagggagaaccatgttaggcaggaatctctactcatcgaagctgttaagcaaaa

SEQ ID NO: 18225 - DNA, 601 bp, Human
aggatgcagtgaattgtacctataagaatgaggatgactgtgtcgtcagattccagtactatgaagattctagtggaaagtccatcctgtatgtggtagaagagccaggtgagtgaaccctgacggctcccggccctgccccaggagggagagggagaaccatgttaggcaggaatctctactcatcgaagctgttaagcaaaacaggttaagcctgcaagtgataagttaggggccaggtgtggtggttaacacctgtaatcccagcagtttggaaggccatggtgggtggatcgtctgrggtcaggagttcaataccagcctggccaacatggtgaaaccctgtctctactaaaaatacaaaaacattagccgggcatggtggtgcatgcctgtaattccagctccttgggaggctgaggcaggagactcacttgaacccgggaggcacaggttgcagtgagctgagatcgcgccactgcactccagcttgggcaacagagtgagactctgtctcaaaaaaacaaacaaacaacaacaacaacaaaaaaaaacgataagttagggaccgtcatctgggtgaagggcatttataaataca

SEQ ID NO: 18226 - DNA, 601 bp, Human
caagtgatccccccgcctcagccccccgcaaagtgttgggattacaggtgtgagccaacacacagggccaacatttcctatgttgttgctctggaattctaggctccgcctccctgctcatctcccagctccaatcatttcctggctttgagtagaatgttgcagctggggcctcagacagtgggggagatgattctctttctcttccccaactcatgctcttgcagatgctctctttgaagggctaagccactatagggcagtaaagacaacactgccaaaagttttggcattggccaartggaatttaaccacatggaatgggctcttgagctgggctcttatcactcccagatggggttaccaaataaaatacactaggtcccatgcagtatttggtacacaatgatagtaaaaaataatcatttatctgaaattcagatttgtcttggcttcctgctttttttgttttgtttttgtttttgtttttgtttttgttttgagacagagtcttgctctgttgcccagggtggagtacagcggcgtgatcttggctcactgcaatctctgcctcccaggttcaagcaattctcctgcctca

SEQ ID NO: 18227 - DNA, 601 bp, Human
gtgttgggattacaggtgtgagccaacacacagggccaacatttcctatgttgttgctctggaattctaggctccgcctccctgctcatctcccagctccaatcatttcctggctttgagtagaatgttgcagctggggcctcagacagtgggggagatgattctctttctcttccccaactcatgctcttgcagatgctctctttgaagggctaagccactatagggcagtaaagacaacactgccaaaagttttggcattggccaaatggaatttaaccacatggaatgggctcttgakctgggctcttatcactcccagatggggttaccaaataaaatacactaggtcccatgcagtatttggtacacaatgatagtaaaaaataatcatttatctgaaattcagatttgtcttggcttcctgctttttttgttttgtttttgtttttgtttttgtttttgttttgagacagagtcttgctctgttgcccagggtggagtacagcggcgtgatcttggctcactgcaatctctgcctcccaggttcaagcaattctcctgcctcagcctcctgagtagctgggattacaggcgccca

SEQ ID NO: 18228 - DNA, 601 bp, Human
ttgcagctggggcctcagacagtgggggagatgattctctttctcttccccaactcatgctcttgcagatgctctctttgaagggctaagccactatagggcagtaaagacaacactgccaaaagttttggcattggccaaatggaatttaaccacatggaatgggctcttgagctgggctcttatcactcccagatggggttaccaaataaaatacactaggtcccatgcagtatttggtacacaatgatagtaaaaaataatcatttatctgaaattcagatttgtcttggcttcctgctttttttgttttgtttttgtttttgtttttgtttttgttttgagacagagtcttgctctgttgcccagggtggagtacagcggcgtgatcttggctcactgcaatctctgcctcccaggttcaagcaattctcctgcctcagcctcctgagtagctgggattacaggcgcccaccaccacacctgactaacttttgtatttttagtagagacagggtttcaccatgttggccaggctggtcttgaactcctgacttcaagtgatctggctgccttggcctcctgaagtgctgggattcca

SEQ ID NO: 18229 - DNA, 601 bp, Human
aaataaaatacactaggtcccatgcagtatttggtacacaatgatagtaaaaaataatcatttatctgaaattcagatttgtcttggcttcctgctttttttgttttgtttttgtttttgtttttgtttttgttttgagacagagtcttgctctgttgcccagggtggagtacagcggcgtgatcttggctcactgcaatctctgcctcccaggttcaagcaattctcctgcctcagcctcctgagtagctgggattacaggcgcccaccaccacacctgactaacttttgtatttttagyagagacagggtttcaccatgttggccaggctggtcttgaactcctgacttcaagtgatctggctgccttggcctcctgaagtgctgggattccaggtgtgagccactgcacctggccaagcatcctgtgtttttgtttgctgaatctgccaaccctacccagacttctctgaccttgggtcatttgccattggtccaccgctgtggctggaagggccctccagaggtcacctgatcttgccttctgcttccaggaaacccaccccaaactcctttcaggacacatggttaacagattgtt

SEQ ID NO: 18230 - DNA, 601 bp, Human
ctattagatacctgacatttgtgggaagcagagctctgcagagtatactcagcctgacccccagaggggtgacatgcctctgttttagttgttgactggggttgaacaggaaggcagctttcaatagggttatgattttagatgactaagtattttgggaaagaacccaaaatattgtcttggctggcaggtcctggtctctaagaatgcaaaaaatgtcattaggttcacagccctcaggaatgtaaatatctgaaccaggataacagacacaaatacttacagtggctaaggaagcaartaagttagtgaaaacagctgggtgtaagaagatccgttacaacggtagctgatatttactgagcacttactctgtgccaggcattgttctgagtttttaagatatatttaatttaatcattcctcataacaagtttcttttaaagtcagtgctattactatcttcattttaaagatggagaaacaggaaacagacattcagaaaggttaagtaattttccaaagatcatgtataaaagttaagtgataagtcaggattcaaacccagggagtctggctgtaacatccacaggagcgcaga

SEQ ID NO: 18231 - DNA, 601 bp, Human
tttcaatagggttatgattttagatgactaagtattttgggaaagaacccaaaatattgtcttggctggcaggtcctggtctctaagaatgcaaaaaatgtcattaggttcacagccctcaggaatgtaaatatctgaaccaggataacagacacaaatacttacagtggctaaggaagcaaataagttagtgaaaacagctgggtgtaagaagatccgttacaacggtagctgatatttactgagcacttactctgtgccaggcattgttctgagtttttaagatatatttaatttaatyattcctcataacaagtttcttttaaagtcagtgctattactatcttcattttaaagatggagaaacaggaaacagacattcagaaaggttaagtaattttccaaagatcatgtataaaagttaagtgataagtcaggattcaaacccagggagtctggctgtaacatccacaggagcgcagacacaccaacaagtcacactgccttcctctaggagagagaagggagagtggtggggattctggtaaactagaaaacatgagttccaactaaaaggagcagctcctcctcagctctagct

SEQ ID NO: 18232 - DNA, 601 bp, Human
gcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgwgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtga

SEQ ID NO: 18233 - DNA, 601 bp, Human
tggaagtgaggccacaagagctacaccactcgggggcgggggcaggaaggggccagcagcgggcgggggttcccaggtctacagctcctgtgagggccccaagaacctcctcctgcggcggccgcccccggcccttaagccgaacctggagagcgcccccgcacacactaaaatctcccggggagcagcgggaaacggactcccccacaccctccaggaaggacacacccgccctcccggccgttcacgggaaaggggaggttgccaatttggacggcgttcgcaggccagaactgcgccragtcgccttccacggcgcaccaggtttaattagttaagcaaagagatcagctacaacgatctcttggcttggggccgggagagttactctgggaacttcaagttgcaagtttacaccggccttcctaggagcctggtcccataaaccctctgggatccccacttttgtgcactaagcaaatagcagcaggaatgggacccacctcgactaccccagccgagatctaactatagtgtcccggctccctcacccgccacccctagagatttccccagttagcgcctagtttcaagccaaagc

SEQ ID NO: 18234 - DNA, 601 bp, Human
tcactggcaccataaaaaaaaaaaaaaaaaaaaaaaacagcagtcacagggctgctgtggtccatgcggtaatcagaaatcagcaaagaagtcacaacacagccacccagtgccatgcaccaaagtaaaggtgggatttttctgaacccaggaccctcctccatttccaccaccattttagaatcaccactttccattcatcccaatgtatcttccaacagttggaagaaaagattaagttttgagagatatatatatatttaaaagctgaagccaagagtcacttctctcagcagcctaratcctaggcttgaaggatgggggtaggtggaagagcaacatgccttacagaagtttaccatggaagaatttgcaggagtatttgcatttatggattacaacgctaattgtatgcacatccagagatcatgcattcttacattgtcactaaccttgaaagccggacattgggaccaacttctggcccttctacaatggggccagtgggtgatatgaatccagccaaggcctctggttcacattcctgttttcagatcaggaactgtgaaggctccttgttaccttgacactgttttttttt

SEQ ID NO: 18235 - DNA, 601 bp, Human
ggcagagcggtaagcacttaattgccacattaagaaggggggatgtaagaaacaaaggtaattgtgttggcagccgggagcttccttttcctggcaacagtgacagccaaaccaagccctgagaagcggctgcctcccctcctgccaagctgacggacacaaataaaccgccatccaaacggcacgcgtgcggcgtccaaaaccccaggctgctgcgacaggcaggcccgccggcggcacgcacatcctgggaatgcccgacgtgccaacgcggccattgtgcacagtcagtcggctcccrgggttcgtcaggggccctgagctctgctgactcaactgttgcttcctgtcgcttgtcctgtgttagcattatttttggagaggccctattattctccataatcctcatttcagtcaattcggccaactctattgtcctgcctgtgtctgggtggccagagtataaaatattccagtcacaaaacatattaagcagaaaaggttgcagggagtccatgtgtggcgcatgcacacgtactcatgcacacaatgcgagtgggttttgggaaagtgagataagaaaggacaactatcctatagc

SEQ ID NO: 18236 - DNA, 601 bp, Human
gcccaaggaaatctggaaacctggcagctggttcccattctggtgtggcatcaaagaggaatggtcagccttcggaattgctttttggaagatttctgtggaattctacctagaggagagtcctggcatcaaagccccaaggcatccaagggccaccaggttcccagcaaggctggggcccctgcacctcctcccgccctccacacttaggctgctgtgccaaggttgtgttctctgccctgtcccactccatggcggttaccttggcactgggcagagcggtaagcacttaattgccacrttaagaaggggggatgtaagaaacaaaggtaattgtgttggcagccgggagcttccttttcctggcaacagtgacagccaaaccaagccctgagaagcggctgcctcccctcctgccaagctgacggacacaaataaaccgccatccaaacggcacgcgtgcggcgtccaaaaccccaggctgctgcgacaggcaggcccgccggcggcacgcacatcctgggaatgcccgacgtgccaacgcggccattgtgcacagtcagtcggctcccggggttcgtcaggggccctgagctctgct

SEQ ID NO: 18237 - DNA, 601 bp, Human
ttaaatgcattgataccaggagttttgacagacttgcacaagcgctaaacacataatacccacaaaccccactgcaagggaaggtgccgggactgagctggcatggcagtactaactcagtttaatactcaaagaggaaagcatccttaggtcttgcacaagaacttggacgaccaagcagtctaccaggctcatcctcgccagaactgggaaaacctcagaagttgctgaccgacatcaccccacctggagagaaaagaattgcacacagccctacgtgcctggctctgtgattttccakgaactgcccttctttctcagaggcagagacagggtgagggcagggagctacagtgacggcaacaaagcctggactttttttcctgtctgtttcagggaggggattagggtctcctggggcaggaggattcctcctgcccagccctacagagaaaaaggattccctccaaggttcctattaggaggcactcaacctcccactccatccccacactatagatcagcaatcaagataatttaacaatgattattagttgctagagaactttaatttttcccaggcccacacttgacctctgta

SEQ ID NO: 18238 - DNA, 601 bp, Human
taaactgaaggcaccttttatcttccaagcttatctcagaattccacctccccacccccagccaaacctaagctattagcaaattccctccttttctaaaattttccttcgtaatttacagtaaggtcagtctcacaaaacaccagcgtttaaatgaagcttctgctatcttggcactgaagaaatgtactcaaggcaggtggggtagacaaggaacatgaactaggttatgaatccctgctttgctgtgtcagaaaccaagccataggaaatagaagcgtgtatagattaaataataccrtgctgtgccaccagaagcacactgctgccaagagaagagaaagcacctataagataaaggaaaaagagaaaaagggagggtaaaagggagtttcattcataactcaaggccagcttagcgctctcagagtgacacagcaggtcatctctgaatataaaaatatcttgtgatagaccctgccttggaattcagccgaaatatgtttcatactcaaagcagagtaggattccatttcgttcactgataactgtgggaaaatgctcagaaaagcaagcaaaaccgggcaagccagggcacata

SEQ ID NO: 18239 - DNA, 601 bp, Human
gtcaacatgcatgcaggcagctcaaagttgagatcaggaaatgccacctcactatatgatatgagagtatttagcatatagtttcccaaaactttccagaccctgaccctagtgcatgaggaaacacacacacacacacacacacacacacacacacacacacaaagaatttattctaagctaacctaaccaggtatttgtaccgagggggtattgctaaggttacactttgggccctggtgaggcagtctctagggaggcccccttttcctttttagaacccctttgaaaactctgtctrtgtgagaccatcctggctcccacaagtatcgggtaactctaggaaacaggagggggtagatgcaaagtgactctgcaagacaaagaagtcaacctcacttgggcggtggagttgggggcagatcccagggaagaaagtacaaagggagaaacaaccgcacacccatgggttatatttattgatgaacttatctgttaataagatctaacattccaagaataatcagagtctactaactaaacaaattccctggatactggcaagatgccagctgttaaactgaaggcaccttttatcttc

SEQ ID NO: 18240 - DNA, 601 bp, Human
tagcaattcagaaacagggtcgactttccaaaatctcgtacattcttggcctcccagaataccccaccaaacaaaaccataatgccaaaataaaaattctgttggttgttgcattgagttcctggatgtttaaatccaaaccaactccccttcctttgtcagcactcttcccaggttgacaaatgactcctttcacctggcagggacgcactggagtcaacatgcatgcaggcagctcaaagttgagatcaggaaatgccacctcactatatgatatgagagtatttagcatatagtttcycaaaactttccagaccctgaccctagtgcatgaggaaacacacacacacacacacacacacacacacacacacacacaaagaatttattctaagctaacctaaccaggtatttgtaccgagggggtattgctaaggttacactttgggccctggtgaggcagtctctagggaggcccccttttcctttttagaacccctttgaaaactctgtctatgtgagaccatcctggctcccacaagtatcgggtaactctaggaaacaggagggggtagatgcaaagtgactctgcaagacaaag

SEQ ID NO: 18241 - DNA, 601 bp, Human
catcctccatggcttatccaccaaaaccaacccctcagtcctgaaaggcaacctgcactgaaaacagagccatctttcagaaagggacaaggcaggtaatggctgtgaagctctggaattgcgcttcaatgaaaggtttgtggagcagtgtgggaaacccggagagactagaagctcacctgcccaccaagtgaaattcaaggtcggtctctagagcccagcaccacctttatggctttatctttctgatgagagattaaacactcacttaaagtttaaatggacttttaaaaagtcactrctttgatcctttagcagactacaaggttttaaagttgtaaaaccattaagatctctatcccgaagataatctaggtttcataatcagggaatgagttaactgggattctgttctggccacttaatattccaagcaaaaatcctagaaaagttaaggaatacattccactgaaggttcaccctggggtacaggggagaacagaaggcaagaggtggcagaaatgctaagtactaaggagacagatccagctccaactggttggccaagccccacacttccacgtgtgtttagagaaaagtc

SEQ ID NO: 18242 - DNA, 601 bp, Human
gttttccagcgaccgcaacccaaactctgctggcaaaaagggaacttgaagtttcggctcgtgagcgaaaacactgtaaagttacaattaaagagcaagactactttgtaagccagactatgtcatttcaatcacatcctccatggcttatccaccaaaaccaacccctcagtcctgaaaggcaacctgcactgaaaacagagccatctttcagaaagggacaaggcaggtaatggctgtgaagctctggaattgcgcttcaatgaaaggtttgtggagcagtgtgggaaacccggagagrctagaagctcacctgcccaccaagtgaaattcaaggtcggtctctagagcccagcaccacctttatggctttatctttctgatgagagattaaacactcacttaaagtttaaatggacttttaaaaagtcactactttgatcctttagcagactacaaggttttaaagttgtaaaaccattaagatctctatcccgaagataatctaggtttcataatcagggaatgagttaactgggattctgttctggccacttaatattccaagcaaaaatcctagaaaagttaaggaatacattcc

SEQ ID NO: 18243 - DNA, 601 bp, Human
ggcattcagagaacagagagccaagacaagaagctggatccactcttcctcatgcacagaccaagagatttcagtgcgcatcaagttttccagcgaccgcaacccaaactctgctggcaaaaagggaacttgaagtttcggctcgtgagcgaaaacactgtaaagttacaattaaagagcaagactactttgtaagccagactatgtcatttcaatcacatcctccatggcttatccaccaaaaccaacccctcagtcctgaaaggcaacctgcactgaaaacagagccatctttcagaargggacaaggcaggtaatggctgtgaagctctggaattgcgcttcaatgaaaggtttgtggagcagtgtgggaaacccggagagactagaagctcacctgcccaccaagtgaaattcaaggtcggtctctagagcccagcaccacctttatggctttatctttctgatgagagattaaacactcacttaaagtttaaatggacttttaaaaagtcactactttgatcctttagcagactacaaggttttaaagttgtaaaaccattaagatctctatcccgaagataatctaggtttcata

SEQ ID NO: 18244 - DNA, 601 bp, Human
gcacatcggagctcagcaatgattctgtggctccaagtagcccaataagccagccacaggtggaagctgcccacgtagcaggcaccaagccctcactgcacccacggtgtgcattcaccattttctgtcagcaaaaaaagcaaggcaaggaaagatgaaaatatattattcacagtgaaagcaaacaaaaaaaaaatggtaagatagaaaagcaaaaagtacaaggcattcagagaacagagagccaagacaagaagctggatccactcttcctcatgcacagaccaagagatttcagtgmgcatcaagttttccagcgaccgcaacccaaactctgctggcaaaaagggaacttgaagtttcggctcgtgagcgaaaacactgtaaagttacaattaaagagcaagactactttgtaagccagactatgtcatttcaatcacatcctccatggcttatccaccaaaaccaacccctcagtcctgaaaggcaacctgcactgaaaacagagccatctttcagaaagggacaaggcaggtaatggctgtgaagctctggaattgcgcttcaatgaaaggtttgtggagcagtgtgggaaacc

SEQ ID NO: 18245 - DNA, 601 bp, Human
aagtagcataaacagcatgtgcaaaggtcctgaggccagaaagcatgtgatgtagttgaggataggaaggcaactgctagggtatggccaggctacagatacgatggacaacacggtgtgtaagacaaggctggcagggagacaaagctgggctgcacagagccttgtgggccacatgaagatctgtcccaagagcaacagaaggccaccaagtggttggtttttcataataagggtgacaagcaaatgttatggctctgaaaagaccaggatggcagaagaatggagaaagcactagagrtgagtcagagcagataaaggtggaccagacgaaggctactctaagttcagtcatgagcagatggtgacttggaccagggcagtggcagaaggcaggcagattcaagtgaagagctggagagatttttcagaacttggaggtggactaggtatggatgctaacagagagggggtacacagatcgccttctatatttctggcttatggcaatgagtgttcaaatatcggtgccagacacccagaaggggccctgggaagggactgcttttggcaagagaagatcctgagtttggttttgact

SEQ ID NO: 18246 - DNA, 601 bp, Human
aaatacataaacagcacctaggctatatttgggcccgagtctgcctgtgagggctcactgcagagctgatagaaggaattctctgccctaaaactcagggctctgcctttgatttacatctgaagccagaatgtttacaactcgcttgggtcccacagggcagccaactccgtttgggcttctgaacatcctcagcttctgccctgtggagtgcagtccagagggagtggctgagggtgaagaaaggaacaaaacactccaagtagcataaacagcatgtgcaaaggtcctgaggccagaragcatgtgatgtagttgaggataggaaggcaactgctagggtatggccaggctacagatacgatggacaacacggtgtgtaagacaaggctggcagggagacaaagctgggctgcacagagccttgtgggccacatgaagatctgtcccaagagcaacagaaggccaccaagtggttggtttttcataataagggtgacaagcaaatgttatggctctgaaaagaccaggatggcagaagaatggagaaagcactagaggtgagtcagagcagataaaggtggaccagacgaaggctact

SEQ ID NO: 18247 - DNA, 601 bp, Human
tcacacctgctcagggagggggtcgagcatgtctgggttcaaatacgtctgctgcctgcttcctgatcacgctttccttcagcttggggcactggaaaggaatctgtggcagttcgtttggcagtccagccttgtgactggaaaaggacatcaccatgcctccctgcaatccccagtgccacgaagatgagtcacgaagaagccatgaccgcctcgcaggccaaggaggaggtgatgaagggcgagtctgagcataacctgggaccacaccgacccaaaaacctggaagggggccttagcmgagaaagctaagctacagggaaaacctggtctgaagtgtgcctatttatgtttacatgtttattatgcattacagtaaactgaaaccatttgctctaggggagaaagaaatttggaactctatataccacagtcccaaaatgtaataaaagactttggaggaccgatgacagaaggaccagccttaaatactttcaaatacataaacagcacctaggctatatttgggcccgagtctgcctgtgagggctcactgcagagctgatagaaggaattctctgccctaaaactcagggctctg

SEQ ID NO: 18248 - DNA, 601 bp, Human
ttacattgccatactgacttgcaagtgctctttacatatgagagacagtagctccctatggaatgttgctcttgaagaaatttcattattccagataaaggtcagcaatcatttctggttttagggttttatgtcttgctcagaaaagctttttgtccatttcaaaactcttaactggaagccaaggagacgattgagttacttttttttttttttttttttttttttttacaattgttaacatggcaacctttaaagccagctcttaaataccaagaccttgaacttgatgcattccacmtttctcctctgcccagaaggcagatgggagaataattcaccaaagtttagacacaggtaaattgaggggagggtttcttttttctttttgtttttttgagccaagtcatgctcctgaaaaaaaatgcttactgaggataataaacacctcgagctcaagcagctctcaggagtatgtagtccctgccctgaggccacttatcatctagtttgagaagagacaggtacaaaaatagctcaaacatcaggtgccagcagttcaggggagggatctgaaaaggcagcaaggcactaaatcagc

SEQ ID NO: 18249 - DNA, 601 bp, Human
tagcatttaactaagtgatggcaagagccctttctggtagttacaaaaccatttatatttgttcctgtgaacagcaacagcttctcttctctgccaacttttctattacattgccatactgacttgcaagtgctctttacatatgagagacagtagctccctatggaatgttgctcttgaagaaatttcattattccagataaaggtcagcaatcatttctggttttagggttttatgtcttgctcagaaaagctttttgtccatttcaaaactcttaactggaagccaaggagacgattragttacttttttttttttttttttttttttttttacaattgttaacatggcaacctttaaagccagctcttaaataccaagaccttgaacttgatgcattccacctttctcctctgcccagaaggcagatgggagaataattcaccaaagtttagacacaggtaaattgaggggagggtttcttttttctttttgtttttttgagccaagtcatgctcctgaaaaaaaatgcttactgaggataataaacacctcgagctcaagcagctctcaggagtatgtagtccctgccctgaggcc

SEQ ID NO: 18250 - DNA, 601 bp, Human
gtctgtcctcccaccacccaggaagctgtgtttcccaataacactgccaacgttgtacattatcaaaccttctaatctatgcctgataggtaaagaggtatctcatttaattagcatttaactaagtgatggcaagagccctttctggtagttacaaaaccatttatatttgttcctgtgaacagcaacagcttctcttctctgccaacttttctattacattgccatactgacttgcaagtgctctttacatatgagagacagtagctccctatggaatgttgctcttgaagaaatttcwttattccagataaaggtcagcaatcatttctggttttagggttttatgtcttgctcagaaaagctttttgtccatttcaaaactcttaactggaagccaaggagacgattgagttacttttttttttttttttttttttttttttacaattgttaacatggcaacctttaaagccagctcttaaataccaagaccttgaacttgatgcattccacctttctcctctgcccagaaggcagatgggagaataattcaccaaagtttagacacaggtaaattgaggggagggtttcttttttc

SEQ ID NO: 18251 - DNA, 601 bp, Human
agtctgtcctcccaccacccaggaagctgtgtttcccaataacactgccaacgttgtacattatcaaaccttctaatctatgcctgataggtaaagaggtatctcatttaattagcatttaactaagtgatggcaagagccctttctggtagttacaaaaccatttatatttgttcctgtgaacagcaacagcttctcttctctgccaacttttctattacattgccatactgacttgcaagtgctctttacatatgagagacagtagctccctatggaatgttgctcttgaagaaatttyattattccagataaaggtcagcaatcatttctggttttagggttttatgtcttgctcagaaaagctttttgtccatttcaaaactcttaactggaagccaaggagacgattgagttacttttttttttttttttttttttttttttacaattgttaacatggcaacctttaaagccagctcttaaataccaagaccttgaacttgatgcattccacctttctcctctgcccagaaggcagatgggagaataattcaccaaagtttagacacaggtaaattgaggggagggtttctttttt

SEQ ID NO: 18252 - DNA, 601 bp, Human
tgcctgtgtatggttcccacaatgagatactctagaaatggaagtgctgaatcagagtccgtgcacaacaaatcaacctctgtccacagtctcaaactaccagtctgtcctcccaccacccaggaagctgtgtttcccaataacactgccaacgttgtacattatcaaaccttctaatctatgcctgataggtaaagaggtatctcatttaattagcatttaactaagtgatggcaagagccctttctggtagttacaaaaccatttatatttgttcctgtgaacagcaacagcttctctyctctgccaacttttctattacattgccatactgacttgcaagtgctctttacatatgagagacagtagctccctatggaatgttgctcttgaagaaatttcattattccagataaaggtcagcaatcatttctggttttagggttttatgtcttgctcagaaaagctttttgtccatttcaaaactcttaactggaagccaaggagacgattgagttacttttttttttttttttttttttttttttacaattgttaacatggcaacctttaaagccagctcttaaataccaagaccttg

SEQ ID NO: 18253 - DNA, 601 bp, Human
gcatgtgagtcgtttgggcttcttactattaaacaaagccacagtgagcattccttgaacgtatctgcctgtgtatggttcccacaatgagatactctagaaatggaagtgctgaatcagagtccgtgcacaacaaatcaacctctgtccacagtctcaaactaccagtctgtcctcccaccacccaggaagctgtgtttcccaataacactgccaacgttgtacattatcaaaccttctaatctatgcctgataggtaaagaggtatctcatttaattagcatttaactaagtgatggcragagccctttctggtagttacaaaaccatttatatttgttcctgtgaacagcaacagcttctcttctctgccaacttttctattacattgccatactgacttgcaagtgctctttacatatgagagacagtagctccctatggaatgttgctcttgaagaaatttcattattccagataaaggtcagcaatcatttctggttttagggttttatgtcttgctcagaaaagctttttgtccatttcaaaactcttaactggaagccaaggagacgattgagttactttttttttttttttt

SEQ ID NO: 18254 - DNA, 601 bp, Human
cacacgtgcacatgcacacacacacacatacctctgttacattcggggcccatccagccttccatgcaagttttgttgccattctggtcacaggcatagtgtccaaagaagtcatctctggggcggcagaacttattgcagccaaagccatagtagtagtcatcacaggtcacgcggatctgatactcaaagtgggcaacgcccgtgttctgcttcagcgtctgccactgccggctggggttgatcatgcccgagtgagaagccttttcaataatactgtcaggttctagagacaaagtgrtgaatcatgttaatattcacattgcagccttcttccctgaccattttggctttttaaaataaaaacatatgcacctgctacaaaattctatctgttgtaaaaaaggcaaagaaatgaaaagtttatgcccctacccagagacaacctgttaccacttgtttaccttctttaatgggtacacagtatttcattgtctggaaacaccaataaataatttacctagtccctgacatgtgtgcatgtgagtcgtttgggcttcttactattaaacaaagccacagtgagcattccttgaacgta

SEQ ID NO: 18255 - DNA, 601 bp, Human
gatgccagtaaaggggatctggatggggcaccaacagcatcttctacactccgcatcttcatactgcaggcccagaataacagccaaaatcccaccccacctgagatagccgcatgccacctgcctgctggtggggtgataaatggacactaaaagcaacaggcacacgtgcacatgcacacacacacacatacctctgttacattcggggcccatccagccttccatgcaagttttgttgccattctggtcacaggcatagtgtccaaagaagtcatctctggggcggcagaacttattrcagccaaagccatagtagtagtcatcacaggtcacgcggatctgatactcaaagtgggcaacgcccgtgttctgcttcagcgtctgccactgccggctggggttgatcatgcccgagtgagaagccttttcaataatactgtcaggttctagagacaaagtgatgaatcatgttaatattcacattgcagccttcttccctgaccattttggctttttaaaataaaaacatatgcacctgctacaaaattctatctgttgtaaaaaaggcaaagaaatgaaaagtttatgcccctaccca

SEQ ID NO: 18256 - DNA, 601 bp, Human
ctgttcagacaacaactgggctgacctagtcctgtctggatctattttgggtcaagttccttagaagcagagtctgagaaggggatctggacataggtagaaggaattgagggaagcagatggggtaggggaaagagctgagcaagaacatggtctcaactggagtctgatttcagcctaatcccagggtaagctctagagtgcaaattgtactactgttttaaggcaaaggaagctgggctttgtagccctatgtctgtcaatcactgactgtgagctggaggaatggggcatgcactgktttggccaaggacgagtctcctgagaaggagcagctgtgagctgttggcagccaacacagcacctgggggatggggatgccagtaaaggggatctggatggggcaccaacagcatcttctacactccgcatcttcatactgcaggcccagaataacagccaaaatcccaccccacctgagatagccgcatgccacctgcctgctggtggggtgataaatggacactaaaagcaacaggcacacgtgcacatgcacacacacacacatacctctgttacattcggggcccatccagccttc

SEQ ID NO: 18257 - DNA, 601 bp, Human
tccccttttcatttgaattccagaaatgccatcctttttaaactcttctctccaattatttaagaaagcagtagtactacccgggagagctgtaaattccttcccccatgacccacccctctctcatggttgaaaaactcactttgaaattgagtctatcaaaacaatttacctaattatcatgtaaaataagcagagtacattattgctcatgaggggatattatacagttaacagaattacccatcaagttgctatgaattggaatcactgaattctataaagggactgggacagtagwcagcacagagactaaaagtgggcccactcctacaccaataggaaagcttgagctaaccacatacctctccccatcaaagccatgcccccaaagacacctagtgaaaacttgctgcaaggctaccctgaatgcaggggctatcatttcctataggatagcctgttcagacaacaactgggctgacctagtcctgtctggatctattttgggtcaagttccttagaagcagagtctgagaaggggatctggacataggtagaaggaattgagggaagcagatggggtaggggaaagagctga

SEQ ID NO: 18258 - DNA, 601 bp, Human
aaggagaattcagaataaaagcccctgccaataaaattagaaaccaaattagtgccatcccacccccagatcccaccctgggtctcatccctaagggccatacctttgtcacagagctggccgccccagttggtctcacagaggcactgccagggctcattacagatgccgtggacgcatcccgggtgtgggatgcacttatcacagtacaggccttgccagccgtactggcacctggagacacacagcacacctccaggttagccttttgaacgttaagagacacctgtacaattcaaayggaagactgcaaagtccaggctttttctgttttgtttctggggacaggaaggtagactcccaaggctcatcaggggctccgtataaacaaacattttcacagttgagctgaggtcccctcccagccgactcctgacaaaaggagggctgtttgggaagaggccagcatggggatgcccttcacaaagccactctcttctcaggctcacacgagtgagccaaaggtgaaggcatggaataaatcaacccgtgcacctagttgcgacagactatagaggaaaggactctctcggtgacaaga

SEQ ID NO: 18259 - DNA, 601 bp, Human
gaagatggcgaacccaccatgtttctagccccagtcgtcttttaaaaagaaaaaccagaaaacccacacagcattcaaggagaattcagaataaaagcccctgccaataaaattagaaaccaaattagtgccatcccacccccagatcccaccctgggtctcatccctaagggccatacctttgtcacagagctggccgccccagttggtctcacagaggcactgccagggctcattacagatgccgtggacgcatcccgggtgtgggatgcacttatcacagtacaggccttgccagccrtactggcacctggagacacacagcacacctccaggttagccttttgaacgttaagagacacctgtacaattcaaatggaagactgcaaagtccaggctttttctgttttgtttctggggacaggaaggtagactcccaaggctcatcaggggctccgtataaacaaacattttcacagttgagctgaggtcccctcccagccgactcctgacaaaaggagggctgtttgggaagaggccagcatggggatgcccttcacaaagccactctcttctcaggctcacacgagtgagccaaagg

SEQ ID NO: 18260 - DNA, 601 bp, Human
agggcctgggccaagcccactttcctggagacagggaccctctggctaatgagacacaccccagggaagccaagatactggcaacgtgccacatcacattatgacaggcaaagttgagactccaggcaaagagttttaaagcattttctccctccacacaaccaggaaaacccacatgcttgtggatccccttcatcctacctttgacatctacccaatttggtaaacacttgctaaggcaaaaggacctgctttatttacttcctttttgatcttaagcaaggctcaaggacaatcttayagaagctttaaatgttgtgctgcctaatacagcagccaccggccacatgtggctatttacatttaaatgaactaaaatgaaataaaatcagtttctagttacactagtcacagtccacatggcctggggctcccatacctgaccgtgcagatacagaacatccccctctgtctgccgttgcaggaagttctgttgacagtgttgttctcaggcatttgcctcagcgttgcacatcagcccaccccagaacaggaatgctaaatggatttcacattctctcccctgggctacttgtagaca

SEQ ID NO: 18261 - DNA, 601 bp, Human
tgcctggggaattttaaaagaatactgatgcctgggtcccacccccagaaagtctaatttcacaggtcttggttgcagcccaggcagcgggatttttaaaagctcccaggtgattctggtgtgcagccaaggttgaaaaatcactgctctaaatgaggacacaacctggctaattaaagtgtggtccatggggcagcaggatcgcttcacctgggagcttgttagaaaagcagtctgaggccccaccccagacctcctgactcagaacttgcattttaaacacaatccctgggtgattctcacacacacacacacacacacacacacacacacacacacgatagtggatgagtgctggcttaaaaggatgtcacacttaccagggatgagggctgcagtcattggtatctgcaaagaaaagacaacttaatagtgaggacttcaacagggaaagcggtcttagccctaagtaaaaccaccacttattttcctaatacccaaatgataaagtcgtagttaacaccagcaaaatacctttgctaaattggaaccaggcccgcaccacacttagtttcatttgctgtgggacacatgtacacag

SEQ ID NO: 18262 - DNA, 601 bp, Human
aagagaaagggcttgtaaaaaagtagagaaaaggctcaaaataatatgctttaagcctcttgaaaaactgcgttgcctgcccctattttcctgttttagtcatttctccagggcctgatcagacccagcacagacaagcctctggaagccacagtcgtcctcccttccgtttgtattagctttatcctataccagtgtagctgtggttaacatctgcttgcccataatttcatgttagtcatggggaaatgcacatactttcttcaggaccccactgtagattaatcatcagattctgtgrctggcactctctccccaagaacaaggagggctacaccacccagggaactaccagcaggtacctgggaggatccagcctggcatatcttaatcccagctggaggagagagatcctttgctctatgagagctacttaaagggaatggtggctttgtttttaaagatgaaagtcttggggtgaggcatggaatgaagcggtaaagccattgggaaaaccagacggagacagtccttacttattctgcagtcgggcccagcaaaacccggggcacattcgcaccggtaccagttgtctccatcc

SEQ ID NO: 18263 - DNA, 601 bp, Human
aaggggaaggctcgcaagcgatgtagattgaatattcagcggaaacattcttcaaaatattcaaattcctcaattcactgcaaatgtgctccgtagtaagaccctaaaacgatttttaaaaacccacacacgtgtaagattgagaggaagaacaaaaggctgagatgttctctttgaggctggctaagttcaagcttactttattataaaacaggaatgtaagctagggagaagtagatcctagctcatggcattcctcctttaaagcaagcaagcagacatccaccattcaaaaaaaaaacaaaggttgttacatactggtgacatcatctccttgttaaaggtaaatgtgatgttcgcacagttatcctggtaataggagtcagaggtgcactttgtcttcaccggctggagactggaagaccgacactcgcccacaccagtgcaggggtggacgaagcactggtcgtccaggatggggatgcagctctgcccgctggggcactcgctgtgccctttgtggagcaggcaaggtcgagggccacaccagacctggagaaaaacagaagctggcagcttagcaggcatgctcatccctgat

SEQ ID NO: 18264 - DNA, 601 bp, Human
agtacaggagttggttttcagaactagaaatccgattcaaattagcacagacagctcaaacgtgccatggctccatgcccaatctctcccttggctgaaacggtgctcgagatcctcaggagggaagcctggacacccctgcggggccatcgagcctcacagagctcagcagtggctaggctgtcccaggacaccaaaatgccaagtcaggctttgtacagcttcaaactcaaggacaaaggacaagcagtgtcctagggctttgtcacggatctagcacaatacctgttctgcagggaaygttgcatagtgtgttgggaaggaaaatatgaggcagacctctgttcccatgggccatgtgaccttagtaaagtaggctgccctcagttctcagttaaattgggagctcctgcgagggtagggcactgccagataatccctcgacctgatggctttattgaatagtataatgagatcatctactatcatcacacaaactagtcccacttgacacctacctgttctgttcttcagaggccgcctctgaactcttacttctgcaacggcagcaatcagcgagctgtttccatcacgtttacta

SEQ ID NO: 18265 - DNA, 601 bp, Human
cacagggacaagtcccttttcatcattgcatatggtcacttcacaacttgataagcaaatgctgggatcaggcccctgtagaccttgatactcttatccctggagagactgggtggagcggcagctcctacaggctctttgacttcgcatggggagagcagtgtcttgttaagtctggctactgaggcagctcagtacaggagttggttttcagaactagaaatccgattcaaattagcacagacagctcaaacgtgccatggctccatgcccaatctctcccttggctgaaacggtgctsgagatcctcaggagggaagcctggacacccctgcggggccatcgagcctcacagagctcagcagtggctaggctgtcccaggacaccaaaatgccaagtcaggctttgtacagcttcaaactcaaggacaaaggacaagcagtgtcctagggctttgtcacggatctagcacaatacctgttctgcagggaacgttgcatagtgtgttgggaaggaaaatatgaggcagacctctgttcccatgggccatgtgaccttagtaaagtaggctgccctcagttctcagttaaattgggagct

SEQ ID NO: 18266 - DNA, 601 bp, Human
tttggcttataggcaacaagtaatgagaagagttcaaaaaaataaagccatacgcttacaatgctatcaaaaaccttcaattctaaacacatacatataaataaaaaggaatgatgttttaaggctcttgattattaagttaataaatcaaatatacacagtgattaataaaaaagaattatttacataactatacaaagttctacttttgacatttttttctttaaattcttcattttaccagcaactgctgacatcaaagtctcccctcccccaacaacaaaaatacaattaaaaaaaataaataataaagtcatttgtgatcgttgctgtggttctgagctgcaaaggcactttcaaatacagaactacttgtacgtcatcataaaaccaatatacaaaaacaactcaagagtcaataaatataaataaaactatgatctaagactgcatcaccattaggacatctggcagaagtgggagctcaaagaccagggggctgggcaggctcctgggagcctgatccgagaccgtgtcggctgcaaggggacacacaaccagggtactgttgactagctttttgcatagctgtgagatgcgg

SEQ ID NO: 18267 - DNA, 601 bp, Human
atcagaatttacaaagtcagattggtgtgcttccaagttcacacaattaatttgatatttttaatcatattcaaccactcacattttggctatgttaagtcatagctcaacttgttcccttactgctctgcagcagatcacctgcctgtctcttttcaagtctaaagcagaaaaacaaaaaacaaacaaacaaaaaaacctgttctaaactaatcctcaaactgcctcagtcagtccttaaaacgtgttttaagtgatgctatagaaggtgttttaaacatctgacgtcgtacaaaaaaaattccatcagtattctgggcacagaagcccatcctattgttttaaaataaactattttcaaacaccttaattttggcttataggcaacaagtaatgagaagagttcaaaaaaataaagccatacgcttacaatgctatcaaaaaccttcaattctaaacacatacatataaataaaaaggaatgatgttttaaggctcttgattattaagttaataaatcaaatatacacagtgattaataaaaaagaattatttacataactatacaaagttctacttttgacatttttttctttaaatt

SEQ ID NO: 18268 - DNA, 601 bp, Human
acactaataggacaatacaaagtatcttcacggtctcaatggtgaaccaacaagattactctgttttataagcctttttgatcttgaacttcgtaatagcactttgatttcctcacttaaggcaggcagtgtactctatggcaaatctaaacagtgatcttactggacattttatggttcaagtattcaactagcttattagaatactccctaaatgcagtagattaaaaaaaaaaatcaaatctacaagtggttcagtattatgtacgaatggtgaaaagaaatcagaatttacaaagtmagattggtgtgcttccaagttcacacaattaatttgatatttttaatcatattcaaccactcacattttggctatgttaagtcatagctcaacttgttcccttactgctctgcagcagatcacctgcctgtctcttttcaagtctaaagcagaaaaacaaaaaacaaacaaacaaaaaaacctgttctaaactaatcctcaaactgcctcagtcagtccttaaaacgtgttttaagtgatgctatagaaggtgttttaaacatctgacgtcgtacaaaaaaaattccatcagtattctgg

SEQ ID NO: 18269 - DNA, 601 bp, Human
tttcagtgctgtggccagttcccctgattgctcacaaacaattcacctcgacactacaggccattaatccagtggtgtttattcaagcagtattcacacttgctgttgaataacaagggaatcaaggctcccctagatggggctcccgcagttccagcttcacagcagccccaggtctttgagaactccagatgagttttgtggttgaaaagcctttcagttcttcctccatccctctgtcaggcagagcctattataccccgattaccagaacagactcagcagggtggcagaagcacayggcaaagccggtagaactacgtaagctcagaagaggccacactgttccatgttttcatacaaaaaaatttaataaatattacttttcaaaatttattgccaagaacaacacatcaaagatgcatttgtatgttcatataacactaataggacaatacaaagtatcttcacggtctcaatggtgaaccaacaagattactctgttttataagcctttttgatcttgaacttcgtaatagcactttgatttcctcacttaaggcaggcagtgtactctatggcaaatctaaacagtgatctt

SEQ ID NO: 18270 - DNA, 601 bp, Human
cgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggcygacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctc

SEQ ID NO: 18271 - DNA, 601 bp, Human
cccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacscggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtg

SEQ ID NO: 18272 - DNA, 601 bp, Human
cccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggrcgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggac

SEQ ID NO: 18273 - DNA, 601 bp, Human
ggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagrgttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctc

SEQ ID NO: 18274 - DNA, 601 bp, Human
gcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggmccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacg

SEQ ID NO: 18275 - DNA, 601 bp, Human
ctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggycacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttag

SEQ ID NO: 18276 - DNA, 601 bp, Human
gcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccaygtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggacca

SEQ ID NO: 18277 - DNA, 601 bp, Human
cctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctayagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtc

SEQ ID NO: 18278 - DNA, 601 bp, Human
catccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagmgtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtccc

SEQ ID NO: 18279 - DNA, 601 bp, Human
catggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggytggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagggctcagcatcccatcttagagaagagagcgtagaatctccatcatacagaagggacatacagaagggagaaacagagttcaac

SEQ ID NO: 18280 - DNA, 601 bp, Human
atctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatrtcatcctcactccctcccttaaggcagagcaaggcagggctcagcatcccatcttagagaagagagcgtagaatctccatcatacagaagggacatacagaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatctta

SEQ ID NO: 18281 - DNA, 601 bp, Human
atcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcagtgtcccatcttccaaaagggaggatcagggctcaatatcccatctyacagaaaggagagtcaaggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccat

SEQ ID NO: 18282 - DNA, 601 bp, Human
acagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcagtgtcccatcttccaaaagggaggatcagggctcaatatcccatcttacagaaaggrgagtcaaggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaag

SEQ ID NO: 18283 - DNA, 601 bp, Human
aacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgtygtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacc

SEQ ID NO: 18284 - DNA, 601 bp, Human
ggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctcygccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggta

SEQ ID NO: 18285 - DNA, 601 bp, Human
agagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcytgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagctt

SEQ ID NO: 18286 - DNA, 601 bp, Human
agctgcatgatcagcggtgccggaggagggaggggctgagaccctgagttcttgcctctcaaccacccccttctcctcaccacccccacccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacycgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctg

SEQ ID NO: 18287 - DNA, 601 bp, Human
cagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgcmaacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactct

SEQ ID NO: 18288 - DNA, 601 bp, Human
agggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacggggrcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctccccccagccctaccaccccacttcccaagccc

SEQ ID NO: 18289 - DNA, 601 bp, Human
caactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagyggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctccccccagccctaccaccccacttcccaagcccagct

SEQ ID NO: 18290 - DNA, 601 bp, Human
ttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgccaacagcagccacggctcatagtgtgggctggtgtaacgggggcagtggaatggctgtgcccccagcctggagtcaggcctrtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctccccccagccctaccaccccacttcccaagcccagctggggtccccggcccaccccagcacttggccctgat

SEQ ID NO: 18291 - DNA, 601 bp, Human
tgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacrtcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagctta

SEQ ID NO: 18292 - DNA, 601 bp, Human
cgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacrgtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttagcgacgtcgctcctgttctgggccctgggctggccctggccatgaagtgcagtcaca

SEQ ID NO: 18293 - DNA, 601 bp, Human
caattggttgttctcagaccaagccccaagctgaataggtattttttctttccaacatcacatggcttgaataccaacatgctaagacatgacaagccatcagctaaggtctctgggcagcaggcgtggattgggttccagcattgccttcctctccttggccacgctctatcgctcacttgtttctcctaaaagttgtgcctaataacaactggccggaaacacttacttatcatcaatctcccggcctattctctgaaacccactgaaatactgagttttccaagggttcacaaagatrcaggtgaacatacagacataagtacatatttacaagacaaaagtaagatcacaccaggaagaaacaagataccatgttaatctctccatacaacagttatgtaagaaacagacttaaaagaagtctttattgttggaagtctttattattcgggaaaacctggcatttactgaaggtgttttttacatgcactgggttagccaatgctattgatttatttgttcagagtgagagggattattcttagagaatgcaatgatacaggataaattcatccactaaccaaaactgtcattcaca

SEQ ID NO: 18294 - DNA, 601 bp, Human
cattcatggctggaaaaagcaaggaagtggtgctggttgttggtctttctatgcagactgatttcttttagactcagcctaatttattgtaggcgacagtcagtggactgacgctaatttgtgtaaacttggaaacacttaatttgatagtggagtcgtgtgatttaaaccaaggcaattggttgttctcagaccaagccccaagctgaataggtattttttctttccaacatcacatggcttgaataccaacatgctaagacatgacaagccatcagctaaggtctctgggcagcaggcrtggattgggttccagcattgccttcctctccttggccacgctctatcgctcacttgtttctcctaaaagttgtgcctaataacaactggccggaaacacttacttatcatcaatctcccggcctattctctgaaacccactgaaatactgagttttccaagggttcacaaagatgcaggtgaacatacagacataagtacatatttacaagacaaaagtaagatcacaccaggaagaaacaagataccatgttaatctctccatacaacagttatgtaagaaacagacttaaaagaagtc

SEQ ID NO: 18295 - DNA, 601 bp, Human
tgaggcgctttctcaaatggatattctttttcatagtagtgatggaatggtgagttcattcacagatcagcctcctactgtatgtcctgatgatattcctgagtaccatgtctgtaaagctatcagtattaaatttctagtagtttgtaggaaaacattgtgaaggtcatagagtagcaaatgtacaaggaaagcaaaagacaatttagcattgaaagaagggccaagaaagtctaaaattattctgtattagatccagacagctttctttaactggcatttatgctatcaagtgatttaktgacttgttattttcaagtcggaaaaaaaaaacactacagacgttcacagtttacagagaatgtccattttgccatttcctagggatggctgtcactaggagtcacccactaacaaccactgtcacctttcactgcccagagtgctgcgtttaagctgcatttccagtttaaatgaaaatgaaagatgaaaaataagagtgtttttttcaaagtcaactacaataaagataaaatctgggacttcaagtctagaaatacagttgtccccctttattgacaggggatttgttccaagaccc

SEQ ID NO: 18296 - DNA, 601 bp, Human
ttgtccccctttattgacaggggatttgttccaagacccctactggaagcctaaaaccacagagagtacagaaccctgtatacactatctgttttcctgtgcatacacacctctgctaaagtttaacttataaataaggctcagtgagagattaagaacaataactcacaataaaatgaagtgattatgacaatatgctagcatcaatgctcttgtgctttggagccattattaattaaaattaacggtgacttgaacacaagtaccacaataacttaacagtggatctcaccgtggagayggctcctcagtgactcacgggctgggagcgtagacagctggagatgctggacacagggatgattcatgtcctgggctggacggctcaagattccatcacgctagtcagaaaggggtgccatttaaaatgtataaattatttctggaattttccatttaatattatccagaccaaagttgacagcagataactaaaatcaaaactaaaaccaaagaaagtgaaacagcaggcagcaggggaggagctgctaaaacctcactgacacaagccaaagtcacaatgaggcttacagcacacagt

SEQ ID NO: 18297 - DNA, 601 bp, Human
taaaatgaagtgattatgacaatatgctagcatcaatgctcttgtgctttggagccattattaattaaaattaacggtgacttgaacacaagtaccacaataacttaacagtggatctcaccgtggagacggctcctcagtgactcacgggctgggagcgtagacagctggagatgctggacacagggatgattcatgtcctgggctggacggctcaagattccatcacgctagtcagaaaggggtgccatttaaaatgtataaattatttctggaattttccatttaatattatccagaccaaagttgacagcagataactaaaatcaaaactaaaaccaaagaaagtgaaacagcaggcagcaggggaggagctgctaaaacctcactgacacaagccaaagtcacaatgaggcttacagcacacagtgctcaatactgatattggaaccctgtttgttagaaaaaaaaaaaggaaaaagctcaatttcggtcaaccagaaaatcagacatgttagggatgttcctaaatggtctagaagaaaaccaaggatttggtttataagctcattccaattgtatgatgccatatttatagatt

SEQ ID NO: 18298 - DNA, 601 bp, Human
acctaaagattctacttgaaaaacatattaacagctatttgacttctttgaccgtgactgcaccagaccatgcacggcacagagctgcctgcaatgctgtggggtcgtgtgatcaagcctcacctggcaggtgcacaccggcgaatgcgtgcagcagacagcaggttgttaatagattggaaggcaaggataagagccacataacataaaggaaggagctctccttggcaaggacagaattatgcctacccacattcagtttaattccttgtaacaagtgagtgccctggagtgggcaacrtttggctgctggatgtgacgatttttatttccttatcaaaaagatttccaagcctcaatctacggctctttgtttgcacttcagtttaactaaattatcatatgaccagaatatccagtagttttcatttcattttaattggcttagtctgcgtgtctactgcttttcagcatctaataggaggctgtgcagtttcaaataatatttaaaaattagggaaatggttgccagctaataggatgaatttaattgcctctcataggaaaacaaaatcaggaataaaatcaggataaacttcat

SEQ ID NO: 18299 - DNA, 601 bp, Human
taaaggaaggagctctccttggcaaggacagaattatgcctacccacattcagtttaattccttgtaacaagtgagtgccctggagtgggcaacgtttggctgctggatgtgacgatttttatttccttatcaaaaagatttccaagcctcaatctacggctctttgtttgcacttcagtttaactaaattatcatatgaccagaatatccagtagttttcatttcattttaattggcttagtctgcgtgtctactgcttttcagcatctaataggaggctgtgcagtttcaaataatatwtaaaaattagggaaatggttgccagctaataggatgaatttaattgcctctcataggaaaacaaaatcaggaataaaatcaggataaacttcatcattcatgggtaaaaattattaagatgaatctattctaatggattgtactttatcctaatggggaggagaggatttacataaagtcaaagtgagtcacaagataaatgtgaatcgggagaattctaatatgtttgacaaataattctgaaaggcgttttgagaagcatagcatcacaaaactgaaaagcaacccagtttattgaaa

SEQ ID NO: 18300 - DNA, 601 bp, Human
ccggtgtgagcaccacgtgccaggagcacagccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccrgaacaattgcgaattctctctgcctcgcctccccctatctcgtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaag

SEQ ID NO: 18301 - DNA, 601 bp, Human
ctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatctygtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaaggaataaatcactcaaaattaaactttctgtatatagtcaat

SEQ ID NO: 18302 - DNA, 601 bp, Human
gaggcatgcaccatcacacctggctaacttttgtattttttgtggagatggggtttcaccatgttccccaggctggtcttaaactcctaggctcaagcaatccccctgccttggcctcccaaagtgctaggagtacaagcatgagccaccgcgcccagcccccacccatattcgtcttactggactcctattgatcctttaaggcccagcacaagtgtctttgctctgtaaatccattaggagtgccctgcaaattggttctcaaacaaggcacacacacagaacaattctctgtaaacawtttttacctcctactatgtcaggctcacagtgcccatcccgctaagtccagcataacgcagtctgcagggcagagccagtgctatgggtttaggggtgaggtggggcagctgcacgcagaaggaggcgtacaaatggccctaagggacaggtcagcttccaggacctgatttacacatatttctccactgttttaaggtttagaaagtccctaagaggaaaaacattaagataattgttctcgggagggggcgggggggaacgtttggaaaaatctggagacatttttggttttcaaaac

SEQ ID NO: 18303 - DNA, 601 bp, Human
aaacaaggcacacacacagaacaattctctgtaaacattttttacctcctactatgtcaggctcacagtgcccatcccgctaagtccagcataacgcagtctgcagggcagagccagtgctatgggtttaggggtgaggtggggcagctgcacgcagaaggaggcgtacaaatggccctaagggacaggtcagcttccaggacctgatttacacatatttctccactgttttaaggtttagaaagtccctaagaggaaaaacattaagataattgttctcgggagggggcgggggggaacrtttggaaaaatctggagacatttttggttttcaaaacctggggcagtgggtgggtgttgctggcatctagttggtgaaggccaggaatgctgctaaacatcgtacaatgcccaagacagcccccacaacaaggaattctctggcccaaaatgtcaactgtgcatggctgagaaacgtcatagcaagcccttcctccagcattatccaggagctggagaaggaagaagggtgagcggggagaaaggaaactagtgcgaccctccctctgtcccctcctcaggtggacggcgtgctagaaaa

SEQ ID NO: 18304 - DNA, 601 bp, Human
accctgtaagctatcaagcccccacacaaatgagtgggatcacttctgtagggcattagtgtccaggggaagacaggcaggcaggaggctgcagctaccaggcgaggtcacaggtacctgagtcccaggagagtcagccagttgagagattagtttcagtttggagtgtgaataaggcacctcatttctgagcaggcacgaagaacagggtgggcgccacaacacactggaccgcaaaaggctttcatccaggcagctcttctcctgcccccatcccgctgctgtcttccaggaatctgtkcaactctctcgaagccatgttcacctaattgggtacagcctgggtgcacacgtgtcaggatttgccggcagttccatcggtggaacgcacaagattgggagaatcacaggtaaccatgcctaataactcacacactgatctccactccataggggcatccaacaaggacctgcttttccaacaggctcatcattaaaacaccccaacacttattgtgagggatcagcgctcatgagaggacttgtgacattctttcaaacatgaccaatgtcatggattgctgttccagagaattcagag

SEQ ID NO: 18305 - DNA, 601 bp, Human
gattgctgttccagagaattcagagcaaattatagcctcaattcctattgcctgccctcaaacgaatacctcatgttggtgtgccaaatgggactaaaagatggacttttctagcaagaaagagtcttattttttaatctataatttacaaagtccaatttgggcgagttaaggagtgaagaatcacagccttaatttgctgtaattcatcagccacgttagtgcctccgtttccacatttgtgaaacgtgtatgttttagtctgggacccatttgggttgagggagggagctctgcatcmaaaacttcaccccaaactccatacacactcagaaatggcccaagatatccaggaaggtctgcacatgtgcgaggaaggccttcctcccaggcttccgtgacaccaaccccacccttcacactgccaggcattggatccaaaaacacacagctggtgagattgttccccagtccaagtctgaggcccactgataccacaggtataaaacccgggaggcacaggcaaggcctttctcggtgtggaagccccagagtgccccagcctctcctcctgctgatcccttcccatagctctaggctt

SEQ ID NO: 18306 - DNA, 601 bp, Human
acggggtttcaccatattggtcaggctggtctcgaactcccaacctcaggtgatccaccatctcggcctcccaaagtgctgggattacagacgtgagccaccacggccggccatgaggacatttttacaaacaactactatctgctattaccattcctttataaaagaatttcttttaacttgagaaagaatggggataatggcagacgtttcaacagaatacacttgtgattatgacagctcatttcctcatgcttttttgttcatcttgctggtcactggggaagcctggtcacagacyggcgtgtggcccccatggatttaacccacaatagcctggggatgagcagccctcccactgaagaagcagggccagaggtcagagtccacacccagcgaggcagcctcaggcccaaggcccagaaccctctccatccaactggtgctgtgggtcacattaggcgtatcagctgggcccacccacctcagagacagcaggaaagctcaacaccctcttgccgtcttgtcatcagcctgataaagaaaggaacagaaatcatatcaggacatttttctttttctctttctttttttttttttt

SEQ ID NO: 18307 - DNA, 601 bp, Human
gcctggtcacagaccggcgtgtggcccccatggatttaacccacaatagcctggggatgagcagccctcccactgaagaagcagggccagaggtcagagtccacacccagcgaggcagcctcaggcccaaggcccagaaccctctccatccaactggtgctgtgggtcacattaggcgtatcagctgggcccacccacctcagagacagcaggaaagctcaacaccctcttgccgtcttgtcatcagcctgataaagaaaggaacagaaatcatatcaggacatttttctttttctctttytttttttttttttttttttgagacagagtctcattctgttgcccaggctacagggcagtggcatgatcttggctcactgcagcctccacctccctggttcaagtgattctcctgcctcagcttcccaagtagctgggactacaggtgtccaccaccacgcccggctaatttttgtatttttagtagaaacggggttttgtcatgttgcccaggttggtctcgaactcctgacctcaggtgatctgccagactcagcctcccaaagtgctgggattaccaggcgtgagccaccgcacccgg

SEQ ID NO: 18308 - DNA, 601 bp, Human
aggctacagggcagtggcatgatcttggctcactgcagcctccacctccctggttcaagtgattctcctgcctcagcttcccaagtagctgggactacaggtgtccaccaccacgcccggctaatttttgtatttttagtagaaacggggttttgtcatgttgcccaggttggtctcgaactcctgacctcaggtgatctgccagactcagcctcccaaagtgctgggattaccaggcgtgagccaccgcacccggccaaggacatttttcatttgtcactgtgggtagggctggagaacrggtgatctcacggctcactctcaattccttcgccccccaagtagggaaggaaaccagggctggggtgggacaccagagggtcctccagagaaggcagaggaagaaagacagggaaaaaaaacttggagcgcataaatactccccaaccacagtcagccaggaggtgccaccttacttcatgcacagacatctgtcacttgaggcccagagctttgagctcccctacttgcacacaacattttcacatacagtgaaatgtcccgcggctgttctggacgttctaatgaaatgacatcttag

SEQ ID NO: 18309 - DNA, 601 bp, Human
tttgtcatgttgcccaggttggtctcgaactcctgacctcaggtgatctgccagactcagcctcccaaagtgctgggattaccaggcgtgagccaccgcacccggccaaggacatttttcatttgtcactgtgggtagggctggagaacgggtgatctcacggctcactctcaattccttcgccccccaagtagggaaggaaaccagggctggggtgggacaccagagggtcctccagagaaggcagaggaagaaagacagggaaaaaaaacttggagcgcataaatactccccaaccacrgtcagccaggaggtgccaccttacttcatgcacagacatctgtcacttgaggcccagagctttgagctcccctacttgcacacaacattttcacatacagtgaaatgtcccgcggctgttctggacgttctaatgaaatgacatcttaggagaaaaatcagcttgtttagggaaattattgacaacatacaggcaaataaatttcattctttgataggtaggttggaactacttataatgagcatattggctttttttgtatgcaaacagatggtcttgaaagtagcttgagaggtactc

SEQ ID NO: 18310 - DNA, 601 bp, Human
gccaggaggtgccaccttacttcatgcacagacatctgtcacttgaggcccagagctttgagctcccctacttgcacacaacattttcacatacagtgaaatgtcccgcggctgttctggacgttctaatgaaatgacatcttaggagaaaaatcagcttgtttagggaaattattgacaacatacaggcaaataaatttcattctttgataggtaggttggaactacttataatgagcatattggctttttttgtatgcaaacagatggtcttgaaagtagcttgagaggtactcaaaaytgatttgctcaagtaaatcaagcattccctcataaccttattcctttttttttttctttttgagacaggatctccctctgttgcctagactgggtcacagtggtgcagtcatgattcgctgctacctcaaactcctgggctcaagcaaccctcctgccacagcctcctgagtggctgaaactacaggcacaggccaccacatccacataatttttgtattcttttttattttagagatggggtttcactatgctgcccaggcctcctggcctcaggcatcataaccttgtgtctaccact

SEQ ID NO: 18311 - DNA, 601 bp, Human
cgttctaatgaaatgacatcttaggagaaaaatcagcttgtttagggaaattattgacaacatacaggcaaataaatttcattctttgataggtaggttggaactacttataatgagcatattggctttttttgtatgcaaacagatggtcttgaaagtagcttgagaggtactcaaaactgatttgctcaagtaaatcaagcattccctcataaccttattcctttttttttttctttttgagacaggatctccctctgttgcctagactgggtcacagtggtgcagtcatgattcgctsctacctcaaactcctgggctcaagcaaccctcctgccacagcctcctgagtggctgaaactacaggcacaggccaccacatccacataatttttgtattcttttttattttagagatggggtttcactatgctgcccaggcctcctggcctcaggcatcataaccttgtgtctaccactggagagtttccgcaaacctctttccccgctagctaatgcccagcctgtgtgtcattgttagcaccatgaactactgtggttttactgagaaaaggttacggcgaggttttctagggaagga

SEQ ID NO: 18312 - DNA, 601 bp, Human
cctcataaccttattcctttttttttttctttttgagacaggatctccctctgttgcctagactgggtcacagtggtgcagtcatgattcgctgctacctcaaactcctgggctcaagcaaccctcctgccacagcctcctgagtggctgaaactacaggcacaggccaccacatccacataatttttgtattcttttttattttagagatggggtttcactatgctgcccaggcctcctggcctcaggcatcataaccttgtgtctaccactggagagtttccgcaaacctctttccccrctagctaatgcccagcctgtgtgtcattgttagcaccatgaactactgtggttttactgagaaaaggttacggcgaggttttctagggaaggatcagccctacgtgtttcttcttcctgctagttcactgatgtataataatatccaaaagctaaaaagcacatctctcttcccctctccttgctcccgcgtaacccttacccctgctttcccattagggctggatgccgcgggacctttgtttgagggaagtgcccccagcaatcgtctttctccagatgatgccagttttgtggatgc

SEQ ID NO: 18313 - DNA, 601 bp, Human
atctccctctgttgcctagactgggtcacagtggtgcagtcatgattcgctgctacctcaaactcctgggctcaagcaaccctcctgccacagcctcctgagtggctgaaactacaggcacaggccaccacatccacataatttttgtattcttttttattttagagatggggtttcactatgctgcccaggcctcctggcctcaggcatcataaccttgtgtctaccactggagagtttccgcaaacctctttccccgctagctaatgcccagcctgtgtgtcattgttagcaccatgarctactgtggttttactgagaaaaggttacggcgaggttttctagggaaggatcagccctacgtgtttcttcttcctgctagttcactgatgtataataatatccaaaagctaaaaagcacatctctcttcccctctccttgctcccgcgtaacccttacccctgctttcccattagggctggatgccgcgggacctttgtttgagggaagtgcccccagcaatcgtctttctccagatgatgccagttttgtggatgccattcatacctttacccgggagcacatgggcctgagcgtggg

SEQ ID NO: 18314 - DNA, 601 bp, Human
ctcctggcctcaggcatcataaccttgtgtctaccactggagagtttccgcaaacctctttccccgctagctaatgcccagcctgtgtgtcattgttagcaccatgaactactgtggttttactgagaaaaggttacggcgaggttttctagggaaggatcagccctacgtgtttcttcttcctgctagttcactgatgtataataatatccaaaagctaaaaagcacatctctcttcccctctccttgctcccgcgtaacccttacccctgctttcccattagggctggatgccgcgggrcctttgtttgagggaagtgcccccagcaatcgtctttctccagatgatgccagttttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatggtgagaatgaagtcatgggccgggagcaccggcctacatttcaatggggcctctggaattcagcggaatctaccaacatacgg

SEQ ID NO: 18315 - DNA, 601 bp, Human
acctctttccccgctagctaatgcccagcctgtgtgtcattgttagcaccatgaactactgtggttttactgagaaaaggttacggcgaggttttctagggaaggatcagccctacgtgtttcttcttcctgctagttcactgatgtataataatatccaaaagctaaaaagcacatctctcttcccctctccttgctcccgcgtaacccttacccctgctttcccattagggctggatgccgcgggacctttgtttgagggaagtgcccccagcaatcgtctttctccagatgatgccarttttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatggtgagaatgaagtcatgggccgggagcaccggcctacatttcaatggggcctctggaattcagcggaatctaccaacatacgggactcagggaagagttcagcaaggataggggcccagggtgtatggtcaccaag

SEQ ID NO: 18316 - DNA, 601 bp, Human
cctgtgtgtcattgttagcaccatgaactactgtggttttactgagaaaaggttacggcgaggttttctagggaaggatcagccctacgtgtttcttcttcctgctagttcactgatgtataataatatccaaaagctaaaaagcacatctctcttcccctctccttgctcccgcgtaacccttacccctgctttcccattagggctggatgccgcgggacctttgtttgagggaagtgcccccagcaatcgtctttctccagatgatgccagttttgtggatgccattcatacctttacscgggagcacatgggcctgagcgtgggcatcaaacagcccataggacactatgacttctatcccaacgggggctccttccagcctggctgccacttcctagagctctacagacatattgcccagcacggcttcaatggtgagaatgaagtcatgggccgggagcaccggcctacatttcaatggggcctctggaattcagcggaatctaccaacatacgggactcagggaagagttcagcaaggataggggcccagggtgtatggtcaccaagcccacccagagagaaggaatgctggagt

SEQ ID NO: 18317 - DNA, 601 bp, Human
ccacttcctagagctctacagacatattgcccagcacggcttcaatggtgagaatgaagtcatgggccgggagcaccggcctacatttcaatggggcctctggaattcagcggaatctaccaacatacgggactcagggaagagttcagcaaggataggggcccagggtgtatggtcaccaagcccacccagagagaaggaatgctggagtgggcaagggtgcctgtcccccagcaggccactcctggcaacaggccaacgccacgccctgaggatgaacagagggcaccaacaggaaccyccacttctcactccagccccatgtgcccaggcaaaccctctcccggggtaccagctcttctgagagttgagtccggatgcctgtggttattcttccttctctggaagtttcctcgttccagggaccgcctctattctgaaccacataaggatccacttaataggttgtggcttctcgatgaaggtctcactcttcatcccaccccatcagtttaattgaggaaattactcagactctcccaatgggaaattcagcttcaaatatgtccttgttatgccctttacctcagggcagacacgg

SEQ ID NO: 18318 - DNA, 601 bp, Human
gctctacagacatattgcccagcacggcttcaatggtgagaatgaagtcatgggccgggagcaccggcctacatttcaatggggcctctggaattcagcggaatctaccaacatacgggactcagggaagagttcagcaaggataggggcccagggtgtatggtcaccaagcccacccagagagaaggaatgctggagtgggcaagggtgcctgtcccccagcaggccactcctggcaacaggccaacgccacgccctgaggatgaacagagggcaccaacaggaacctccacttctcacyccagccccatgtgcccaggcaaaccctctcccggggtaccagctcttctgagagttgagtccggatgcctgtggttattcttccttctctggaagtttcctcgttccagggaccgcctctattctgaaccacataaggatccacttaataggttgtggcttctcgatgaaggtctcactcttcatcccaccccatcagtttaattgaggaaattactcagactctcccaatgggaaattcagcttcaaatatgtccttgttatgccctttacctcagggcagacacggaatgtgctgtta

SEQ ID NO: 18319 - DNA, 601 bp, Human
agcaaggataggggcccagggtgtatggtcaccaagcccacccagagagaaggaatgctggagtgggcaagggtgcctgtcccccagcaggccactcctggcaacaggccaacgccacgccctgaggatgaacagagggcaccaacaggaacctccacttctcactccagccccatgtgcccaggcaaaccctctcccggggtaccagctcttctgagagttgagtccggatgcctgtggttattcttccttctctggaagtttcctcgttccagggaccgcctctattctgaaccacatraggatccacttaataggttgtggcttctcgatgaaggtctcactcttcatcccaccccatcagtttaattgaggaaattactcagactctcccaatgggaaattcagcttcaaatatgtccttgttatgccctttacctcagggcagacacggaatgtgctgttatctgggttgtgatcccacttctctctcaagtcctaaaaccgaaatattaacatgcacattgataatatgcacaggattaaagaacaaaaatgtcagcagaagcagcacattccacgggcattccaaatttcttgc

SEQ ID NO: 18320 - DNA, 601 bp, Human
atgacaccatcctcgcctctccaatatcagagtgaccttcacactccgcatcatctcattttggctggactcccagccttccaccgcccaggcctgagagagccttctgggaacttgcccttatcattgcttacatccctcccacctcccccactccaacacctcccctccagccaccagcagttcccagctgaccatccagccctcatcccaaacttcaccccacccaacaaagctcagtacagaccatcaggatggtgtatgggctttattttcctggtaaacacatttctgaccaatyattaccatttgctcttttgtgctaaacttcaaagtgacggaaccaaatgtaggtattcagcttgcccaagcttgggctggtttttctcagtcgtcttcacccctgtgtttgaaagggttcctggggtagttctcccagccacagctgcacaggggctcactggataactgcagattcaccttcactacctcctgggtggatgagcttgggtgagttagtggatgtcttggaagctcagttttctcgtcgaaaacagcggcctcaaggagctgcagtgaagatgcaggcagtggaggagcg

SEQ ID NO: 18321 - DNA, 601 bp, Human
gaattatttaccacagattaggttaaaatttggagagttaaaaaaaaaaggtcaaatccttagtagatcaacctcataagcttgttttgggggtgaggcctgtccagatctggttactgggcaatgtccttccaaatccaattcttgtgctggtttcacaggcctgttacctaagggatgcaatggctgctttgggacacaaggtagacattgtcgagaggcctcagcgttctccagaccatcagagtgccacgggattgtctcgtgtatctagttatattaagagaagaggagtcccacrcaagcctgttccagaaaacccaccctccaggcatcagcacctgggcattttaaattatctcatttgagatagaaatatttctataataaattacactaacctgctctcttaatgaatttgatctttccttagtgacttgggtgcctattaaaatgcctactgtaacacgctgtcataaaggagtgctctcaggatcccggcagtgcccgggattttgcctgacactacatgactcagagggtctacttcccttagtttcagtcagttgtcacatcctgctcttgtcaaggggtctgcctt

SEQ ID NO: 18322 - DNA, 601 bp, Human
taggagcaaaaaaatgttgttaacatattaatatctatccaaactcttccctctgcatgtttaaattttaagaaataagagatttttaaatttaaaatcactgcttaaattatctctctctttctctctctgtctctctctctagtttatcattaccagttcaagatccagttcatcaaccaaactgagacaccaatacaaacaacttttaccatgtcactactcggaacaaaagagaaaatgcagaaaattcccatcactctgtgagtaggaggtgtagccccctagggtgatgacacayttatttttcttgcagaacataaatggactctgtaattttcaagagtcaggccagctacaactactttattccagacgcaaaccaaaaactatctgagacacatgtcaatcaatttagtttattttgccaaggttaaagacattatcgtgacacagcctcaggaggtcctggtgacctgtatccaaggtggtcaggctacagcttggctttatacattataggaagatataagacatcaatcagtacttgtaagatgtacactggtttggtccagaaaggcaggagaactcaaagtggttt

SEQ ID NO: 18323 - DNA, 601 bp, Human
atttaaaatcactgcttaaattatctctctctttctctctctgtctctctctctagtttatcattaccagttcaagatccagttcatcaaccaaactgagacaccaatacaaacaacttttaccatgtcactactcggaacaaaagagaaaatgcagaaaattcccatcactctgtgagtaggaggtgtagccccctagggtgatgacacacttatttttcttgcagaacataaatggactctgtaattttcaagagtcaggccagctacaactactttattccagacgcaaaccaaaaastatctgagacacatgtcaatcaatttagtttattttgccaaggttaaagacattatcgtgacacagcctcaggaggtcctggtgacctgtatccaaggtggtcaggctacagcttggctttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatc

SEQ ID NO: 18324 - DNA, 601 bp, Human
tttatcattaccagttcaagatccagttcatcaaccaaactgagacaccaatacaaacaacttttaccatgtcactactcggaacaaaagagaaaatgcagaaaattcccatcactctgtgagtaggaggtgtagccccctagggtgatgacacacttatttttcttgcagaacataaatggactctgtaattttcaagagtcaggccagctacaactactttattccagacgcaaaccaaaaactatctgagacacatgtcaatcaatttagtttattttgccaaggttaaagacattaycgtgacacagcctcaggaggtcctggtgacctgtatccaaggtggtcaggctacagcttggctttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtctggattaagataaggggttgtggagaccaaggt

SEQ ID NO: 18325 - DNA, 601 bp, Human
tttaccatgtcactactcggaacaaaagagaaaatgcagaaaattcccatcactctgtgagtaggaggtgtagccccctagggtgatgacacacttatttttcttgcagaacataaatggactctgtaattttcaagagtcaggccagctacaactactttattccagacgcaaaccaaaaactatctgagacacatgtcaatcaatttagtttattttgccaaggttaaagacattatcgtgacacagcctcaggaggtcctggtgacctgtatccaaggtggtcaggctacagcttggytttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtctggattaagataaggggttgtggagaccaaggttcttattatgcagaagaagcctccaggtagcaggcttcagagacaattgattgtaaatgtta

SEQ ID NO: 18326 - DNA, 601 bp, Human
tcaatcaatttagtttattttgccaaggttaaagacattatcgtgacacagcctcaggaggtcctggtgacctgtatccaaggtggtcaggctacagcttggctttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagrgagtgtctggattaagataaggggttgtggagaccaaggttcttattatgcagaagaagcctccaggtagcaggcttcagagacaattgattgtaaatgttacttatcagacttaaaaaggtgccagacttagttcattctctcccagatcagtgaaaagacctggatagggaagggaattctctacagaatgtagattttcccaccacaagacagctgttcagggccctttcaaaatatgtcaaagaaatatattttagggtaaaatagtttaatttctttcagggcctgctgtctgtc

SEQ ID NO: 18327 - DNA, 601 bp, Human
tttagtttattttgccaaggttaaagacattatcgtgacacagcctcaggaggtcctggtgacctgtatccaaggtggtcaggctacagcttggctttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtckggattaagataaggggttgtggagaccaaggttcttattatgcagaagaagcctccaggtagcaggcttcagagacaattgattgtaaatgttacttatcagacttaaaaaggtgccagacttagttcattctctcccagatcagtgaaaagacctggatagggaagggaattctctacagaatgtagattttcccaccacaagacagctgttcagggccctttcaaaatatgtcaaagaaatatattttagggtaaaatagtttaatttctttcagggcctgctgtctgtcatgtgatg

SEQ ID NO: 18328 - DNA, 601 bp, Human
ctttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtctggattaagataaggggttgtggagaccaaggttcttattatgcagaagaagcctccaggtagcaggcttcagagacaattgattgtaaatgttwcttatcagacttaaaaaggtgccagacttagttcattctctcccagatcagtgaaaagacctggatagggaagggaattctctacagaatgtagattttcccaccacaagacagctgttcagggccctttcaaaatatgtcaaagaaatatattttagggtaaaatagtttaatttctttcagggcctgctgtctgtcatgtgatgctatactagagtcaggctggaatttggtgtcttattgctacaaaaagtctgcttcatcagtcttaaaatctgggttttaatgttaatgctggtc

SEQ ID NO: 18329 - DNA, 601 bp, Human
tggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtctggattaagataaggggttgtggagaccaaggttcttattatgcagaagaagcctccaggtagcaggcttcagagacaattgattgtaaatgttacttatcagacttaaaaaggtgccagacttagttcattctctcccagatcagtgaaaagayctggatagggaagggaattctctacagaatgtagattttcccaccacaagacagctgttcagggccctttcaaaatatgtcaaagaaatatattttagggtaaaatagtttaatttctttcagggcctgctgtctgtcatgtgatgctatactagagtcaggctggaatttggtgtcttattgctacaaaaagtctgcttcatcagtcttaaaatctgggttttaatgttaatgctggtcagttgtgcctgaattccaaagggaggagagtataaagaggcgtgtcccacctccccttcc

SEQ ID NO: 18330 - DNA, 601 bp, Human
cctctggatgctcacaacctggcagggcggggggattcctaaacaattcttcacagcatactcgggaagagctatgccaagccacacaagggacccccccccaaccccaccatccatctgcctcgccctaaatccactgctgcctctgcactgccaaaaatctctcccaggggatggttctcaatagtggaaagggcatctcgctgctctgtcaacgttgggatattttagtgtcttggagattagtgagtaaagctgatcatgatacctcagagtctgcatttaaatcttgctctaaatyggtgcatcctttttatgtgtagtttttctattactgttatgcctcactgttttaacagaggtttctatttatatggggggaggagcattacttgggagagagtgcatgctgcaggcatactatgttaaacctacagagagctgaactgtccagacgccgttgccaaagccccactgtctccacagcggcttcttcctagaagctaagctagagaaagttaactagatttgttatagtgggacttctcggagcctttttgatgtgttagccagaaaatagtatagttttcgcaattttatt

SEQ ID NO: 18331 - DNA, 601 bp, Human
aaaatctctcccaggggatggttctcaatagtggaaagggcatctcgctgctctgtcaacgttgggatattttagtgtcttggagattagtgagtaaagctgatcatgatacctcagagtctgcatttaaatcttgctctaaatcggtgcatcctttttatgtgtagtttttctattactgttatgcctcactgttttaacagaggtttctatttatatggggggaggagcattacttgggagagagtgcatgctgcaggcatactatgttaaacctacagagagctgaactgtccagacrccgttgccaaagccccactgtctccacagcggcttcttcctagaagctaagctagagaaagttaactagatttgttatagtgggacttctcggagcctttttgatgtgttagccagaaaatagtatagttttcgcaattttattatctggaaatcccttttttatcctggcacacctactgctaactctatcaatagtctgttgaacactagtttgggaaatgcagcaaaaatcccaagtcattcagggaaacacaacacatcctgaatgtgtgtgaccgtcactttgctgttacgacta

SEQ ID NO: 18332 - DNA, 601 bp, Human
attcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaaggtgactgctgattcaatctcctattaacgtccattaagcacccacttgtgccaggcagtctcacaatttaatactcacattcatcatgtgaggtgagtattattaggcccyagtgatggagtacagaagctcagaaaggtgaagtgactatcccaactttacatagccacaggtgccaggacaaggattcacacccaggtctttgaatacacaccagggtctccccactgcccgtggctaacgctgcctgcctctggagcctgaggaccaccacactaaccccaggcttctcaagcttcagtgcaggtgaatcaccaggtgatgtcagtgctgccagtccaaggtgctgtggtagatgcaacatcttttttttattgtttgcccaaagtaaatcttttaacagatcacaat

SEQ ID NO: 18333 - DNA, 601 bp, Human
agagggaggggcctggcccttccagggctcccacacggggtgagcattgaagcaggtgctccatggcattggtctcacgtgatctttgctgtgatcctgaaatgggtagtattggctgtgcagattaggaacctgaggctcacagaagttacacagcttgaggacattgctcaaaattgtcccagtccagatttgactgggatttgtctgatttattacccatttgttgggggtgtgctgtttccaacagttccttcttccattagttttggttccattaatctgaattttctcagtctawtctagcagagttgcagtgctggacattaacatatgtatgcatcaaacccatccttagggctgtaggaggtactgcatgcaggttatgggagctataattttttttaggttgtaaataccgagtgcctcctctgtgtctacacagtgccaggtactatcggagaatacaaaaaaaaaaaaaaaaatctgagttgtggctcttggtagaaataaactccaggacctaaccaggaaaataagatgaattaattttactaacggtgtggtccatcccagggcttctcaaactttcacgagcata

SEQ ID NO: 18334 - DNA, 601 bp, Human
tcttcaagactcagttgtttagtgataaacgagaatcataatatacatttcatgagactaataacaactactaattttttagtgccttttgcagaccaaaatcccagaatcgggatgggaacattaaactctacactcgtaatatcgctgctaagtgcaagtgggaaaagaagtaggttaagtaacttgctctgtgcctccatggaagaaattcagtggaaggtggttttcttcccccaaaggcacaaaatcagggatgagtagggttgtggagatggtgaagagaaagagaagaaattaytggccctacagcaagaccaagtataataactggctaaacctaatgagaagacattcaatttccacagtactcatataaatgcaaaataaaatcaaagaaattatcactggttactcattagtttggcaggaattcaaaaacggacaacacccagagttagtaaagatgtggagaaacgggcattctcatacactattagtgagagtgtaaattacaggcattttgtaggggaatttcattcaacaactaacgtttagtgagtacctaccttatgccagacaatgttgtggacaccagatg

SEQ ID NO: 18335 - DNA, 601 bp, Human
caggactttccttcttacagaactgaaatcaccccagtgaagaactccaggaagtcttacactgatggctttcactgacttgggttttgtttttctctgaagttacaaaaatatttgcgaacataagaatctaacttaaaaaaagacatcacatgccttacacaaattgagtgaaatttgataaagaatgaaacacttcaataagctccacctaaaacttaatgctgtgtttgcttcctgttttctattcagaatgacattttgttcagaaaacacagatgacctactacttcgcccaacmcaggaaaaaatcttcgtgaaatgtgaaataaagtctaaaacatcaaagcgaaagatcagatgagatttaatgaagacccagtgtaaagaataaatgaatcttactccttatctggaatggctgccttatttagaagccaaaattacataaagaatctcacacaaagcttaaataaagtttagatttaaggggggtatgtttcactctcataaactgagcttttaaaaacgatatgatataactattttccagtatcagtacaaccaaaaatgtcccaattttatctctggttaaatgtta

SEQ ID NO: 18336 - DNA, 601 bp, Human
gttctcctgtccagcccactgctgctggatctccctgtaaacagattcccccagtaaaacctatgtttgtttgctgactccatctcttctttggcctcttgaacctggtgccatccctactgaagtgaataggggtctgacatgacaatgacccagagaagaaaaattcatcctgtgtcccacgggatggcctgacctgtgggccactttcctgggctggcaagacaactattagtcacaaactgctgtgtggaattctgagatgccagagaatgagagctgaatctctgttttgagttayagtatagttgagaaaaatatactcaaataggacatcagtctcctcatatccccaggcagtttcctctggaaggtaaagaattgcagagacagaacagcccaacacgtacctggttcccccttttctcccttggtgccatcacgcccatctttgcctgggaagccgttgatgcctggagagctacaggcaatcactgcagggcaggtcttttgggcatcctcacaggtcacagtttctgagtaagacgctgccaccatactcaggagaaggagagggagtgatggaaacagggacatggtc

SEQ ID NO: 18337 - DNA, 601 bp, Human
taactgtatggtgtgcacctgagagcaataacttaagaaataaagttgccacgtggaggttgctgcagggagggtgcaaagtgaaaattaactgcatttgtttttaccagtagttgttgttctcctgtccagcccactgctgctggatctccctgtaaacagattcccccagtaaaacctatgtttgtttgctgactccatctcttctttggcctcttgaacctggtgccatccctactgaagtgaataggggtctgacatgacaatgacccagagaagaaaaattcatcctgtgtcccaygggatggcctgacctgtgggccactttcctgggctggcaagacaactattagtcacaaactgctgtgtggaattctgagatgccagagaatgagagctgaatctctgttttgagttacagtatagttgagaaaaatatactcaaataggacatcagtctcctcatatccccaggcagtttcctctggaaggtaaagaattgcagagacagaacagcccaacacgtacctggttcccccttttctcccttggtgccatcacgcccatctttgcctgggaagccgttgatgcctggagagct

SEQ ID NO: 18338 - DNA, 601 bp, Human
tggcctgttggaagacaaaggaaatgtgacttaatatctatgttcttgctctctctcttcaagagtttgatgcccaatcccttctcaggagaaaggagaccttgacccaggactgacctttctgagcactgctctcaataactgtatggtgtgcacctgagagcaataacttaagaaataaagttgccacgtggaggttgctgcagggagggtgcaaagtgaaaattaactgcatttgtttttaccagtagttgttgttctcctgtccagcccactgctgctggatctccctgtaaacagrttcccccagtaaaacctatgtttgtttgctgactccatctcttctttggcctcttgaacctggtgccatccctactgaagtgaataggggtctgacatgacaatgacccagagaagaaaaattcatcctgtgtcccacgggatggcctgacctgtgggccactttcctgggctggcaagacaactattagtcacaaactgctgtgtggaattctgagatgccagagaatgagagctgaatctctgttttgagttacagtatagttgagaaaaatatactcaaataggacatcagtctcct

SEQ ID NO: 18339 - DNA, 601 bp, Human
gaagcctaaagcctatcttatttctactcttgggaatcctgtaatcactgctatgtgaacaagccctgttggatgatgagagatgtggttcaattaccctcatcactccagctaacattcagacaacagccagacacatgagtgagactattggccatcagttgaccacagacatgtgggtaagcccagcttaaaccagcagagaaatcacatggccgacccacagacttgtgatttaaattgacggctatgtttttaagctattaagctttggcttggtttcttatgaagtaaaatatgrcataccatggttacatgcttttgtaaaaataggtataataagcccacacttagatggcctgttttctccctctaggaccagggcctcacattagactgtttcagctgatggagaatccaggctcagctcttacagggagtgcctgatgagggagttgtcttgaaaagtttgtaagtctgtactcaggcacttataggaattccctaaggctctaagaatgaagagagggctgagggcactgggtcagaaagcaaatttgggtatcttcctttgaaggaacaggagaaggggcacctctta

SEQ ID NO: 18340 - DNA, 601 bp, Human
attttacattgatgtttacactttgaaggaaaataaaaaatactgaaaagcccaaagaatgaaaaatcgctatttccatccaaccccaaatgtccctctttgtctgtttactgtatcccaaagtacgcatacatatcacatgcacacatatactccctgattacctagcaatccatatgccaggttcttcacagatttttttttcaaataaattgttctatcaaaactaaaaagaaatctcttgaggcgttactctattatgacctggtgaagagtgacgaaaaagattgcagagtttttrtctttggagaggttttgcttttgatgtcttttgttttgtttttgttttttccaggtttgttctgttagtcaggaaaccaagatttttgtgagttgcccattatccaagtggggagggcatgagcaaatcacttgttgtagtagatggcaaaaatggcctcaatagggtacagctcctcgcattaagacatgagtctattaccccactccttgaatctgggctggccttgtgacttgttttgaccaatacagtctgacagaaatgataatgtgctctgagtcttcaagaagcctaaagcct

SEQ ID NO: 18341 - DNA, 601 bp, Human
tttctgtttgcagagcttttctttctgaggcagccaggctactatcaccatctagaaaattagaacaaagtaaagaagcattgttgagaaggagcctcagaactgtgcatatacaagggagtggagtatctttttcaaactgaaaaaaaaagcttattttacattgatgtttacactttgaaggaaaataaaaaatactgaaaagcccaaagaatgaaaaatcgctatttccatccaaccccaaatgtccctctttgtctgtttactgtatcccaaagtacgcatacatatcacatgcacrcatatactccctgattacctagcaatccatatgccaggttcttcacagatttttttttcaaataaattgttctatcaaaactaaaaagaaatctcttgaggcgttactctattatgacctggtgaagagtgacgaaaaagattgcagagtttttgtctttggagaggttttgcttttgatgtcttttgttttgtttttgttttttccaggtttgttctgttagtcaggaaaccaagatttttgtgagttgcccattatccaagtggggagggcatgagcaaatcacttgttgtagtagat

SEQ ID NO: 18342 - DNA, 601 bp, Human
ctatttttcccaaacttcaagctgcctggagagtaagagaaaaagcttacactttttgatacgtgccatttctgtttgcagagcttttctttctgaggcagccaggctactatcaccatctagaaaattagaacaaagtaaagaagcattgttgagaaggagcctcagaactgtgcatatacaagggagtggagtatctttttcaaactgaaaaaaaaagcttattttacattgatgtttacactttgaaggaaaataaaaaatactgaaaagcccaaagaatgaaaaatcgctatttccrtccaaccccaaatgtccctctttgtctgtttactgtatcccaaagtacgcatacatatcacatgcacacatatactccctgattacctagcaatccatatgccaggttcttcacagatttttttttcaaataaattgttctatcaaaactaaaaagaaatctcttgaggcgttactctattatgacctggtgaagagtgacgaaaaagattgcagagtttttgtctttggagaggttttgcttttgatgtcttttgttttgtttttgttttttccaggtttgttctgttagtcaggaaac

SEQ ID NO: 18343 - DNA, 601 bp, Human
tcaaaattcaacattaggagcaagtcaaaaactagcaaaatatttgtaatacacattaaaaaggacatattcagaatgtaaaaataacttaaaaatcagtaagaaaaatattggctaactaatttaaacaaaatacaaaaatgtgaacgggtacttcacaaaagaagatacccaagtgcccaataagcatataaaaaagtgttcaaccttattacatgttggggaaatacagattaaaaccatggggaaatatcactttacatccacaggaataatgaaaatcaagagaactgaaaacatygactttttacaagcacatagagcatctaggactgccacacattgccggtaggagcataaattcatacaatcacttaggaaaactggtaatatctactaaagctgaatacatgctttcctcatcctctaccagttccactcctggataggtagtgaaattagtgcaccatgtccaccaaaagacaagtccaggaatgttcgtgggttctcttcctcatggccaaaaattggaagccacttaagtgcctattaacaatagaatggatgaactgaggaatattaatataagggaaccctacat

SEQ ID NO: 18344 - DNA, 601 bp, Human
tcttcatggtttcaaaatcatgaaaaatatcttatgattttgggatgggcaaaaatttcttaaacatgacacaaaaagcactaattttgaaagaaaatatgaataaataagactttctcaaaattaggaaattttgttcatcaaaattcaacattaggagcaagtcaaaaactagcaaaatatttgtaatacacattaaaaaggacatattcagaatgtaaaaataacttaaaaatcagtaagaaaaatattggctaactaatttaaacaaaatacaaaaatgtgaacgggtacttcacaraagaagatacccaagtgcccaataagcatataaaaaagtgttcaaccttattacatgttggggaaatacagattaaaaccatggggaaatatcactttacatccacaggaataatgaaaatcaagagaactgaaaacattgactttttacaagcacatagagcatctaggactgccacacattgccggtaggagcataaattcatacaatcacttaggaaaactggtaatatctactaaagctgaatacatgctttcctcatcctctaccagttccactcctggataggtagtgaaatta

SEQ ID NO: 18345 - DNA, 601 bp, Human
ggatcttgctctgttgccctgatgtgatctcagctcactgcaacctctgcctcccaggctcaagcaatcctctcacctcagcctgttttctgttttttcaatagctgaaaatacaggtgtgtgctaccacgcctggctcatttttttgtatttttggtagagacagggtttcaccatgttgcccaagctggtctcaaactcctgagctctagcaatccacccaccttagcctcccaaagtgctgagattatttataagtgtgagccaccatgcctagcctatatttctcaaatagtacttytcaaacgttttaagcaggacaactgtttcaaataagatcttacacaggtcagcaaaacccagattatacgctttaaaaataaaaataagccgggcacggtggcctatgtctgaaatcccagcactttgggaggctgaggcgggaggatcacttgaggtcaggagttcgagaccagcctggccaacatggtgaacagcactgagaagattctataccaaccccgttcatatgattgcatagcaatccctttttgctaacctagagatgtttgtctgacatgagtattaatcataaatgtag

SEQ ID NO: 18346 - DNA, 601 bp, Human
catggaattgtcacctggatagcctcggtaccctctaaactggtggcatttttcttttacagtttttttttagtctctttacctatagggacagctgcttaaaaaaatccagatggcctggagcctcctgatcccttgccaaaaaccagaggaagttaagatcagagcaaaaccagtgcaaactggaagaggtgacttccagttaccttaagatcatttacacattgttataaggctaaaggtccctcccctaaaagaagatggccagggttttgtgtccatgcgatgtaggaagaagcaygctggggacagcgcctgcacatatggaaccctgccctgggcctgcttacctatctcccttcccctccctggactctaaaatcgccctgcctcccatccctggcaagcagacgcctgcagaggtgagctccccttctccattctttggccactgataacacctgattgcctttttcaatcggacattctttctttctttttttttccccccaaaatgtttaagagacagggtcttgctctgttgcccaggccggagtgcagtggcacatcctcagctcactgcagcctggaactccctggc

SEQ ID NO: 18347 - DNA, 601 bp, Human
ttcgagaccaacctgggcaacatagcaagaccccatatctaaaaaaaaaaaaaattaaaaaaaatacagtagggataaaagaaaattaggggggaaatacttcagtacttttcaggtcactattcctaaggatgctaggttttccagatcccagggtcctttctcactggaagacccagggacttctggatttgaagactcatgcagcataccacatcctttcccctcccaggtctcaggggtccctggactcccaattcttttttttttttttttttgagacagagttttgctcttgtcrcccaggctagagtgcagtggcatgatcttggctcactgcaacctctgcctcctcggttcaagcaattctcctgcctcgaagccttctgagtagctgggattatggacacccgccaccacgcccagcaaatttagtatttttagtagagatggcgtttcaccatgttggcaggctggtctcgaactcctcacctcaggtgatccgcccccattggcctcccaaagtgctgggattacaggtatgagccaccgcacccggcctggacccccaattctatttctcctccttgagtgctgtgat

SEQ ID NO: 18348 - DNA, 601 bp, Human
cagcttctagaaacttctagagctttcccgagggatactattcccctctgttcctccatcttgctgcctggcatgaggacgtcaccttctgagagcagaagcttgaggacaaacttggtgggacagagcaacagcaggaccccagggtcctggcccacggatctgcctgggaccgcctgtgtatcatttatgtgaaggaggcacaaacttcttttctgttgaggttactgttatttgggtgtttctattattcacaaccaaacataattttaatgactacctcagcagtagatagttaggrctttagccaataggcttttctttctgctgagagaaaggcaaatggtagaatctcaaccccatgatgatgcattgctgtgaggttattgtgagagggagtatttttaaccagtcttccccagattttctacctggtatccataaaccccttggattctaaagatggtcttcagagtgtccaagaactacctgaaatttgatgtgacatttgtgaagctgtgcatatatgcatttttcagggtctaagcctgcatcagattaacgaagcggccctaggagacacccaggaatcccaatgata

SEQ ID NO: 18349 - DNA, 601 bp, Human
aagaaaaagcaaagaaggggggcattatagggctaaagactggaactcatcatgaagacctaacagttatgaatagctctactccaagactctaattgcaacttcataagcagacatgccacgagatacaagaagaaatagaaacacaaggccgagcgcagtggctcacgcctgtaatcccagcactttgggaggccgaggcgggtgggtcatgaggtcaggagttcaagaccagcctggccaagatggtgaaaccctgtctctactaaaaatacaaaaattagccggacgtggtggtggrcacctgtaatcccagctactcgggaggctgaggcaggagaattgcttgaacccgggaggcggagtttgcagtgagctgaagttgcgccactgcactccagtctgggtgaccaagagagactccatctcaaaaaaaaaaaaaaaaaaaaaaagaaatagaaacacactcaatcctttagcccctgctacctcctcccacctcacagtgtcccagaaattcacagcacatctgtaaatgagactgctagtagtcaccagaaattattctccctccttctctcgtgatagaattaattgtcca

SEQ ID NO: 18350 - DNA, 601 bp, Human
aaagaaaaagcaaagaaggggggcattatagggctaaagactggaactcatcatgaagacctaacagttatgaatagctctactccaagactctaattgcaacttcataagcagacatgccacgagatacaagaagaaatagaaacacaaggccgagcgcagtggctcacgcctgtaatcccagcactttgggaggccgaggcgggtgggtcatgaggtcaggagttcaagaccagcctggccaagatggtgaaaccctgtctctactaaaaatacaaaaattagccggacgtggtggtgsgcacctgtaatcccagctactcgggaggctgaggcaggagaattgcttgaacccgggaggcggagtttgcagtgagctgaagttgcgccactgcactccagtctgggtgaccaagagagactccatctcaaaaaaaaaaaaaaaaaaaaaaagaaatagaaacacactcaatcctttagcccctgctacctcctcccacctcacagtgtcccagaaattcacagcacatctgtaaatgagactgctagtagtcaccagaaattattctccctccttctctcgtgatagaattaattgtcc

SEQ ID NO: 18351 - DNA, 601 bp, Human
ccctagcagagtacctggcaaatgcaagcatttggaaaatgagtattgaatgaaggaataaatagaccactgctcacatatgagttcaataaccattaaatgaaagcaaagaaggggctgggtggtggctcatgcctataatcccagtgctttgggaggccaaggtgggaggactgcttaagctcaggagtttgagaccagcctgggcaacatggcaagagcccacctctacaaaaaattaaaaaattagccaggtgtggtggtgcacacctctaatcccagctacttgggaggctgagayaggaggattgcttgaacctaggaggttgatgctgcaccactgcactccagcctgggcaacagagtaagatgccatcttaaaagaaaaagcaaagaaggggggcattatagggctaaagactggaactcatcatgaagacctaacagttatgaatagctctactccaagactctaattgcaacttcataagcagacatgccacgagatacaagaagaaatagaaacacaaggccgagcgcagtggctcacgcctgtaatcccagcactttgggaggccgaggcgggtgggtcatgaggtca

SEQ ID NO: 18352 - DNA, 601 bp, Human
taaaaatacaaaaattagccaggagtggtggcatgtgcctacagtcccagcaactcgggaggctgaggcaggagaattgcttaaactggggaggcgaaggtttgcagtgagccgagattgcaccactgcaccccagcctggacgacggagtgagattccatctcaaaaaaaaaaaaaaaaaaccctaaaaaacaaaaaaaccagcccaggcacgatggctcacacctgtaatcccagcactttgggaggccgaggcaggtggatcacctgaggtcaggagtttgagaccagcctggccaasacggtgaaatcccgtctctactaaaaatacaaaaattagccaggcgcggtggcaggcgcctgtaattccagccactaaggaggctgaggcaggagaattgcttgaacctcggaggtggaggttggagcaagccaagatcgtgccactgtactccagcctgggtgacagagcgagactccatcttggaaacaaaacaaaaaaacagagagtaaattatgaagttaaaagtgttcttggccgggcgcagtggctcacatctgtaatcccagtactttgggaggccaaggcgggcggatcacg

SEQ ID NO: 18353 - DNA, 601 bp, Human
cagtttgtttctggggagcagaggacagggaggtatgggggtctgtgctgtgggtggacgtggatgtccaggaacccccagaagcccacctcctggaggtggataagaggtgggcttatgctgcctcttcaaggcctagattccagagcaggaggcgatattgtctggaaccttccagaaaagactgagcatggctggggctagctctgggaaaatgtccttaaacctggtgttaaggtttaactgtgtcccttccaaaatttacacgttgaagccctaacccccagtactcagcatgtgmtcttatttggagataagagttcttgcagatgtaattagttaagatgtggtcctactgggattgggtgggtccctaatccaatataaatgttgtcttataaaatggggaaatttgggctgggtgcattggctcatgtctgtaatcccagcactttgggaggctgagttgggcagatcacttgagatcaggagttcgagaccagcctggccaacatggggaaactctgtctttactaaaaatacaaaaattagccaggagtggtggcatgtgcctacagtcccagcaactcgggaggctgag

SEQ ID NO: 18354 - DNA, 601 bp, Human
gctaagtgaagaagccagacacaaaaggacaccgggattttgtaaagctcccaggtgattttaaggcttagcctcttcctgtcccttccctcccctccccttcctgctgggcttagcccagctccactccaaacaagcttcccaaggccaccagtaggcctgaaggggcagctttcatcagatgaactgcacgggacacaatgcactcggaaggtttcttagggagcctccatcttgtttcagcaggatgggctgaattcacccttcccagtctgcagctccatacccggccagcctcccygctgaccagatgcccttctccctatcaaatccagagaggctttgggaagctgcagaaaaaaggaggagtctggaatcacagaccccggggttgggaacatctccctcccaggtcccttctgggactgtctcccccatatgctttctgcaagacaccccagggtacaccacaggacctcgctgtacctgtgcaagatgtctccaatgtcctaggagaaaaaagaaggaaactgtcggttaccaggctcctagtggctgggctgactcctggcctctacttctgggctcctggacttttagc

SEQ ID NO: 18355 - DNA, 601 bp, Human
ggaaggaaagagaaatggctgggcacggtggctcacgcctgtaatcccagtgctttgggaggccaaggtgggtggatcacttgaggtcaggagtttgagaccagcctggctaatatggtgaaaccctgtctaccaaaaaaattagctgggcatggtggcacgctcctgtagtcccagctactagggaggctgaggtgggagaatcccttgaacctgggaggcagaggttgtagtgagccaagatcgcgccactgcactccagcctggatgacagagcaagacgctgtcttcaaaaaaaaaaagagagagagagagtgaaacagaagaaaataagtgatggcaaagatgtggagaaactggagcccctgtgcgctgctggtgggaatgtgaagcgatgcagcccctgtgagaattaggatggtggttcctcaaaaaaaattaaacacaggataaccacatggtcccgcagttccacttctgggtaggtacccaaaataacaaagcagggtctcaagcagatatttgtacacccttgttcatagcaacattattcacaaaccaaaagttagaagaagtcccgatatccatgaatggataagca

SEQ ID NO: 18356 - DNA, 601 bp, Human
cttaccagcatgtgcctgagcgccaatcagctccggaactacggagaaaaatcagatagggaaaaaaatcctgagcattagcattaagaggggctaaattacactgtcctgacaacaaggaaagacaaggaaccccctgcttagggccctgcatgctatgttgggtataatcccgttcctcccaggaacccaggccatgttggggactgtggtctaatgagtcaactcagtcaatgagtcacgcacagagcctggggggcctgccatgacctttctcctacctttgctccaggtgtttggtttttttttttgtcttctaaatagggcccctcaagtcaacagcacaagggaacactgcaacaaccccaggccagcacacaccattaccgctggactcaccattgaacatttccatttctgaacgcagggtttctaaaatgtgggaaagggagcagagagaagctggagttaggtccctcagccagggacagatggaggagaggttgaaggcaggtcagcaagaccaggggaagaggagggaagtgaggggctctgggctatgtggatcttagggaggaagtgagcatgcacctccaatctt

SEQ ID NO: 18357 - DNA, 601 bp, Human
ctgggaggtggaggttgcagtgagctgagatcgtgccactgcactccagcctgggccacagagcaagatttggtctcaaaaaaaaaaaaaaaaaatcatagttcattaatccaggtacacaaatacttctatcccaatccagtctgcttgcgtttctctaggcttcccatatcctcaagacagaagcagagagaacaaggggacatatatccttgccgtggggttctgagggaaaatgagggccaaatcttctgttcaggagcacctgagagtgccacccaccaggggcggattatgcaaygactccgtacttcctcctctgaaatccatggtgtgtcatcagtacatgtcttcacccggattgactaacatgttcgttcctaacttacctctgctataatcgggtaggctccgtgggcacagtaactattttgttatttttgcatttcccatagcagctagcacctagtcggcattccgtgactattgagtgtgaatgcaagatacaaggccagaagcaggaagagagatgcagtgttgggcattcagtcaggcccctgaccacccactggacagatagtcagaggagctgtgttcttcc

SEQ ID NO: 18358 - DNA, 601 bp, Human
gaggcaggagaatcgcttgaacctgggaggtggaggttgcagtgagctgagatcgtgccactgcactccagcctgggccacagagcaagatttggtctcaaaaaaaaaaaaaaaaaatcatagttcattaatccaggtacacaaatacttctatcccaatccagtctgcttgcgtttctctaggcttcccatatcctcaagacagaagcagagagaacaaggggacatatatccttgccgtggggttctgagggaaaatgagggccaaatcttctgttcaggagcacctgagagtgccacycaccaggggcggattatgcaacgactccgtacttcctcctctgaaatccatggtgtgtcatcagtacatgtcttcacccggattgactaacatgttcgttcctaacttacctctgctataatcgggtaggctccgtgggcacagtaactattttgttatttttgcatttcccatagcagctagcacctagtcggcattccgtgactattgagtgtgaatgcaagatacaaggccagaagcaggaagagagatgcagtgttgggcattcagtcaggcccctgaccacccactggacagata

SEQ ID NO: 18359 - DNA, 601 bp, Human
catgcctgtaatccctgcactttgggaggctgaggtgggtgcatcacctgaggtcaggagtttgagaccggcctggccaacatgatgaaacctcatgtctactaaaaatgcaaaaaattagccgggcatggtggcgggcgcctgtaatcccagctacttcggaggctgaggcaggagaatctcttgaacctgggaggcggaggttgcgagccaagattgcaccactgcactccagcctgggtgacaagagcaaaactttgtctcaaaaaaaaaaaaaaaaaagaatcataggccgggcacrgtggctcatgcctgtaatcccagcactttgggaggctgaggcgggtggatcacctgaggtcaggagttcgagaccagcctggctaacatggtgaaacccccgtctctactaaaaatacaagaaaaccagcctggtgtggtggcacgcacctgtaatcccagctgctcaggaggctgaggcaggagaatcgcttgaacctgggaggtggaggttgcagtgagctgagatcgtgccactgcactccagcctgggccacagagcaagatttggtctcaaaaaaaaaaaaaaaaaatcatagtt

SEQ ID NO: 18360 - DNA, 601 bp, Human
ttgagtgacaaatgcaaatgaccagattttctaatttttttattcatgaggcccagtcaattctcttaagaatcatggcccggcatggtggctcatgcctgtaatccctgcactttgggaggctgaggtgggtgcatcacctgaggtcaggagtttgagaccggcctggccaacatgatgaaacctcatgtctactaaaaatgcaaaaaattagccgggcatggtggcgggcgcctgtaatcccagctacttcggaggctgaggcaggagaatctcttgaacctgggaggcggaggttgctagccaagattgcaccactgcactccagcctgggtgacaagagcaaaactttgtctcaaaaaaaaaaaaaaaaaagaatcataggccgggcacagtggctcatgcctgtaatcccagcactttgggaggctgaggcgggtggatcacctgaggtcaggagttcgagaccagcctggctaacatggtgaaacccccgtctctactaaaaatacaagaaaaccagcctggtgtggtggcacgcacctgtaatcccagctgctcaggaggctgaggcaggagaatcgcttgaacctgggaggtg

SEQ ID NO: 18361 - DNA, 601 bp, Human
tcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttyctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcct

SEQ ID NO: 18362 - DNA, 601 bp, Human
tcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaracaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtg

SEQ ID NO: 18363 - DNA, 601 bp, Human
ggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatrtatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagc

SEQ ID NO: 18364 - DNA, 601 bp, Human
cagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcsttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcaga

SEQ ID NO: 18365 - DNA, 601 bp, Human
tagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccrtaacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctgg

SEQ ID NO: 18366 - DNA, 601 bp, Human
tcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtygtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcac

SEQ ID NO: 18367 - DNA, 601 bp, Human
agggaactggcaggggctgggaaaagcaaggagggaggaagaaaaaagtgggggcctcatcttccctcagagaaagggcaaatctggttttggagcaactgaagagtgaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcg

SEQ ID NO: 18368 - DNA, 601 bp, Human
tctagccctgaggccaagggcagggctggggtgcggctcacgtagtcagccaggaaaggaatgccatgagggaagcgcttgggatctggcatcaggcggccactggcatcgcgaccaccgatccagcagtcatcaatgttgaggtatgtgtagcccatgtcccgccatccatcctgtgccatccggtcagccatctccatgaagagctgttcactagtgaggggcagagggatggggtagctcagggacccagcccggccctcacccacaccctgcctcagctctgattgaatctgggctrtaaaaaccatgaccttgctgagccctaagccaggtatcagtgtaaatgaccaccagagattgtgcgatgagccataagcaagctggcttgaaaggagtggctggccccaggctaaaaggcaggactgggtcaggggaagtacagggggcctggcctgaccttctaagagttatctcaggggctgggtccatgtaaggtccctgcctcgtgaccaggttggggcctgagagtccctgcagaggctccagacaggtcatggggctaggtgtcagacagtccgagtgacttctggctgcagtc

SEQ ID NO: 18369 - DNA, 601 bp, Human
atggccaccctccccgtttgcctacgtgccccagccagctgcgtaactcaccctgggcccgctcctcgggggtggagaagcagccatccagcttgagcatgtctaccttccactcggcgaaggtctgagcatcctggaccaccttgtccagtgtggtgcctgggtaacccatgcaggtgaagttgcccatgtccgcgtagatacccaacttcaggcccagggagtgaacctgtgggggtttgaggacacagtgggctcaagcaggaccctcaaggagcctcctcaaggcatatctgacccygtcccattaaacctccagtggctcccacggaccaaaggagatggtcccagcatgctggcccggcctctgcccatgatggcccacctctcccccaacacacacctcccagcggctgtttcttgcccctaggcctttgctcctgccatcctctctgcctccaatgccatctctctgggctcagctcaagaaatgcctcctccagggaaccttcctagaataccaggctgtgtgagatgccctttctggctctcactcaacagaataggccaaaagtcggtgttcatttgtctgtttccccca

SEQ ID NO: 18370 - DNA, 601 bp, Human
cctttcagatactctagctcacacatcagaagagcatgtgcaggaagagagatgaaataatggtacacattgatggttactggagctggatgctgggtacatggaggttcactctaccattttatttttgtatttgaaagttttcatgataaaaagtttttaaaaagagaaagggtaccttgcgtccaaacaagtctgtatttaactgaaaaaaaaaataattgcattcctaactggccttgaatagaagggaataaatgtcctgggagatagatggcatgtttgttgaaagaatgaaggrtgaagagataggatcaatcaggcacccccaggacaaaaggaaaacttatacagcaagtaaagacatgtagctatcttgggctgaaaggtaagggaattaattggtcaagtccaggctcaactctggcccccaactcccaagtccatggtctcaactcatttcccacaaagccttcctggagctagcaagagaaggtgttcccacctgagactattccattttgcctgaacagcactatgaacaagacccaaaggcagagctatgcacggaggggcaggcctgggatgaggtaggcttctg

SEQ ID NO: 18371 - DNA, 601 bp, Human
cactacgaccactcagctttctttcatttagcccagtatggagcacctactgtgtgcaaggcaccgggctactgagaagcaggtaacatacctgcccttgcactctaaatgcagagaagataaagaacaagtacaaacaatgctctatatagtttatcaggtgatgatgagggcacaaaaagtgggatagatggttagagaaggattccctgagggggtgacatttggcccctgaaagaaatggggaagtgccctgctgggaaaagggaattccaagtccgtctcgaataccgcctcctcygggaagcgcccgggtccctggggtcctcgcaacgccgccctcctacccgggggtcttggcagcgaacatgcgtgtcgaccccagcccccaccgcagccgcacacggtggggccgccagacgcgggcaggtggggccggagccagccaggagggtggagaggagctgcggcccccgcgctgaccctgactcggagcgtgcagctcgccgaccggcgctgggactccgggccaacgggaagaggcgcctacccgcggcattcagcgaccccggctgacgctctcacccgcggtccggccggg

SEQ ID NO: 18372 - DNA, 601 bp, Human
tgctcccgtccagacatcagcttggttccttcaggagagcagcaggtctcaggccagcttggaatcctgaacccaaatgcaacccctggcactccctgtgagcaccgagccagcctaaccagagagacagcacacccacagctgggcaccagcctgctcagtctaccctttaaaagggtcacaggctggattcaaggatctgaccctgagttccgtgacacccatctgagactttgtctgcactgttctctacctgaagggagtctcattgctgaaggactagcacaaaagtcacccaggragtgaagccttcccacactttatctgagctcagagtccatgcccctcctttgcaaatggcaagaccacacggcaagcagatggatgacagagtcccatgtgtccatctgttccagtggcctgtgagtaccttaagggaagacccactgctattcctggaatatagcaggtgcccacaaaatatttgatttgtatgctctaagctccctcaaccttgggggccaacttagaacccactttctgttgccattttccctgtatcttaaaaagagagatgcattcagtccactagatcccccat

SEQ ID NO: 18373 - DNA, 601 bp, Human
caacaagagcaaaactacgtctcaaaaaaaaaaaaagaaagagaaaaagaaaagctctcattccaggatccagtcagttccagacttgctcccgtccagacatcagcttggttccttcaggagagcagcaggtctcaggccagcttggaatcctgaacccaaatgcaacccctggcactccctgtgagcaccgagccagcctaaccagagagacagcacacccacagctgggcaccagcctgctcagtctaccctttaaaagggtcacaggctggattcaaggatctgaccctgagttccktgacacccatctgagactttgtctgcactgttctctacctgaagggagtctcattgctgaaggactagcacaaaagtcacccagggagtgaagccttcccacactttatctgagctcagagtccatgcccctcctttgcaaatggcaagaccacacggcaagcagatggatgacagagtcccatgtgtccatctgttccagtggcctgtgagtaccttaagggaagacccactgctattcctggaatatagcaggtgcccacaaaatatttgatttgtatgctctaagctccctcaacct

SEQ ID NO: 18374 - DNA, 601 bp, Human
tctgtggaaagctcaaagcattgcttaaggagacagcagcagtgccaccaagtgccatgggatagggacccctctccatgaggggatgggaggtgacctcagcgcactctgtctcaacctgaagcctacacccaggctagcaagagaaagtaggatcaaccctgaaacaccccacatcttaaaaagagagatgcattcagagtagattcttgagtttcaaattaaatctgagatgctagtttagggcttcccctactccccaaatcatatggggcacaccccagtcacctggaactctcayggaccccctctgtcccaggctctggtaggattctacagacaaccaaacccaactcccagtgagcccacggcaatggccgtgacttgctggcatcatgcctcgttatgcctgactctatgatctgttctgtgagtgtggctaggagctgagctttgcgggaaacacacttaatcattctgctctaaaggaagccactggggtcaacctcaggctcaaagtacatgggaaagccccataccagactgggatggctcttcccaaggagactgccaggctctggaagctcccacaccctctcaa

SEQ ID NO: 18375 - DNA, 601 bp, Human
actaaaaatacaaaaattagctgggcatagtggcacacacctataatcccagccactcgggaggctgaggcaggaaaatcacttgaatctgggaggcggaggttgcagtgagccaagatcaagccaccgcactccagcctgggtgaaagagcaagactccgtttcaaaaaaaacaaaaaacaaaaaacaaaaaaaaacctgatgccgagaatggtacgtaggtttcactgatgcccgtggggtctaccgcacagacaaggaaagatctctgcactagaatgtggagccactggccaggtgyggtggctcacgcctgtaataccagcacttggggaggctgaagtgggtgggtcacgaggtcaggagtttgagaccagcctggccaacataatgaaaccccatccctattaaaaatacaaaaaaattagccaggcatggtagtgggcacctgtaatcccagctactcgggaggctgaggcaggagaaccacttgaacccgggaggcggaggttgcagtgagccgagatcgcgccattgcactccagtgtgagactccctctcaaaaaaaaaaaaaaaatgaaatgtggagccacttctagac

SEQ ID NO: 18376 - DNA, 601 bp, Human
gaattcgagaccagaatgggcaacatggcaaaaccccatctctaccgaaaacacaaaaattagtcaggaatggtggcttgtgcatgtggtcccagctacccgggaggctaaggcaggaggaacgcttgagcactggaggcggagactacagtgagctgagatcgcaacactacactccagcctgggggacagggcgagaccctgtctcaaatttatgtaacattttgatacctgtatttccatataattgggttttacttttgtaatattatgtacttatttcatacatttaaaaacattrtgccagccaggtgtggtggctcatgcctataatcccaacattttaggaggccgacatgggcagatcacctgaggtcaggagttcgataccacctggccaacatggtgagcccctgtgtctactaaaaatacaaaaattagctgggcatagtggcacacacctataatcccagccactcgggaggctgaggcaggaaaatcacttgaatctgggaggcggaggttgcagtgagccaagatcaagccaccgcactccagcctgggtgaaagagcaagactccgtttcaaaaaaaacaaaaaa

SEQ ID NO: 18377 - DNA, 601 bp, Human
cagccacgtgcagggctcttacctaaggcctagggacccccaaggattcatcctcaaattcaggggctccatctactagatgggaaaaagctatacctttattttctctaacctccaattcgaatttacattttcttcagttattaacataagcaacaaactactcagtgtcagcaatgcatgttaatctgtcaccaacaaaaatcaaaggtattttaataccatgttattgctcttccagtatctcaaaatatcacttttgctccccacaacttcaaagttaaagtagttgggccaggcrcagtggctcatgcctatcatcccagcactgcgggaggcaggaattcgagaccagaatgggcaacatggcaaaaccccatctctaccgaaaacacaaaaattagtcaggaatggtggcttgtgcatgtggtcccagctacccgggaggctaaggcaggaggaacgcttgagcactggaggcggagactacagtgagctgagatcgcaacactacactccagcctgggggacagggcgagaccctgtctcaaatttatgtaacattttgatacctgtatttccatataattgggttttactt

SEQ ID NO: 18378 - DNA, 601 bp, Human
cactccttaatcataacaggtgctggctccccatggcctgacaccatgcccccacctgtaatgctcacagaagggctggccttccccttgttcagaaccttctgagagacaaatttctcagggcacccagactgggatcccaagggctgagcagaaaacttgataagccaccttctccttgaacactcagctgccactgcaaagaaaatctacaaccatgcttatttctccatggggctccgccagaacagaacccaccctgtgcagggctctgagcataagaagggctagcctgagccaygaggcaaggcaatatgctacagtcattaattacaggacaccaagtaataaagttttatagagacatgccctttgatttcccatggcataaaccaagcccccagagagactgtcaggctcagagtcaacacagacgaattcttcctgcaaattcggcaaatgtagcaccaacaaaacatctctaacaggtttctgctgcagcttttgttaactggcacccagaatttaaaaggcaaaagccattatcatccccaggtcccagggtaaataagccatgctttgctgcagacagacaaggcac

SEQ ID NO: 18379 - DNA, 601 bp, Human
agcaaggtctaccctcattgcacatccccatccccagggccacctccccatgtcccgtctggacaactgcaggcaactctcaacggtgctcttggccgcaacttccccgtggcctggtctgcaccttctgccagaagggccctttcaaaatgccaatcccagcacacactccctgcccaaccccgtgccagctggcttctctgagtgcagacttcactccccagccacaagggatccagacccccagttcacccttggcttcctctactgtggcacgggcatcctcgctcttccctaaacycccagaacactccagcctttgccgctgcggcgccctgtggggaatgctcttcccaagggcatcccatgcccttttacccagcctctgcagaaatgcccctttcctacccaccccagcctctgcagaaatgcccctttcctacccaccccagcctctgcagaaatgcccctttcctacccaccccatcccccagctctcttcgtgtctctctagagcccccatcactcttcatttatttgtttgctggccctccaggtaacatgtaagctccctgagggcagggacagagcaggtgtcggt

SEQ ID NO: 18380 - DNA, 601 bp, Human
ttgggattgaaataacataacataaagatccatcaaaagcctcctctctccacagtccaaccaggcagaagatgctgtagagacaggcccccgtggccctgtagaggtgggcagtgcccttcacagaggctcttccagggatctctgcccaggcaccaccaccctgcggtgactgttcactcatgtggtcacctcctgcactggactgtgccctgggctgttgaggtcagccctgggtctcggccacctctgatgccctacatgtccctgggactgggcagggaaagagtgcaagaggaaygtctggggaaaaagaactggacgttcaagacaaatacaagacagtcaagggcagggtgcacatcagaacacagtcagcgtccatggtgtccacaacttggtcctgagggctcagggaaggggcaccagtgtgggccagagtctacagcagatacagtggctgctacaaggctggtgcaaggcctcaaaagatggataggagaaagacagagaaatggaaaacatattccaggacagcagtaccgggggcagggctgggcacatggtactggcccacctgcagtcaaagagggctggccac

SEQ ID NO: 18381 - DNA, 601 bp, Human
ctactgaagcctcgacaatctgctttgtatacgaagacgaagaatgagccggtctctgtgctgtcattctgtgcaaccattaacaacttccctgccctaacactcaaggtggcctgtctcttactttgcttagagaccagttctccttcctcacccccagaaatcacagtagacacggagctgaattttcccccagttataaagacaaaaatgtcagacagtggctggggaggctgtggtccagaggtggctcggactcagcagctgagtccagggcagaggcaggtgccggtcccaccasggtccttgagacagggtcctggaggcaggtgcccatcctgccagggtccttgagacagagtcctggaggcaggtgcccattccaccaggatccttgagacagggtcctggagacaggtgcccatcccgccacagtccttgagacagggtcctggaggcaggtgcccatcccaccagggtcctcgagacagggtcctggaggcaggtgcccatgccgccagagtccttgagacaggatcctggagtcaggtgcccgttccaccaggatccctgagacagggtcctggaggcaggtgcccat

SEQ ID NO: 18382 - DNA, 601 bp, Human
ccctggcgtcacatcccagtaccactcccctccagctgtgggactgtggacgaggcctttctctctgagcctcagcctcatatctatgaacggggtgggggctacggcccagcacagtccctgccccgctgtgtccctcccgcagcgggagggccaaggggctccaagagagctctagtgttactggagcccacgtgggccgccccagcatgaagcgcttgctctgctgtcaacgtgagccttgttcccagtaaaaacagcagcagtaacagtaacatcaacaccaatctgcaatggcagwggcgttgacggggtgcggtggggtgctcccgaaccctaaagagattctagcctttgaactctactgaagcctcgacaatctgctttgtatacgaagacgaagaatgagccggtctctgtgctgtcattctgtgcaaccattaacaacttccctgccctaacactcaaggtggcctgtctcttactttgcttagagaccagttctccttcctcacccccagaaatcacagtagacacggagctgaattttcccccagttataaagacaaaaatgtcagacagtggctggggaggctgtggt

SEQ ID NO: 18383 - DNA, 601 bp, Human
cagccggtgatcccgccagcctttgcacagggccttcacggcagagcctcggggccccactcaaggttctgctgaatgcctccttctcaggggaactgccttctcaataaactcaggatcctctgtggggaggagggaacctcggagccagctgtgccccatcagacacctgcatggcatacatgctatcacgtgaccagccatggcactggaggccttcctgccttttttcagaggagacaagcgttggctgtgatttgtcactgacagctaaggccaccccaagtgagatggggctgascactgcagaaccagcctggggaccccttccctgcataaagggcttcctgtaacctcccatgatgcaacaggccctgggtacctcaagcaacctgggatacctcccagctcagggggttcagtccagcaagtcacactttttggcaggctcccttcagagccacagaaaatcaaaggcacagggagtccatgtcgcctccacaggagtgtcctacagcagccctcctttctgaggggaaagggaggcctggaggggaggcccctggcgtcacatcccagtaccactcccctccagctgtgg

SEQ ID NO: 18384 - DNA, 601 bp, Human
ccacggagtggtggccactggggacctctctcaccctgcgctgttaaatgaccctgccttgcttcatgccagagccagcatcgatttctccggcagcccccggcctctctggcagatggagctggatggtcacgggcagaattcatcagagccctgtgggtgtacatcctcccctggggacaatcagaggcttcccacggacacctcctgcactttcctaaccagggcccagaccaggcccgagggccgcttttcgcagggtgataagctggacaaaaaagctggatatgcctttgccagsgctgggaaagcctgcaaggctccagagagctggctctgccctgcaatcactgaagcttttgaaaataaaccttctttcgtggcattctcctccaacagtattgcacgctggtggcctgcactgcttttacaatttcaaatttgtttctcaaatgtaaacatcaggaaacatcaccaacagtctggatgtgtggctactcctgaacaatcaggttcctggagccatgggctcgtggtcccacagcacagtggcccctgctgaccccatcgcttccgatgcctgtccctgtgctgctgcggt

SEQ ID NO: 18385 - DNA, 601 bp, Human
ttgggagggaggagcaggataacaaatgtgtgggctgatggtttttctccgggcgacgactctcaggacatgctggttaggaataatggaggaggggagagcagccgtctccttgcagcccggtgctcagacaatccaggcctgactctgagagcaggctgtgcatctcctagtcctggcagggcaacatcttttattgatcacaactgcttgagtgggccctggttacttctgcggctgcaaaaacctctcccgacctggcagctccacccgcccttccccatggagacccattagtgckacgctctcatcagcacaccctgactccgtgcctcaaatattaagggaacacgacgcgctgtgcgttgctggctcccgatgtatccccagcacacaagacagcacggctctgtcaactcagggcctcgtttccacggagtggtggccactggggacctctctcaccctgcgctgttaaatgaccctgccttgcttcatgccagagccagcatcgatttctccggcagcccccggcctctctggcagatggagctggatggtcacgggcagaattcatcagagccctgtgggtgtacatcct

SEQ ID NO: 18386 - DNA, 601 bp, Human
ccattgcactccagcctgttgggtgacagagcgagactctgtctcaaaaaaaaaaaaaaaaattaaatgcctttaaaactgttgggtcaaaagccacagactttgtcaaggtttaccatgctcctggcccaatgatcctccagacatgtatcaacaatctcccgggatcctccctcatgttactgagtgactgcttggagaatggctgtgtcctttggcctcagtgttgcaaaaaaacaaaaggctcagctgggtgtggtggctcatgcctgtaatcccagcactttgggaaggctgaggmgggtggatcacttgaggtcaggagttcaagaccagcctggccaacatgatgaaaccccgtctctattaaaaatacaaaaaaattagccgggcttggtgactgtaatcccagctactcgggaggctgaggtaggagaaccgcttgaacctgggaggcagaggtttcagtgagtcgtgactgcgccactgcaccccagcctggggggcaagaatgcaactcagtatcaaaaacaaaaaacaaaaaaaaacacccaaaaggttcagctgtgtccctacacaccctcagcccctcctgaaggaa

SEQ ID NO: 18387 - DNA, 601 bp, Human
ttaaatgccagccagccacagtggatcatgcttgtaatcgcagcacttttggaagctgaggcaggtggatcgcgaggtcaggagttcgagaccagcctggccaaatggtgaaacccccatctctactaaaaattagccgggtgtggtggcacgtgcctgtagtcccagctactcaggaggctgaggcagaagaatcgcttgaacccaggaggcggcagctgcagtgagccgagatcatgccattgcactccagcctgttgggtgacagagcgagactctgtctcaaaaaaaaaaaaaaaaattaaatgcctttaaaactgttgggtcaaaagccacagactttgtcaaggtttaccatgctcctggcccaatgatcctccagacatgtatcaacaatctcccgggatcctccctcatgttactgagtgactgcttggagaatggctgtgtcctttggcctcagtgttgcaaaaaaacaaaaggctcagctgggtgtggtggctcatgcctgtaatcccagcactttgggaaggctgaggcgggtggatcacttgaggtcaggagttcaagaccagcctggccaacatgatgaaaccccgtc

SEQ ID NO: 18388 - DNA, 601 bp, Human
catgcaatttttagcagtcactaccgctggggacagtaaacgtccagtaggtcgctgaagacggcctgtgccagtcatcttacacacagcatctcatttaaccacacggggagacagtgcggcaaacatgcaggtttcgcaaatgagaatggcttacagattagagaacttgcctgagtctggttaaaaaataacagcgcagcccagatttgaacctatggctgtagaatactctcttaatggacactactcattcctctacggacacttaaattacatctaatacactttgggaggacarggcaggcagatcacgaggtcaggagatcgagaccatcctggctaaaacagtgaaaccccatctctattaaaaatacaaaaaaaattagctggatgtggtggcgggtgcctgtagtcccagctactcaggaggctgaggcaggagaatggcatgaacccaggaggcggagcttgcagtgagccaagactgcgccactgcactccagcctgggcaacagagcaagactccgtctcaaaaaaaaaattacatctaataattagcaattataaataacgctgtgatgaacatcctcgcatacaa

SEQ ID NO: 18389 - DNA, 601 bp, Human
atctgtaatgacatttggatcatatgaaattacatgcttcacttatttcctgtcattatatgttcttcaaacatgcaatttttagcagtcactaccgctggggacagtaaacgtccagtaggtcgctgaagacggcctgtgccagtcatcttacacacagcatctcatttaaccacacggggagacagtgcggcaaacatgcaggtttcgcaaatgagaatggcttacagattagagaacttgcctgagtctggttaaaaaataacagcgcagcccagatttgaacctatggctgtagaayactctcttaatggacactactcattcctctacggacacttaaattacatctaatacactttgggaggacagggcaggcagatcacgaggtcaggagatcgagaccatcctggctaaaacagtgaaaccccatctctattaaaaatacaaaaaaaattagctggatgtggtggcgggtgcctgtagtcccagctactcaggaggctgaggcaggagaatggcatgaacccaggaggcggagcttgcagtgagccaagactgcgccactgcactccagcctgggcaacagagcaagactccg

SEQ ID NO: 18390 - DNA, 601 bp, Human
ccatctgcaaagtccctgctcaaagacccgtcccccgggaaccctttaggctccaggcctaccagcctctggttcctagggcagaagactccctccctgctccccattcaacccctagacccaagggagttggccttccccaatcccaccctctggcccccaccccacagcccactctctgtccctccaccatgacccacttggacctcctgccactgcaagccagttacttcccggcccaagcccttgcatctgcatgccgggccagctcctctctccacgcctctgctccagctcttayctctccctgagtgccttcttcccatcttagtgcctcatcaatgtgcactcaggatgaaagccccagccccctgggcaggttcgttcactccctcctctactgccccactgacagtcaccattcccccagcaaagtgccatgtgccaaccagcctgctgggagcaatttcttcctctgccagcccctcctcctcagtctggcctgcatcttggctactgcagaccctcttgtttctgagcaccccctgggcagagaacagtctcatctccacagccctcgcctctccccacacccctatcc

SEQ ID NO: 18391 - DNA, 601 bp, Human
tcgctacttatcactgatgaccattcctcttggtttatttttttctttttttgagacagggtcctgtctgtggcccagactggagcacagtggcgcgatcatacctcactgcagcctcaaactcctgggctcaagcacgcctcccacctcagcctcccaagtagctgggaccacaagcacatgccaccaggcctggctaactttttaatttgttgtaaagacagggtcttgccatgttgcccaggctggcctggaactcctggctccaagcgatcctcccaccttgcctctcaaggcactyggataacaggcgtgagcccctggacccaacccctctccgttttttaatcctcccctatgggcccgacctctgcaggagaggtggcccccataaaaaccctccccagagccaagcactgccccacccctggacaccagccacttaccaaagtgaggaggacagagggcttctgtgacgtcaggacgctggcaatctagaaggtcggaaagaaaaacccactttagaggcaccactaagcctaatgaagatgacatgccaccattccttcataatgacagtgcacatttatcaagcagatca

SEQ ID NO: 18392 - DNA, 601 bp, Human
gccaggcccacatcctcacgacaggacacagcaggtcccagggagactcaaggatggggtcccataaacagctattcagactgagcaggtatcgctacttatcactgatgaccattcctcttggtttatttttttctttttttgagacagggtcctgtctgtggcccagactggagcacagtggcgcgatcatacctcactgcagcctcaaactcctgggctcaagcacgcctcccacctcagcctcccaagtagctgggaccacaagcacatgccaccaggcctggctaactttttaatytgttgtaaagacagggtcttgccatgttgcccaggctggcctggaactcctggctccaagcgatcctcccaccttgcctctcaaggcacttggataacaggcgtgagcccctggacccaacccctctccgttttttaatcctcccctatgggcccgacctctgcaggagaggtggcccccataaaaaccctccccagagccaagcactgccccacccctggacaccagccacttaccaaagtgaggaggacagagggcttctgtgacgtcaggacgctggcaatctagaaggtcggaaag

SEQ ID NO: 18393 - DNA, 601 bp, Human
tggcaccatctcggctcacctcagcctccacctcccaagttcaagtgattctcctgcttcagcctctcgagtagctgggattacaggtgcgcaccaccatgcccagctaattttatatttttagtagagacatggttttgccacgttggccaggcttgtctcgaactcttgacctcaagtgatccgcgtacctcggccttccaaagtgctgggattacaggcatgagccactatgcccagcctgggcaaggcattttaaatcaccatttctttacccagaacttcagcttgatgtctaatygtatatctaaattgaacacattggatcatctatgaccataatcatctcacataagtttcccttatagccatcaagacagtaaagcaaaaaaaaggggccaagtgctaaaggaaataactattttggtaaaaatcaattaagaaaagagaaaggctgggcacggtggctcacgcctgtaatcccagcactttgggaggccgaggtgggcagatcacctgaggttgggagtttgagactgatcaacatggcgaaaccccgtctctaacaaaaaacacaatattagctgggtgtggtggtgca

SEQ ID NO: 18394 - DNA, 601 bp, Human
actgtgtgccaccttctggacaggtgacacctgggcccagcaggcagacagcaccgcctctatgtccagttctgtggaatgctcacagatgcacccctgtcttggccagggtcccgattcccccctcctcatggcctccgtataccacagggagccatggggcccatccctgccatcccaatacacgcctgctgcctcctagagtcccaccctgccctgggggtcaggctcagcggcagctgatgggcaggccactccgcctgccatgtccacactgacctctgggtagcctcccacgtcrtgcacgtcaatgcccaggaagtggccaagcccgtgaggcataaacacggcccccaggtgagcctggaccatggcgtccacgctgccgctcaggatgcccatgtgggccagctcctccaggtggatgcggtcagccaggcggtgcatgtcaggccaccagacacctgtgggccagagggagctgccgtgagccacagagcccagcagccaacaccgcagggccaggggctgggagatgtgaagccctcacactggctgtggtgggagggcctgaggtggggggtgagggggcaagggtact

SEQ ID NO: 18395 - DNA, 601 bp, Human
gtttccttccttccagtcacccctccatccccatgggcccaccccggctgctccatggtacacggttgaggggcaggtttgtttccccagagaaacgaactttcctcccctctgaaatcttgaggtccaccactgaagtggggtgggggagattagaagggatccccagcgggcacagggcaaggcctgcctcagcccagtggcgcagctgccccttcagggtgttggctctaggggcctgcccgggggacctgctgagaacagggcgcaggcgccataagagaatgggaagggctgggcygggtggagcgcagagccatgtggggagggcacgagcccctgtggcccaggaagcgcagccttcaggggtggggaggggtcctgccctcaccgcgcccatgctcgcctctgcctgggcacagggcttgacaaggcctcaacttttattgggctccaagcagaggagccccagatgtgtctgcaggcctgaaataaaacaaatgacttttataggaaaagccatattttttccacaatgtttatctgtcagaagaatagactctgagcacaaagaggtgcttactggaaaagatgaaaacag

SEQ ID NO: 18396 - DNA, 601 bp, Human
ggcctccacgctgggcacggccagagaggctgtgactgattccacggagggcagggacagccacgctgacctggagagagcaggccaggcgggaggcgatgaggagacaccacagcctggctggtgtggccccggccccacaacacttgcctctgggccgctgaccgggagctgaggccggagggcagggatgccccgtggctgaggaaccgtatggagtgacagtccctctgcgcaggtgagaggtgcatgtggaccgagctggggcctgtctcctgcccagaagctgctgggggtcccrgggtctctgctccaggaccttcccgtccctgtcatccgaagcctgtgctgggctcccccaccccaccgccgcccatccctctccttcatgctattcctgaagtgtccgtccctgtctccacccacagcaatcgaagccaggggcctgggggaagcaagggcctgccaacgtcaggtttccttccttccagtcacccctccatccccatgggcccaccccggctgctccatggtacacggttgaggggcaggtttgtttccccagagaaacgaactttcctcccctctgaaatcttgaggt

SEQ ID NO: 18397 - DNA, 601 bp, Human
gccgttagagggcctgtgctgccagcaccatcttcctggaactgacttgatactgacaccaggtgagccatcttttcagggtgcacggggtcccaaatgctcatctgcaaaggaataaaggggaagccacgcacaaaggaccattttaggaaaccttttattgcaaatgccattctgcatattgatttttgacagaaagtatcagaaatgcttctttcctgggaaaaggaatataaatgacagcaagacacattttagttgctactaaagaacagcattattttcaatcattttaagtcgstcatttaataagcaaggtataaaacagattaaaggtgggagcctgcaaaagggtaattaaaaaagtgtttcctccccgggaaacagcactgtttggtctgatcaaatgccgaagctgggatctgattctgggtgccgtctctcgctactggagtgctgaccagcaggctgcccatcacgaaaagaggttgcaaggccaggcccccaggtgcgctgggatttctggctggctctacttggggccagagaagggggtaaaggccttgtcacagcctgccatgcatgcttcaatctcttccac

SEQ ID NO: 18398 - DNA, 601 bp, Human
ggagaaaagaacaaggaggcaaagagagaaactttatttaggtatcattacaaagtgactaatataaatgcaattcttacatttttcatcagaatcactgggggactgaatggttggtagactggtactatctccttaaggatctattctaagtgattctaacttacaatattttaggagcataggagctaagctttgtttttagtaacatgattagggtttggttttgtgttttgaaagataaatcagagaatttgattatatagacctccctttttttagtggaagatagtgatccagaaaaaaaaaaaaaaacccaattcacttaataaaaaacttagcagtattgaggaatgtatatatttgaacttgtaggagaacacaaatatgaactagaaggagcacagcatcatgattaagagcacagtcttaggctgggtgcagtggctcacagagcacagtctttagaattgtattggtttggtttgaatcccagctctgccaccttctatgtacctacgtgactttggcaaggtacttaactgcttgggtttagtttcctcaactgtgagctaatacatttacttcattgggttgtgtt

SEQ ID NO: 18399 - DNA, 601 bp, Human
gataacctgtgatgggacaagcttggtgactcctcacataatgaaacacacagcggtaacaaaacacatagccagaggtggcaagaacagtatcattcacccgggttttacgacacagtgggcacacagtcttcattttgggtaagaggggagaatcagagttatagtctaggtgtacaggtggtggtggagtaggcagggcagtcaatgacttgatggtttcttgattttcagatgagtaccaccagtcaaggaactgcaagaagaatacacccacagaaaggccagtagacagggatawggcaacacccccaacagctttcttcagagctgagtttatcttctcactaacactgttgggagaaaagaacaaggaggcaaagagagaaactttatttaggtatcattacaaagtgactaatataaatgcaattcttacatttttcatcagaatcactgggggactgaatggttggtagactggtactatctccttaaggatctattctaagtgattctaacttacaatattttaggagcataggagctaagctttgtttttagtaacatgattagggtttggttttgtgttttgaaagat

SEQ ID NO: 18400 - DNA, 601 bp, Human
ttatcgtttgcaaactgatgaaatttccaccttacagacaggcaggtaaatgctttcttttctaaaaagaagtcttgctaccacctcactgttcactttattttttatgcggtctaacctgggtttttcgtaagagctcctttatttcttatattttaaggaaagggataggcaaaaacttgtgtactcattattctgtttaatctctacactggccctcatatcccctgccagtcctgatccttctactttaagcagcttggtcaactgtaagtagggttctagagagcaggctaaaagkttaggatcaaatgggcatatccttttaaagaaatccatataatcatttaaagttcatatagttatgaattgaggctgagaagtgtcaactcaataccatgctgaaaccagctctgtgacattacagcgcaatacttttgttgtgaggataagacatgattccctttcagttctcaggggagtagagtttaatcagatgttgtacttctgttggataacctgtgatgggacaagcttggtgactcctcacataatgaaacacacagcggtaacaaaacacatagccagaggtggcaagaac

SEQ ID NO: 18401 - DNA, 601 bp, Human
gcaagcagaaagaacttattaaaatatcctttctttacacaattagattagtattttgcttcatgtcttcattgcttgttagctttgcttttacacaggaatcttcagactactctctgtaacactcaacccctattccttttttaaccagtttctcaagaaggatatggagagctcataaaggaatatcctcaaatatcctaaatatccaacttttaaaataccttttttatccttaaaagctgataaacaatagatgtcacttaacaaatgtctcacagtatatggaaggagctttttycccccccagagtgtttctaagcatttctatcaagagcaagtctgcatttcttatcgtttgcaaactgatgaaatttccaccttacagacaggcaggtaaatgctttcttttctaaaaagaagtcttgctaccacctcactgttcactttattttttatgcggtctaacctgggtttttcgtaagagctcctttatttcttatattttaaggaaagggataggcaaaaacttgtgtactcattattctgtttaatctctacactggccctcatatcccctgccagtcctgatccttctact

SEQ ID NO: 18402 - DNA, 601 bp, Human
tgctcctacataggcaacttaagtgtttcttaagttgatgcaaggtattttgcatgaggctgaattcttgttgtcggagcagaggatttttgttccaactactgaattggcaaaatgttaaatataaaaacacctcaaaaagtcaaaggtagtctgaatgaaaaatttattttaaacacctcaagtaatctttacatttctacaaaatcataacatagttcttttccagaaacatttattcttaaaatctacttaagtgtttcatagaaactttagtaataaccagaataattcatgacastttagcaaactcttagcagcaagcagaaagaacttattaaaatatcctttctttacacaattagattagtattttgcttcatgtcttcattgcttgttagctttgcttttacacaggaatcttcagactactctctgtaacactcaacccctattccttttttaaccagtttctcaagaaggatatggagagctcataaaggaatatcctcaaatatcctaaatatccaacttttaaaataccttttttatccttaaaagctgataaacaatagatgtcacttaacaaatgtctcacagt

SEQ ID NO: 18403 - DNA, 601 bp, Human
gaaaggaaataaaaaataaatttagtgtacagtaatgttctaggcctttccattcactcactactcattcactcactgactcacccagagtaatttccagttttgtaagctccattcatggtaaggaccctactaccattttttatcttccatactatatttttactataccttttctatgtttagatacagaaagccttacaattgtgttacagtagcctacagtattcagtacagtaacatgctggacaggcatgtagcctaggagcaataggctgtttcatctagcctgggtgtgtastaggctgtaccacctaggtttgtgtaagtacactctgtgatgttcacgcaaagatgaaattgcctaatgccacatttctgagagcatatccccatcattaagtgatgcatgactgtatttatgtccctgaagtggtctgttgaccgtgacaaataggtaaaatgtatgctttgtttttttcccagttttaaattaattaaagttaaaagaacattgtattggcagagttctttaaataaaaataagtaaaataagttaaaatatagtatatatacaatgatattactcaatctaaacatt

SEQ ID NO: 18404 - DNA, 601 bp, Human
ctttctttttcctaacatgataacatacatgactgttcacagatgtttgggatatagaaagttttctactctgtgaacagcagaggatgaggtaaatttttaatgatggtctcagtaaatttatctgggttataagatgacttaggttggtttcctggcttttatatttaggcaggttctgctaaatgactgtggaaaacatcttattaagtgacatctcccaatttcatccttttgtttttttacgttaaggataaaaaagtaccttattgattattttaataaggtaattatgttattsctactatttaaaaaattctaaatttttttttctttttttttgagatggagtcttgccctgtcacccagacacgatctcagctcactgcaacctctgccttctgggttcaagctgttctcctgcctcagcctactgagtagctgggactacaggtgtgcaccaccatgcccggctaatttttttgtatttttagtggagacagggtttcacagtgttggccaggctggtcttgaactcctgacctcaagtgatctgcctgccttagccttccacagtgctgggattacaggctgagtcact

SEQ ID NO: 18405 - DNA, 601 bp, Human
gttggtttcctggcttttatatttaggcaggttctgctaaatgactgtggaaaacatcttattaagtgacatctcccaatttcatccttttgtttttttacgttaaggataaaaaagtaccttattgattattttaataaggtaattatgttattcctactatttaaaaaattctaaatttttttttctttttttttgagatggagtcttgccctgtcacccagacacgatctcagctcactgcaacctctgccttctgggttcaagctgttctcctgcctcagcctactgagtagctggractacaggtgtgcaccaccatgcccggctaatttttttgtatttttagtggagacagggtttcacagtgttggccaggctggtcttgaactcctgacctcaagtgatctgcctgccttagccttccacagtgctgggattacaggctgagtcactgtgcctggccaaaaattctaaatttttagttaagttaatattttaagtttctctggctgcaatgcaacataggagacacagtgctctgttttattttttaataaatttgtttaattggacaagttttagcagttgaaaaatatgc

SEQ ID NO: 18406 - DNA, 601 bp, Human
actactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacktatatagatagtgatatatttcatttttaatttgtcatttttgatgtaaaatataatcactgctgtgataaataaactatctattgatcatttatcattttataacttcccccaaaagactgctctttctaatacattgtatatgtgaatatagtactatatataatatagatatatctgtggttcagtaacaggacactagaatatatttaatttattcttttatttagtagctgtttattgagcatctactcagtgcttgacacatagactcaatgagattctgtcaaggactggtgc

SEQ ID NO: 18407 - DNA, 601 bp, Human
aatttgtccaaaatgtttatccacaggaacaatccctttgtgaaggctgctggtatgtgaatgtgtgccggttcccttggggcgttcatttggatctttctgtgttccagtgacctacggcatgatgagctccaatgtgtactactacacccggatgatgtcacagctcttcctagacacccccgtgtccaaaacggagaaaactaactttaaaactctgtcttccatggaagacttctggaaggtatttgcaaataactttgaaagtacctctctatcacagaaaattgttcatttggcytcatcatttcaatgcatgagtatcgacaggacctgctttgcatttaacactgtgtgagacgtaagttatggtgagttgttagaagttactgttcctactctcaaagggggtaaactaacattgagaactttgcctgtgccttgcactgtgctgagtgtttcatatcttaccttatttaatttctatagtctaactctataaggtaagtactaagactatgccctagtttgttaatgaggaaaatgagattcaggatgtttaaatgcgtatggtcacatggctagggaacaagaaaaattg

SEQ ID NO: 18408 - DNA, 601 bp, Human
cacaacatagtatgactttgtctctccaaaaaagttaaagaattagcagggtgtggtggtacacacctgcagtcccagctactcaggaggctgaggtgggagaatcacttgagcgattgcttgaggtcaaggctgcagtgagccatggccatgctactgcattccagctggggcaacagagtgagaccctttctcaaaaaaaatcccccccaaaaaaaaacccaaaaacaaacaaaaaaggtctgctgttgtgaagttcaacccaatccagccccttcccaagttgtcacaaattccaacrtagttaacagtataccaatgagtgataccacaggaaaaatattaaactgatctgagggatatggggcttggaatctaagaaaattggaagggaaattgaaaaggaaattattatttctccttggggagatagtttctaaaattcttactacaccctggggtcagagctgttgattttaaggatagagacaactgagtcacaggaaactattcatatataaaagtacctggcatccaaaaccacacttgtataatatgaatctttcaccatctgagtagggcaaatcagtctatctctgtt

SEQ ID NO: 18409 - DNA, 601 bp, Human
agggctccctttgggccccgaaatggaaccgcgtaagtgtctgtgactcattgccactcggtgatattcattcatttattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcstttgaaaatttcatttaagatgccctgggccctgtttttacaggtccagtaacatcatccactaagttatttaacacaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaaggg

SEQ ID NO: 18410 - DNA, 601 bp, Human
ctcattgccactcggtgatattcattcatttattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcgtttgaaaatttcatttaagatgccctgggccctgtttttacaggtscagtaacatcatccactaagttatttaacacaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaagggaggtcacttactattttagaagtattgtagttattataaagaaaca

SEQ ID NO: 18411 - DNA, 601 bp, Human
tattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcgtttgaaaatttcatttaagatgccctgggccctgtttttacaggtccagtaacatcatccactaagttatttaacrcaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaagggaggtcacttactattttagaagtattgtagttattataaagaaacaagaagacctccaaggccgtttcagggtggg

SEQ ID NO: 18412 - DNA, 601 bp, Human
gtcgacgctctcagctccccatcagtactcaagcttcctgagggcagggattctattttgttaactgctgtattctcaaagccttgaacaatgcctcatatgtaaagatactaataaatatgtgctggatgcattcgagtgatttctactccagggtggattgccaaaggggaccttccctgtcatatctaaactatccttttattcttctacattctcaagtcactcccatttcttcttcccttcaactccaaacttcttggaagaatagtcttcatttgccacttccatttccttaccmtcaattcacgtcttaaagcttaggttcttgcttttgacatctcaccaggaagctactagggacctctagttagcaaatccactgaacaaatctcagtttttatccccttcatactgtctgcagaaagtggcagtgttgaccgctcattcttttgacttccatgaagaactctacactttgggttcttttaactctgaaacccctttctctcacttctcttattcccaggttctatattcatatctccgtcttttctttcttttctctctttcccatgacattcagatggcttccactgac

SEQ ID NO: 18413 - DNA, 601 bp, Human
gataaagacatacctgagactgggcaatttaccaaagaaagaggtttaatggacttacagttccacatggctggggaggcctcacaatcatggtggaaggcgaggagcaagtcacgtcttacgtggatggcagcaggcaaagagagagagcttgtgcagggaaaatcccacttataaaaccatcagatctcgtgagacttactcactatcatgagaccagcatgggaaagacctgcccccatgattcaattacctcctaccgggtttctccaacaaaacatgggaattgtgggagttacarttcaagatgagtttggttggggacacagccaacccatatgaccattcacctgtgcaagtccagatcctactcacctttcatggttcaggtccaacacagcttcttcctaaagccttttctaatccatccctccactgccagatccccaaataaggacagctttcctctgatctgccagccttatttcttttctcttttgcttcttattattatccaccttgtattttacttgtttaattataactcttatttccctacttgttataaatttgggagggaaaggacctttatatccccatt

SEQ ID NO: 18414 - DNA, 601 bp, Human
gaaagacccaacgctttttgttttatctagccaaaatttgcttatgcttacccaaaacctgaaaagaaattatattcttaatataaatacaatcacatcttgaaatcactttgaaattttctttattttccttttttctttccccaacatatgttctgaagtacacaggctgcatcagtcagccatttgtcctgagcaatagtctttcaaaactagaagaattacttgaaaaaaagaagactattaaggaatttaaactcaaataatttattgaccacttgctaggttgtacagggtaaatttttttttttttttttttttttgagatggagtcttgctctgtcacccagactggagtacagtggcaccatctcggctcactgcaagctctgcctcccgggttcacgccattctccctcctcagcctcctgagtagctgggactacaggtgcctgccaccatgcccagctaattttttgtatttttagtagagacagggtttcaccgagttagccaggatggtctcgatctcctgacctcgtgatccgcccacctcagcctcccaaagtgctgggattacaggcgtgaaccaccgcgcctg

SEQ ID NO: 18415 - DNA, 601 bp, Human
ctgaaaagaaattatattcttaatataaatacaatcacatcttgaaatcactttgaaattttctttattttccttttttctttccccaacatatgttctgaagtacacaggctgcatcagtcagccatttgtcctgagcaatagtctttcaaaactagaagaattacttgaaaaaaagaagactattaaggaatttaaactcaaataatttattgaccacttgctaggttgtacagggtaaatttttttttttttttttttttttgagatggagtcttgctctgtcacccagactggagtrcagtggcaccatctcggctcactgcaagctctgcctcccgggttcacgccattctccctcctcagcctcctgagtagctgggactacaggtgcctgccaccatgcccagctaattttttgtatttttagtagagacagggtttcaccgagttagccaggatggtctcgatctcctgacctcgtgatccgcccacctcagcctcccaaagtgctgggattacaggcgtgaaccaccgcgcctggcccgactaattcatttattcagcgagtgttttctgagcacctactatgtacttgcca

SEQ ID NO: 18416 - DNA, 601 bp, Human
caaattatacctattgagagttgggtaaagagttaccattggatccagtccaccaacccaaatgtttttctacatgtattagctgagatgagctcctcatctcaggagaagcctattcccactgcaggccttcttgagtctgctgtgttcatcattcccaccaccaacacaaaaatacaagattggctctggaaatccttcacagagaaggaaggaaaggaagatggtgaggttggctttttagctgtgatcagcaaccaagctggtctttgctatgagaatcagtgggaccatgatctckatggtcatctcaggaagggagggctaatgaagtggtctctggccatgattcctaagaagagagaatggacagcaaagatcgcagcacctgccacagcccacctgctgcagattcagaccccctggtggggccaggttgttatgactaacccctagcactgtctacatttagtggtgatggatgccaaggagggggcagtgtccccttggatctgattgtaaagcttagaaccaaagcatatgtggaaagttgtagggtcatgagttaagggacagaaatgagcaagagagaagcccttgg

SEQ ID NO: 18417 - DNA, 601 bp, Human
catagtaataataatcaaacagcaaaaataataatagtaataagaatgttctgtggtgatggaaatgttctatattttcattgtcctagacagtagccactaaccatgtataggcatggaacacttaacatgtggctagtaggaccaagggactgaatttttaattgtatttaatcttacttaatttaaatttgaatttagatatccacacatgtttggatagcacagtcagagcctgtgctggtgaaaggatggcaggtgctgcctgagaattactgaagtttccttgattattattagyttaataataataatcaagatagtaataataatcaagatagtaataataatcaagatctcagctgggcacagtggctcacgcactttgggaggctgaggcgggcagatcacctgacgtcgggtttgagaccagcctggccaacatggtgaaaccctgtccctactaaaaatacaaaaaaaaaaaattagctgggtgtggtggcacgtgcctatgatcccagctacttgggaatctgaggcaggagaattgcttgaacccaggaagcagaggttgcggtgagctgaatcatgccactgcact

SEQ ID NO: 18418 - DNA, 601 bp, Human
gtgttctttatgttcttcattcttttggtatgtacatttttatttatagtgaggttcaatttaaacttcgtaaatccttgtcttctcttttctctcacactttatgtcctatcaattttaaataaagacccaggaagtagaaaaaagtgtggatgttggaaaacttattttccttttattaattcacagttttgagactcatatcaaatgtcttttctgtggtctttcattgatccatgtatatgtgtctattcaatgcaaaaaaaattagatctcttccatggtctttcatttctctctmtatatatgtatctattccatgcaaaaaagaaattagatcaagtacaaatttataaagatacctaaaatagtgctttgcctaaaaagtagaatatgcttacatgctttttaaactcatatgtcagcactttcgtagtcacttgctagcatgacttttctctctttcttcttttctttttaaaaaataagaacggaaaagcaagctagatctaagatgtcgagtaatagttgagtgaatcattgcatgtcaaaattaggatattctgttttaaattatttatatcccattcatctagagact

SEQ ID NO: 18419 - DNA, 601 bp, Human
tgcttgactccaaagtctatctctcttccagaaactttttctttactatctgcctagtaggcctgctgtattcctatttgcaacagccttttaaactctttaaaaatgtgtcctgtaaatttcatatatgattatacaaaaaaacttggaataagcatacaattctacttatctgtgttaactgttgaaatttgaagagctttttggaattctatacccttcagtagtgtatgtaaaagtttctaaatatagagaacatagataagcaaaaataatattaaataaaataatcgcaccattmgtaggtaaatatactaatattttgttgtattttattcttgtatgttttcacaaagtatatcataaaatttttcctgtggcatgacttaacggagaaaataatcttcccaaaacatgtggcagcaaaactgttaatttattacatcaggctgggcacagtggctcacgcttgcaatcccagcactttgggaagccgaggcgggcagatcacttgaggccaggagttcgagaccagcctggccaacgtggtgaaacactgtctctactaaaaatacaacagttagccaggtgtagtggcaca

SEQ ID NO: 18420 - DNA, 601 bp, Human
tacagtgtaatattatacaatgaaaacaaggcaagtgctgtttaaactactctggatacattttttacaaagaaataaaacactttagtttttaatgtttctaatgttttacattttagtgtattaaatcaatattagttttcttcttttttaagctccctatacatttataactgacactaagggagtgtttaatgttttgattaaaagttgtaaagatcacagaacaattgtaattcttcccactgattattcagatcattttgcacaatttcagcttgcatggtcacttacagtgccrcactatgtgcaaagcaaggtcaggtctaaagttcgctaatgaaaaatcctcggccaggggcagtggctcacccctgtaatcctagcactttggaaggcgaggcaggcagatcgcttgagctcaggagttcaacaccagcctgggcaacatggtgagaccctgtctctacaaaaaaaaaaaaatagcaaggcgtggtgactcacacctgtagtcccagctacttgttgggggctgagttgggaaaatcacttgagctcaggaggtcgaggctgcagtgagccagaatcacgccactgccct

SEQ ID NO: 18421 - DNA, 601 bp, Human
aagaactgaccgaacatgaacatcagcagatgagagacgacttggagaaagagagggtgggtctggtttaggagaaccggatttgatttggtacctacaacaccacagatgtatcaaacactatagaagtagtgggttattgagtctcttgcccattccccaccacactctctctctctctcagtcggtttatgtgttagtaccctgtttattccagaaagaatatataacacaattatgtataaaaatgggtggttagcatgatataaaaacgtcaaaatgaaaagcaagcaaaacaaawgtaaaaataatggattattaatgaagcttaaaaatgcattcataaaaacacatatgcttattaagattgggctacaaattgggccctaagcttgctggtaatcagcttgaaaagagaagcctgattagctgcagagtccacaatgtccgtgagagtgaagaaaacaaaaaatgacttaccaagagatgtgaaattattctggttagttagtggctatttaaattgttaacttttttttcttttttttttttttttgagatggagtcttgctctgcctcccaggctggagtgcagtggcac

SEQ ID NO: 18422 - DNA, 601 bp, Human
tttaaaaataacttatactggccagacgcagtggctcatgcctgtaatcccaccactttgggaggccaaagcaggcaggtcatgaggtcagaagttcgagacgagcctggccaacatagtgaaaccccatctctattaaaaatacaaaaaattagctgggcatggtggtgggcacctgtaatcctagctacttgggaggctgaggcaagagaattgcttgaacccgggaggcggaggttacagagagccgagatggctccactgcacaccagcctgggcgacagtgcaagactctgtctcaaaaaaaaaaaaacttgtcaattggtgttttgtttcttacataatatgtttactataaaaattagcaaataagagcaaaagaaaacattaacatttcacatatttctaccaatgaaaaatgtttattaatatatcagtgtttgtgtctctatttgcatgtgtttatcaatgtttctatatatttttatggcctaacatatggttcgtcctgaagaatgttccttgtgcatttgagaagaatgaatattctgctgttcaagtgttctgtagatgtttgttaggtctagtttgtttacagttt

SEQ ID NO: 18423 - DNA, 601 bp, Human
atgcatttaagaatgggaacaggctgggcacagtggctcacgcctgtaatcctagcactttgggaggtcaaggcaggaggattgcttgagccaggagttcaggaccagcctgtgcaacatggtgagaccctcatctctacaagaaatagaaaaattaactggtgggttgtgtatacctgtaatcccagctactcgggagcctgaagtgggaggattgcttgaacctggaggcagaggttgcagtgagtcaagattacaccattgcacgccagcctgggcaacagagtgagactctgtctcaaaaaaaaaaaaaaaaaaagagtaggaacattgaggctgggcatggtggctcatgcctgtaatcctagcactatgggaggccaaggcaggagtatcacttgacgctaggagttcaagaccaacctgggtaacatagcgagactttgtctctattaaaaaaaaaaaaaaaaaaggtgtaaaaaacttttgtaacaagagtgggaaagccgggcacagtggctcacacctgtaatcccagcactttggaaggccaaggcaggcaggcggatcacctgaggtcaggagtttgagaccagcctgg

SEQ ID NO: 18424 - DNA, 601 bp, Human
atggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagyggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtg

SEQ ID NO: 18425 - DNA, 601 bp, Human
taagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttgrtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaa

SEQ ID NO: 18426 - DNA, 601 bp, Human
tagtagagacggggtttctccatgttggtcaggctagtctcgaactcctgacctcaagtgatctgcccacctgggcctcccaacatgctgcgattacaggcatgagccaccatgcccggcctcactttctaacggaataaataatttacttattttaaataatttattgtgcttactatttattgtcatactcagctagactgtcagctccccaagggtagggatttttgtctgtttttttcactgatctactcccagggcccaaaatcttgtctactatatgctcaacaaatttttgttraatgaatgactgtgtcaaacatggagaagtctcaaaggagacaaaagatgaagaagcacctcaagaaataccaataggccctgtgtggctgcagggggatgggagtgcttaccgatggtggcaatgatgctggtactgcgagcagccacgggctcggagtcaatgtccagtaggcagaggtgttccaggaaggtgtctgccatagcagctggcagctgctgctgctggaagaaggcagtgcccagctcctgggtcagttgggccacactggcccgccgcagataccccgctggccctgtg

SEQ ID NO: 18427 - DNA, 601 bp, Human
agaacagcaagaaagtggtgaacgaggaaaggagaatctttgttccagttccaggtgtcactaacaagctgtgtgaccctgggtaagtcatcatacttctctgggccttggtgttctcacctgtaaaatgagtgtaagaatgcctgcctcccaggccgggagcggtggctcatgcctgtaatcccagcactttgggaggccgagatgggagaattgtttgagcccaggagctggagaccagcctaggcaacatagtgagaccccatctctgcattaagaaaaaaaaaaaaaaaaaaagaargaatgcctgccctccctaccacacaagaaagatatgagataatacagatatatcaaatgagataataaggagaaatctctttaagaaatataaaagctggccaggcacagtggctcatgcctataatcccagcactttgggaggccaaggagggtggatcacctgaggtcaggagtttgagaccagcctggctaacatgatgaaaccctgtctctactaaaaatacaaaaaatatgcagggcgttgtggcatgcgcctgtaatcccagctactcggaaggctgaggcaggagaatcactt

SEQ ID NO: 18428 - DNA, 601 bp, Human
gcccagaacagcaagaaagtggtgaacgaggaaaggagaatctttgttccagttccaggtgtcactaacaagctgtgtgaccctgggtaagtcatcatacttctctgggccttggtgttctcacctgtaaaatgagtgtaagaatgcctgcctcccaggccgggagcggtggctcatgcctgtaatcccagcactttgggaggccgagatgggagaattgtttgagcccaggagctggagaccagcctaggcaacatagtgagaccccatctctgcattaagaaaaaaaaaaaaaaaaaargaaagaatgcctgccctccctaccacacaagaaagatatgagataatacagatatatcaaatgagataataaggagaaatctctttaagaaatataaaagctggccaggcacagtggctcatgcctataatcccagcactttgggaggccaaggagggtggatcacctgaggtcaggagtttgagaccagcctggctaacatgatgaaaccctgtctctactaaaaatacaaaaaatatgcagggcgttgtggcatgcgcctgtaatcccagctactcggaaggctgaggcaggagaatc

SEQ ID NO: 18429 - DNA, 601 bp, Human
gtcattgagggaccaggccagccctgtaacgagaaccagccaccacctttcaccacatcaaggccatcctgtagggaatgaggcagtgaagtatgtcccacgggtggcatgcagggaatgtgaccactgcagtatattaaaggtgtaagagatgccagcacggtggctgacgcctgtaatcccagcactctgggagtccgaggcgggcggatcacgtggtcaagacattgagaccatcctggccaacatggtgaaaccctgtctctactaaaaatacaaaaattatccaggcgtggtggcrcatgcctgtagtcccagctactcaggaggctgaggtgggagaatcacttgaacccaggaggcagagattgcagtgagccgagatcgtacccctgcactccagcctggcgacagagcaagactctctctcaaaaaaaaaaaaaggtgcaggagtatctgtgggctagggcagagtgtgttgctaagtagcacggccgtctgcctgtgtggctatgctgatggaagaggtatttgtgatatgccagactgatatctcagtcttagtgactctcacagggaaaacctgggaccacaggagaga

SEQ ID NO: 18430 - DNA, 601 bp, Human
agattggatgcagggaatgtacaattggtgctgttgggtggccagtgcataattggacacagactttcaggacctgtgtgaaatggagatggggaaggggcaacctcgaaggggctagatgacagttatagtctcagataggcctcaggtagggagggtcaggaatagagaagagaggacttaaaggtggggctttggaggggtgtgggctggagaacgtagactggggaggaagggatggggtacaagggtaggctgggccagaggagggaggggcgtctcaggatatgcttagcaccckcatgatgttggtgtagccggagccaggtcgccagcctgtcaccacaatcaccaggtctccaacacggaggaagccacggagctttcctgggggagggaaagaaaacaaatcattggacaggtgtggtggctcacacctgtaatcccatcactttgggaagccaaggcaggaggatcacctgaggtcaggagtttgagaccagcctggccaacatggtgaaaccttgtctctactgaaaatacaaaaattagctgggtgtggtggcgcatgcctgtaatcccagctactagggaggctgag

SEQ ID NO: 18431 - DNA, 601 bp, Human
taaagactcaaggcatcttagggcctgctgagcagattggatgcagggaatgtacaattggtgctgttgggtggccagtgcataattggacacagactttcaggacctgtgtgaaatggagatggggaaggggcaacctcgaaggggctagatgacagttatagtctcagataggcctcaggtagggagggtcaggaatagagaagagaggacttaaaggtggggctttggaggggtgtgggctggagaacgtagactggggaggaagggatggggtacaagggtaggctgggccagaggrgggaggggcgtctcaggatatgcttagcacccgcatgatgttggtgtagccggagccaggtcgccagcctgtcaccacaatcaccaggtctccaacacggaggaagccacggagctttcctgggggagggaaagaaaacaaatcattggacaggtgtggtggctcacacctgtaatcccatcactttgggaagccaaggcaggaggatcacctgaggtcaggagtttgagaccagcctggccaacatggtgaaaccttgtctctactgaaaatacaaaaattagctgggtgtggtggcgc

SEQ ID NO: 18432 - DNA, 601 bp, Human
cagtgacaaaatcagctgcccagccctcacttctccccagcatccatcccacccagttttcccaaaagcgtggactttcatgtaactgttagtcaccatgaaggggtagcctgccctggcacgagatgcccagattatcatgagggctacatatgagaatgggagactgtggacaagattgccctgtctcccctctcccccaccccaagggatgggatgcctggggttatggaattaaccagccaaactgggattaaagactcaaggcatcttagggcctgctgagcagattggatgcagrgaatgtacaattggtgctgttgggtggccagtgcataattggacacagactttcaggacctgtgtgaaatggagatggggaaggggcaacctcgaaggggctagatgacagttatagtctcagataggcctcaggtagggagggtcaggaatagagaagagaggacttaaaggtggggctttggaggggtgtgggctggagaacgtagactggggaggaagggatggggtacaagggtaggctgggccagaggagggaggggcgtctcaggatatgcttagcacccgcatgatgttggtg

SEQ ID NO: 18433 - DNA, 601 bp, Human
gcttgcgacgtttcttgctcatggggagagggaagggagagaaaaaaaagagcgagcaggaaggcgcccagcgtcccacacaggggactcgcagccctgcccccaagagcgctggctccgcagcagcagtgccctgcagctccgcgtctgagcagcagcagcgcgcggcccggtggagtgggtggtgcagggcaggggtggtatatcctgtctgacggagggcgggcctcgccagtgccagagagggacgaaccagggtggaagcgccaggagcagctgcagggagccctcacgcggaccwcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcc

SEQ ID NO: 18434 - DNA, 601 bp, Human
cggcccggtggagtgggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtaygaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggtaaaggctcggcccccgcgtggtccgtgcgcccctttccagagcaccctggcccagtggcggggaccaagagacgcacgcatccccggggatgaggggaggcgaggggctgccggccccaggcagggtctacg

SEQ ID NO: 18435 - DNA, 601 bp, Human
agaaacactgggagaggggcccagcaatgcatatattaacaagcccttcagtgattctgatttacactagagtttgagaacctctgatcttaggcatgtaaatctctatccatgttctgaaagagcaaaggaatatgccccggtatggacgacgggaatagaatgggtttcaggttacgttataagacaggtaaatccaaaggacaaataggacaaatagacataaaaactgagggacatggcctgggtgtggtggctcacgcctgtaatcccagcactttgggaggccgaggcaggagcrggtagagggcgcttgagctcaggagtttgagaccagcctgaacaacatgatgaaaccttgtctctacagaaaaatacaaaaattagccaagcatggtggcgggtgcctgtagtcccagctactcagaaggctgaggcaagagaatcacttaagcccgggagggggaggttgcagtgagctgagatagtgtcactgcactccagcctgggcaacagagtgagaccctgtctcaaacaaacaaacaaacaacaacaacaacaacaaaaaccctgagggacttcatggggcttcatgatctac

SEQ ID NO: 18436 - DNA, 601 bp, Human
ttgtctctacagaaaaatacaaaaattagccaagcatggtggcgggtgcctgtagtcccagctactcagaaggctgaggcaagagaatcacttaagcccgggagggggaggttgcagtgagctgagatagtgtcactgcactccagcctgggcaacagagtgagaccctgtctcaaacaaacaaacaaacaacaacaacaacaacaaaaaccctgagggacttcatggggcttcatgatctactgctacagaacagagcacaactcctgtgcatacatgtggaaggccatcacccagaggraacaaaggagaccaaatggggtgccccgttaggagccatagacgcagaggtgtcgtgagtgacactgagcctgcccttcagggctgggggctccctgaacctttgaactgtccttcatcaccacctactgctcttgttatttatttatttggcaaatgtttgccgaccatctactacatgccaggctctttgacaagtgcgggagacacagccatgatagggacaacccagagctgttctggagctacacaattaactccttttctgagagcctcaggagctttgcattcttcatcttta

SEQ ID NO: 18437 - DNA, 601 bp, Human
gaggaattctgagccccctcagcagggctcccagcccaccccgtaaccacccccactgcctattcttcacaggatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtagctggttgcataccttcctccttggtgggcctgcggagggcctgggtgtgtcagcctgactccgcttttagagatgggtgrgggcatctgcagttggcttctcttgccttgcccagctgccaggagccttcgcattgcccaaggttagagctgggcatcttaactttctgcagagcaaagccctctgtttaagtggacattaggcaggtacaattcctccattggtcatggaagagacttcaatgccagccacgggttcaacagaaaccccttttctcaaatcccactaaagaacatgactgctcctcacctctcaactcctgccctcctacctgcttcctctctcccactccccttctctctccaggcatcttacggtag

SEQ ID NO: 18438 - DNA, 601 bp, Human
taagtggacattaggcaggtacaattcctccattggtcatggaagagacttcaatgccagccacgggttcaacagaaaccccttttctcaaatcccactaaagaacatgactgctcctcacctctcaactcctgccctcctacctgcttcctctctcccactccccttctctctccaggcatcttacggtagaaaacaggcctgttgatgcctccaaagctttgctggcaggaaggacactacagggttcttcagttcagcccaaggatgtagtgtcaaaaatgagtttcccagagtcccrgataagtttgtatgcatttctatgtctgtgttctgctttagggttttgaaatgtatttacatccactctcttatcaggtcctcaccatcattctccagaggaagaaagcaggactcaggaaagaggagggaccctagctgaggttctcccagctaggatatgggagctaggatatgggagctaggatctgaatccaggtcttttgcctccgggtctgggtcagttatcatgacctcacactgcttatttattttggttgacttgaatatttctgaactgatagattttttggtctgaaaa

SEQ ID NO: 18439 - DNA, 601 bp, Human
acatccactctcttatcaggtcctcaccatcattctccagaggaagaaagcaggactcaggaaagaggagggaccctagctgaggttctcccagctaggatatgggagctaggatatgggagctaggatctgaatccaggtcttttgcctccgggtctgggtcagttatcatgacctcacactgcttatttattttggttgacttgaatatttctgaactgatagattttttggtctgaaaaaaaaatcagctttgagtagagaataactagatcagcctcatctcccttgaccaggcagygtggcaactctttcctggcaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactggtaggacaacacggccaccgagagccagcctgagggctgtgcaaggccactggctatggccccaggctggg

SEQ ID NO: 18440 - DNA, 601 bp, Human
gctaggatatgggagctaggatatgggagctaggatctgaatccaggtcttttgcctccgggtctgggtcagttatcatgacctcacactgcttatttattttggttgacttgaatatttctgaactgatagattttttggtctgaaaaaaaaatcagctttgagtagagaataactagatcagcctcatctcccttgaccaggcagtgtggcaactctttcctggcaggtctatcagctgggaggcatctgcaagctggtggacctcctccgcagccccaaccagaacgtccagcaggcygcggcaggggccctgcgcaacctggtgttcaggagcaccaccaacaagctggagacccggaggcagaatgggatccgcgaggcagtcagcctcctgaggagaaccgggaacgccgagatccagaagcagctgactggtaggacaacacggccaccgagagccagcctgagggctgtgcaaggccactggctatggccccaggctggggtgcaagcctgtctctccaggctgggccaagacacagctgtgcagatttggcccagggctaatatcctgagagtttagtgacactggccttgg

SEQ ID NO: 18441 - DNA, 601 bp, Human
gactgaggggagaaggggttaacaggccttaagcacctaccctgtgttcaagaaatatggtaggcactcaaggtggggggcacaagaggaagaggtcaccgtgaagacctagaattgggctgggaagatcagaccatgtacagagtaatgactgataagtatttctggcataactttcagatggaaaagagacagcgttagaagactccaagtgctaaaatttatactaaaaaccactgatcaatcaaacgttttttgatcactttccacatgcataattttggccttgacagagaactcygagatgttccctgcctgcaaagaaccttcagtctggttggggcattgagaaatagcctcatgacacagacagacaataggttctacagaccagggctacctggaaagcgacatttcagtagggcccatttgccagagtccaggctggggctgttacctcggtccctagggcatcctgagcctggcacaaattgggttgatggtctctgacccccagggctgctctggaacctgtcttccactgacgagctgaaggaggaactcattgccgacgccctgcctgttctggccgaccgcgtca

SEQ ID NO: 18442 - DNA, 601 bp, Human
gcctccggtagcagcctccaggaagcagagaggctggggagatgaaaagtgaggataattaagagttttatggggttgatgtgctactggtagcaacagcagccacaccccacctgcaccaggctgatgagcccacattgcttggggatgagcccacattgcttgggagtgagcctactgctgggggcagaacacagcttgggtggagagggagcttctggtgcccagcccggccacccccagctccacttctgatccagcatcaacagggcttcttcctgtcccacagaaagagactggrcatgcgggagcttctggctcttgttccgcaaagggccactagtagcagggtgtgagccttgggatgcagctgcggagggaccgttgccacatggagccattgccagttataaagttactgggcagagtgaaggaggagaagaactgagtgcaaatgagacctcatttcagcctcagccagggccaggcggaattggctaaatggtttctctttccttccgttttcatcttttcctctcttcattcctttcctccctttcctcttctccttccttccttctaccacaacttccaatctcca

SEQ ID NO: 18443 - DNA, 601 bp, Human
gtgcccagcccggccacccccagctccacttctgatccagcatcaacagggcttcttcctgtcccacagaaagagactgggcatgcgggagcttctggctcttgttccgcaaagggccactagtagcagggtgtgagccttgggatgcagctgcggagggaccgttgccacatggagccattgccagttataaagttactgggcagagtgaaggaggagaagaactgagtgcaaatgagacctcatttcagcctcagccagggccaggcggaattggctaaatggtttctctttccttccrttttcatcttttcctctcttcattcctttcctccctttcctcttctccttccttccttctaccacaacttccaatctccaccccgtcgtctcctctctgccctcccctctcctgcctgttctctctcctgcctgtcccccaccacactctcttgtccccaccttccccgttctctcttccccctttctctgccctcttccaccctcttctctcccccaggaacctgagctcggccgatgcaggccgccagaccatgcgtaactactcagggctcattgattccctcatggcctatgtcca

SEQ ID NO: 18444 - DNA, 601 bp, Human
tctctcttccccctttctctgccctcttccaccctcttctctcccccaggaacctgagctcggccgatgcaggccgccagaccatgcgtaactactcagggctcattgattccctcatggcctatgtccagaactgtgtagcggccagccgctgtgacgacaaggtgagtgcatcccctggtggcaccctgacccctaggcccagccccctacattttctgggtgcctttgaggcctggcccagtgacaagacaggagcacagactcaggggtggtagaagaggcatctggatgcagggcycagtggtggctacaggagtgggctctggggacagcgtgcccatgcaaatccactctccctcacttagaagtggagtagatgcagctgcttccctaatctctctgtttcccggttcactcttcactctaatggaaagggtcataatcatatcaacctcaagggttgtctgaaaggcttgattagttaataagcaaaacacgaagagggcctggcacagaggaagctcccagcgagcatctgctggctgtgcttcattggtggtgctgaggcctgtcctgtgaccctgagccctgccccaca

SEQ ID NO: 18445 - DNA, 601 bp, Human
ccaggaacctgagctcggccgatgcaggccgccagaccatgcgtaactactcagggctcattgattccctcatggcctatgtccagaactgtgtagcggccagccgctgtgacgacaaggtgagtgcatcccctggtggcaccctgacccctaggcccagccccctacattttctgggtgcctttgaggcctggcccagtgacaagacaggagcacagactcaggggtggtagaagaggcatctggatgcagggcccagtggtggctacaggagtgggctctggggacagcgtgcccatgmaaatccactctccctcacttagaagtggagtagatgcagctgcttccctaatctctctgtttcccggttcactcttcactctaatggaaagggtcataatcatatcaacctcaagggttgtctgaaaggcttgattagttaataagcaaaacacgaagagggcctggcacagaggaagctcccagcgagcatctgctggctgtgcttcattggtggtgctgaggcctgtcctgtgaccctgagccctgccccacagcccagaggaatccatactggtgcccccagggcttagtgtccccc

SEQ ID NO: 18446 - DNA, 601 bp, Human
gctcggccgatgcaggccgccagaccatgcgtaactactcagggctcattgattccctcatggcctatgtccagaactgtgtagcggccagccgctgtgacgacaaggtgagtgcatcccctggtggcaccctgacccctaggcccagccccctacattttctgggtgcctttgaggcctggcccagtgacaagacaggagcacagactcaggggtggtagaagaggcatctggatgcagggcccagtggtggctacaggagtgggctctggggacagcgtgcccatgcaaatccactctmcctcacttagaagtggagtagatgcagctgcttccctaatctctctgtttcccggttcactcttcactctaatggaaagggtcataatcatatcaacctcaagggttgtctgaaaggcttgattagttaataagcaaaacacgaagagggcctggcacagaggaagctcccagcgagcatctgctggctgtgcttcattggtggtgctgaggcctgtcctgtgaccctgagccctgccccacagcccagaggaatccatactggtgcccccagggcttagtgtcccccctgagatgaggc

SEQ ID NO: 18447 - DNA, 601 bp, Human
atctggatgcagggcccagtggtggctacaggagtgggctctggggacagcgtgcccatgcaaatccactctccctcacttagaagtggagtagatgcagctgcttccctaatctctctgtttcccggttcactcttcactctaatggaaagggtcataatcatatcaacctcaagggttgtctgaaaggcttgattagttaataagcaaaacacgaagagggcctggcacagaggaagctcccagcgagcatctgctggctgtgcttcattggtggtgctgaggcctgtcctgtgacccygagccctgccccacagcccagaggaatccatactggtgcccccagggcttagtgtcccccctgagatgaggctccttctgccactgctatcttcccactgcctcccagaaaagccattggcagtcatcttgctgccctctctggacttctggacacacagcacagacaaacagaaagaaaaaaagttgtggagggcagataaacagaaggctgagatgttcccaccatggcaggacagtggctcaggagatagtgaggtccagcaggctccagatcgccagggaacgggctggcatcaca

SEQ ID NO: 18448 - DNA, 601 bp, Human
ctgtcctgtgaccctgagccctgccccacagcccagaggaatccatactggtgcccccagggcttagtgtcccccctgagatgaggctccttctgccactgctatcttcccactgcctcccagaaaagccattggcagtcatcttgctgccctctctggacttctggacacacagcacagacaaacagaaagaaaaaaagttgtggagggcagataaacagaaggctgagatgttcccaccatggcaggacagtggctcaggagatagtgaggtccagcaggctccagatcgccagggaaygggctggcatcacagcacctgggttctcagcacagttgccgtaaggagggattttatctcctgctccctccactggaagcaacagcagggccacagaggagagccttgtcactgggctgctcagcctgcttccaaagggcaagatgcttttctgctctgtgtgcaatatctccaacacctgtgtaaccccaagccctggaagtcagattcccttagaccccagcaagggccaaacatcattaggagggtaaatctgctgcccccaaaccctagtcctttggaggtttgccaaaggagatt

SEQ ID NO: 18449 - DNA, 601 bp, Human
gtcctttggaggtttgccaaaggagattgacaaagatctgagcccagctgccatgatgaagccctgggctccaggtgttgctgtgttttgtgtggacttagcaccgctgacattgacagctaaggactggccccaggaagaaagaatgatgggggcactagatggctttggaatctagaggcatggggcttcttctggaggagtttgttctggaaaaaaaaaaagacacattcttcaatatcccagtctgcccattggcatgttgtccatagcagtcctaccacacactaggccctgtgawaagtgctttctctgtatcatcttccaaatagcctagtgaaatggacaattgtagtctcattttacatttgagatagctgaggcccagagaagtgaggccagtcaagttcatgcagccaggaaatgacagattcaaactcaggtcccagaggtggccctggaagacttcccaggctgagagtgtggtggtgcctgcgctcatctttcccgatgcagcccaggtgcctctgctctcttattagctagggtaggtggtaggccaggagcctgtcgggccgggcagaggctcaggcccatgcct

SEQ ID NO: 18450 - DNA, 601 bp, Human
cctaccacacactaggccctgtgataagtgctttctctgtatcatcttccaaatagcctagtgaaatggacaattgtagtctcattttacatttgagatagctgaggcccagagaagtgaggccagtcaagttcatgcagccaggaaatgacagattcaaactcaggtcccagaggtggccctggaagacttcccaggctgagagtgtggtggtgcctgcgctcatctttcccgatgcagcccaggtgcctctgctctcttattagctagggtaggtggtaggccaggagcctgtcgggcygggcagaggctcaggcccatgcctctccttggtccccagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatggtgagcacagcatcagcagggcggggcctgccccatcaagcacccccccaggagccactgcctcatctgccctttcctctgggccctcctggagcctgaagccag

SEQ ID NO: 18451 - DNA, 601 bp, Human
tgcgctcatctttcccgatgcagcccaggtgcctctgctctcttattagctagggtaggtggtaggccaggagcctgtcgggccgggcagaggctcaggcccatgcctctccttggtccccagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatggtgagcacagcatcagcagggyggggcctgccccatcaagcacccccccaggagccactgcctcatctgccctttcctctgggccctcctggagcctgaagccagccctaagggacaggcccatgctgacaccttggcctggggctcagggtgcactctgggagctgggtagaggccattcatcttgcacaagggggaatctgttcttggaactgtaggggctcagaccaccttagaggtcaaaaactccagccttctgtttgcaggccttggtctttcttcctgtataatgggtcaagtctcccccatcttctcccttgcc

SEQ ID NO: 18452 - DNA, 601 bp, Human
cagaccaccctctttggcccagggtgggtcaaacctactgtctgagtatggaagaggaggaagcatcatgatgggagagcccaaagcagccccacatatctggaaggtttgggccaaggctgccctggaacacagctcccaagatgccaggatgctctcttctcccacatcctgggacagtctgggggaccatggcccattcctgcatcccatggagctgctgcagtgcatagaggaaaggggtgcagcggggctgtcctgggccccctgcctctgcaggcgcttcctcagcttgccctayctggaaccacgaccctgaggctggggggatggggacagaatgcctgggttgtgtcctctcacaaggctccccactgacccccctgaccggctctttatcctcagaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctggtgagtgggactgtacctt

SEQ ID NO: 18453 - DNA, 601 bp, Human
agagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctggtgagtgggactgtaccttctctactgcagcagccccatcctccagccaccgtccagcctctgctccctccttttccccccagcctgtcccctgacttcggagcctcccatgagcagagtgtgcctggcatatgctgggctctgggctgggcaatkgggaaacactcctgccctttaggagctgctgggggatgcagagagggtgggcccactgatgctggattctgtccatgcacacacaatccccttggccacatggctcccggtccccagctggcctcctgggctctgcttgaggtcggggaatgcggcggagaaggtgtttggcaaaaggagtttcccatttgttgaactgacaaaggtggaaaaagagggtttggggtccaagcaggtccagagaagatgtgacagaatccgtgcagatgttgaggccaaatgtatgtagcttggagggca

SEQ ID NO: 18454 - DNA, 601 bp, Human
gggcagcggctggttgtaccattcagatgccatccgcacctacctgaacctcatgggcaagagcaagaaagatgctaccctggaggcctgtgctggtgccctgcagaacctgacagccagcaaggggctggtgagtgggactgtaccttctctactgcagcagccccatcctccagccaccgtccagcctctgctccctccttttccccccagcctgtcccctgacttcggagcctcccatgagcagagtgtgcctggcatatgctgggctctgggctgggcaatggggaaacactcctgycctttaggagctgctgggggatgcagagagggtgggcccactgatgctggattctgtccatgcacacacaatccccttggccacatggctcccggtccccagctggcctcctgggctctgcttgaggtcggggaatgcggcggagaaggtgtttggcaaaaggagtttcccatttgttgaactgacaaaggtggaaaaagagggtttggggtccaagcaggtccagagaagatgtgacagaatccgtgcagatgttgaggccaaatgtatgtagcttggagggcacagtggtatggggca

SEQ ID NO: 18455 - DNA, 601 bp, Human
gtccatgcacacacaatccccttggccacatggctcccggtccccagctggcctcctgggctctgcttgaggtcggggaatgcggcggagaaggtgtttggcaaaaggagtttcccatttgttgaactgacaaaggtggaaaaagagggtttggggtccaagcaggtccagagaagatgtgacagaatccgtgcagatgttgaggccaaatgtatgtagcttggagggcacagtggtatggggcagagccagaggaaacctgttgcaatcaagaagagttgagatgggccaggcggccaaytgttcttcagctttacttaggaaaagggaaccgagcagcagcagcactagagtagaccgagggcagagaacttccctggctgtgaggagagaggctgggcagttctgagaatgccaaacccacctagacctgttacacccaggatagctatgttgcttagaggcctgggcgaactggcctacctctaggggaccccagttctctctccatgtgggcccagaccctttcttagccctcttttctcaggcaagccctcaacaaatatgtgttggattctaaagaggtaggaaagttggaaga

SEQ ID NO: 18456 - DNA, 601 bp, Human
atgtaatgggggcagcgctgagacagtggggtgagagagcagcattggacgcttgggttactctggaagctaactctgggtcactatgagtaggggaaatgagacttccctctctccacccatctgggctgcaggctgatccaggagacaggatcagggctgggaaaggggaggtgcatgttagcctaggtttctgtagttgcccacatgtgagctagtgcttccaatatgaaagagaaagggttctgggatgtctgcctttggggctccttgcccctttctgcctgccatggtgcctgggaagccacaggctagctcatcatctactccttctctcttagatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatgggtaaggtccctctctctcctccccctctagctaagacatggcaggctccctacaattcaagcctgcttgaaggtcatcctttaagccattccctgggatgagcatt

SEQ ID NO: 18457 - DNA, 601 bp, Human
caccctctgctgcacagagtgatgggtaaggtccctctctctcctccccctctagctaagacatggcaggctccctacaattcaagcctgcttgaaggtcatcctttaagccattccctgggatgagcattccaagaaaggaagctggccaaagacaggtatggagacaggagaagggagcctgtcacctgagggctgggagcagatctgcaaaagtcctatctgggtctctgagccctgagttggagctgccaggaagccctgagggccacctggctcagagcctggcagaaggctatcraagagtgtggccccagagggaacccctcagcccttccttccccagtcatcctgaccctgtgccccaactcgttcctctcccagggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcaggtgggcggggggttgctcccacgggctgca

SEQ ID NO: 18458 - DNA, 601 bp, Human
tcaccctgtgagcaaggcagagtgggctgagaagcctggaggctgctgtccttgtcctgtggtggccttggcctcctctctgtcctccacccctccccagctagccaggtacagagtcctctagggtataaggtcttgttgtatgacatcttcacatggcctcttctttcccattcctcagtgataagcatggacataaaggacaggaggtggaagaaatggagcagtggggctgattaggctggagcttttagcttggagactatggttatattcacaaagacacatcagatgaggagarcctgagaaggcttttaggtgggagtaagaggggtcccaatttggagaggttgagtttggaagacttggatgggagtccaggctggaggtggtgtgggccctggcagaggggccagagctaccatacagagtggagctttgttcaggcaggcgaagccatgagaacaggcaagaccaccatgggttgcatgtgtatggaaaagtcttgaaggacagggcagaaatatgaagaccatctgctggggacaagaaggaggaaaggccagggaaaagaggaactgtgcagggtgccagaaggggc

SEQ ID NO: 18459 - DNA, 601 bp, Human
agagcctgagaaggcttttaggtgggagtaagaggggtcccaatttggagaggttgagtttggaagacttggatgggagtccaggctggaggtggtgtgggccctggcagaggggccagagctaccatacagagtggagctttgttcaggcaggcgaagccatgagaacaggcaagaccaccatgggttgcatgtgtatggaaaagtcttgaaggacagggcagaaatatgaagaccatctgctggggacaagaaggaggaaaggccagggaaaagaggaactgtgcagggtgccagaagrggctgaagacctggtaagaagagaaagctctaaggaaggcagggcagcagttcccagggctacctagaggaccaggggatggacactggaaaaggccctggatccggtgcttcggaagtctctggagccgtccaggagcactgctggccaagcaaggggagccccatggggcctgctgcagtgggcaaggcagtggatggggatggatggggagttgctgagaggagatgctgctccctgcaatttagcctgcagaaaaaggagcaaaacagtgggtaaaaagagatctgtttaaagaca

SEQ ID NO: 18460 - DNA, 601 bp, Human
ctagaggaccaggggatggacactggaaaaggccctggatccggtgcttcggaagtctctggagccgtccaggagcactgctggccaagcaaggggagccccatggggcctgctgcagtgggcaaggcagtggatggggatggatggggagttgctgagaggagatgctgctccctgcaatttagcctgcagaaaaaggagcaaaacagtgggtaaaaagagatctgtttaaagacagaggagactcaagcatctctgtcatgggaggagagggagtaggcaaagaagggagaaagacagrgatggaggacagggaagcctggggattggttgagcagcgtggggcagaaggaagcccagctcttcctccagcatggcaggggacaatagggagactcatgaacgcacggtgtccaaagatgattggggaaatctgaaggtcacagcaaagggtggcccttgttctccatgtgacaatccagagctcctttccaacagcactgcattgaagatgggcttggcaaatggcaactgccagatagacaaagggagacgaggaggcaggtaaggaggactggtgtgagcttcctcccgctgtgta

SEQ ID NO: 18461 - DNA, 601 bp, Human
caaggggagccccatggggcctgctgcagtgggcaaggcagtggatggggatggatggggagttgctgagaggagatgctgctccctgcaatttagcctgcagaaaaaggagcaaaacagtgggtaaaaagagatctgtttaaagacagaggagactcaagcatctctgtcatgggaggagagggagtaggcaaagaagggagaaagacagggatggaggacagggaagcctggggattggttgagcagcgtggggcagaaggaagcccagctcttcctccagcatggcaggggacaatarggagactcatgaacgcacggtgtccaaagatgattggggaaatctgaaggtcacagcaaagggtggcccttgttctccatgtgacaatccagagctcctttccaacagcactgcattgaagatgggcttggcaaatggcaactgccagatagacaaagggagacgaggaggcaggtaaggaggactggtgtgagcttcctcccgctgtgtaatggtggtccaaagcattcagcttaccccaaaacacagagtccacccccggcctaagacacacagagaatccactgacatcgctctcgg

SEQ ID NO: 18462 - DNA, 601 bp, Human
caaagaagggagaaagacagggatggaggacagggaagcctggggattggttgagcagcgtggggcagaaggaagcccagctcttcctccagcatggcaggggacaatagggagactcatgaacgcacggtgtccaaagatgattggggaaatctgaaggtcacagcaaagggtggcccttgttctccatgtgacaatccagagctcctttccaacagcactgcattgaagatgggcttggcaaatggcaactgccagatagacaaagggagacgaggaggcaggtaaggaggactggtgwgagcttcctcccgctgtgtaatggtggtccaaagcattcagcttaccccaaaacacagagtccacccccggcctaagacacacagagaatccactgacatcgctctcggtgggaattcccttctacacatgcctttgggaaccagcgtccccattcagtctccactcctccttccagctatgcttgacaaccatcctgggcatgatctagttggtgcgtctgttcccaaagggccttcacatccatcatgcattgagttgtcacaagcacaggtgagacaggccacatggcttgtgtcca

SEQ ID NO: 18463 - DNA, 601 bp, Human
ctgactcaatagccctggagtgggatccaggaaagtctatttttaaacaagcgtctaaagtgtttctgatgcgggtaaactgagaatcacaaatagagatactgcagccagatgtcatcacccctagagaggggcctcaggggcagcccagcatggagccatctgcaaatagcctgggatcaagacagggtctcctgagctaagggggacctcttaaccaggctgtctgccagcaccccccaccccaatccctggtggggagagaggattgtaactttggtctggatgaaggttaaataaracttcagatatcctctcctagtaaacaagctgcaacaacttgaaggcagaaaaggggaaagagattcggtttggcaaatccttaatgaacaccaccttctttcttagtgaggaagacggtgggcaggggacagtgtggcagggtggcagacaaagctgacaagcttctgaatccacagggcaatctataaatgtgtctagggcagccttgaatccagtctcaggccagggcacacttgagggccgacgtgagaagagggtggcagtacaggctgggcttgtggtgtggaaacatctcact

SEQ ID NO: 18464 - DNA, 601 bp, Human
atccctggtggggagagaggattgtaactttggtctggatgaaggttaaataagacttcagatatcctctcctagtaaacaagctgcaacaacttgaaggcagaaaaggggaaagagattcggtttggcaaatccttaatgaacaccaccttctttcttagtgaggaagacggtgggcaggggacagtgtggcagggtggcagacaaagctgacaagcttctgaatccacagggcaatctataaatgtgtctagggcagccttgaatccagtctcaggccagggcacacttgagggccgaygtgagaagagggtggcagtacaggctgggcttgtggtgtggaaacatctcactgtaaacactaactggaggactttctccttttccaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaa

SEQ ID NO: 18465 - DNA, 601 bp, Human
cctcccctgtacctcatcagactgagagttcttgggaggttggaaccaggttcctcccaactacctgggaggttcctgaggtcagaggatgtgtccctcgctagacatagcttgcatatccccacactggattcaaggcttggagtctccaaggcacccatggaggctcggcctcagtattttcctccagaatgaaagcatcaacctctctcttctaggccttctaaccccttccacatacacaagttcccaaacacatacatgttaacacacctatgcccacatacacacactctcgtamttacctgatagtgccaacatcctctcttacactacactcacatactcactcaacacactcatgcacacacaccctctcatacatatcaaatcatgcacatgcatgcacaacacagccactctcaaaggcagcgaatgagcaggaattctgctcttgacaggacatcagcttcgctggctctttacctctcagaggactccagagttgtatccccaggccgtcttgtttgttctgcactcctgctccccttaaatagctgctccctctgggaggttgggggtaggtgaggcacaaggctgg

SEQ ID NO: 18466 - DNA, 601 bp, Human
ggacctgcagcctgtctcttgacatcccaggtgtagacactggccacgtggcatagctgaaggccaggagaaggctggattcttaatgacatggctggaaagctgccccaagcctggcactgcactcttccagaattctagttatgcgacagtcacatatccccattatgcaagccactgtcagcttggcatcatgtggcttgtgacctaacgcctgctgaagatacatgcctctatggagaggccatgatgggagacataatttctgatcttaaaggactcaggccatgggcaggagtcyacgctttttccaaatcccactcatgagtcagctgtctggggacaccaagcaaagccttccagtgccacccacctctcctccccttcagggccaaactttctccagaatgttgtctttgcctcctgtctttatttgccttcccatcagcccccacctggtctaatctggctttgccctcccgactccatggaaacagcttcccctgagtccctcatgcgtttctgcctcaacatccaggggagccttgttggcccttttcatggaggactccctgttcacttggcccttgctaaccatttc

SEQ ID NO: 18467 - DNA, 601 bp, Human
cacagccagtctgactccagaagctatttttttcgtttgttttgttttgtttttataaagataaggtctccctgtgttgcccaggctggccttgaacttctgtgagctcaagcaatccttgcacttcagcctcagcctcccgagcagctgggacaacaggcacacagcactacaccagactcagagcctgtatttttaacccctacccctgtttgttctcatgctaacagtgcatagggcaatgcatacacacacacatatacatgatttgctaattgctttattcagaagagaccccccrgagtacagcttctttggttaagcacggagttgaggtggaggagagcagtagaaggctggaaatctgctggatgtctcattctgggtgggtatagaagggctcctgcctggcctctaggatgggtgagggatgctttctgcatggccaaggaacttggttagggtagggagggagggtatgagagagggaaattcagcactgggtggaaggtttccagggaagaggggactcagcaacgaggggtgctccctctgcagtgtttattggaatagtactggtactttttattgtaggtcgtct

SEQ ID NO: 18468 - DNA, 601 bp, Human
gttcccagttggggctatcgaccacccagggtaggcgccaaggggtggctaaggaccgcctacgtcctcacggcgctgaaccctattctgggtgcactggaggaatgagagggaggccctaaccagctcttgaagagctctggtgcttggaaagatgagacggggctgaagaactcttaagagcaggaaacttgtgctaggttggaaaatgtaatctggactcaccgctagtgctcgggactgatagaccaggatttcaacccaagatcaggcccccttatcagctatgtgccggccccartcctgtaaccaatgggctgtgccgtgagtcatgatattaaaaacaggtttccaggtcaaaccgacctagtggagtctcatcttcacctcttgacatctgtgtgaccttcagcgagtcattaacctctctgagcctcaacatctacagctttaaatggggatgttacctgttccatatggtgtctgtgaggatcaaatgagattgtgtaagttcttgaaagtatgttggacacaacacactaggcctcagtaaatagtagccacctccaccacacccatctccagcccctgcaatggacta

SEQ ID NO: 18469 - DNA, 601 bp, Human
aagacattcagtgtaaatgtacaactgagattgctcaaagtgctgagttataagacttgtaaaaatacattgtgatgtgtcttaatgtagggctattttttcatcttagtttataacttttttaaaattatcacacagtttggaatttaccataagattataccactaagaccactctttctagataggagctttgcttttagaagagactaaaaaatctagttatcttactcttttacatttttgttttgttttgggtgattgcaataaaatcaattctaagcttctccttttttttttkttttgttttgttttgttttgttttgagacgaagtctcgctctgtgacccaggctggagtgcagtggcacgatcttggctcactgcaacctctgactcccgggttcaagtgattctcctgcctcagcctcccgagtagctgggactacaggcgcccaccagcgcgcccgcctaatttttgtatttttaatagagacagggtttcgccacgttggccaggctgatctcgaactctgacctcaggtgatccacccgcctcggcctcctaaagtgccgggattacaggcatgagcctccatgtc

SEQ ID NO: 18470 - DNA, 601 bp, Human
ttatcttactcttttacatttttgttttgttttgggtgattgcaataaaatcaattctaagcttctcctttttttttttttttgttttgttttgttttgttttgagacgaagtctcgctctgtgacccaggctggagtgcagtggcacgatcttggctcactgcaacctctgactcccgggttcaagtgattctcctgcctcagcctcccgagtagctgggactacaggcgcccaccagcgcgcccgcctaatttttgtatttttaatagagacagggtttcgccacgttggccaggctgrtctcgaactctgacctcaggtgatccacccgcctcggcctcctaaagtgccgggattacaggcatgagcctccatgtctggccctaagcttcctctttaatttcattatgttgttttattttaaaatcaacaacttaaatccataaatggagtatagtgtagcatttaaaaggaatgatgagctagatctgtgttggcatgaaaagatcaccacagcatagtgctgaaaaaccaaagtccctgcacaggacatgattccatttatgtttcaaaaataagacctatttgtatatgtgccca

SEQ ID NO: 18471 - DNA, 601 bp, Human
ccaccagcgcgcccgcctaatttttgtatttttaatagagacagggtttcgccacgttggccaggctgatctcgaactctgacctcaggtgatccacccgcctcggcctcctaaagtgccgggattacaggcatgagcctccatgtctggccctaagcttcctctttaatttcattatgttgttttattttaaaatcaacaacttaaatccataaatggagtatagtgtagcatttaaaaggaatgatgagctagatctgtgttggcatgaaaagatcaccacagcatagtgctgaaaaascaaagtccctgcacaggacatgattccatttatgtttcaaaaataagacctatttgtatatgtgcccatagatgggtatataaatgcatagaaaaatagctgggacagtgcacaacagctactaacatattacctgtgtttaaaatttggtaaaaataacacttaagtttattctggtaaagatgcccccccagttacaactaaaatatttgaactatgtacagagctggtaacttaattggcatgtatgaaaataaggcttatagacctggcttatacctgtaatctcagcactttggg

SEQ ID NO: 18472 - DNA, 601 bp, Human
atagatgggtatataaatgcatagaaaaatagctgggacagtgcacaacagctactaacatattacctgtgtttaaaatttggtaaaaataacacttaagtttattctggtaaagatgcccccccagttacaactaaaatatttgaactatgtacagagctggtaacttaattggcatgtatgaaaataaggcttatagacctggcttatacctgtaatctcagcactttgggaggccaaggctggtggatctcctgaacccaggagttccagactggcctgggcaacatggcaaaacttwgtctctacaaaatataaaaaaattagccaggtgtgctggcacataactatggtcccagctactcaggaggcagagataggaggatcaccggagtccagggaggtcgaggctgcgatgagctatgaccatgccactgcactccagcttgggtgacaagtgagaccctatctcaaaaaaaaattttttctttaatttttaaataagaaaataagacttatgtacttgtgttacccttagagttttggtctcctgattattgtgtggcttatgactgttgtattttctttcttgaaatttaga

SEQ ID NO: 18473 - DNA, 601 bp, Human
gcctgggaatcctatttcagtgagtacctctgagagattctagtgtacaaccttgctaatgtagcattctgtaattattgtaaactatccgattatatgtttttgaagagcaggagtatgggttattcatctccatagccacagggcctcctggcctgtaagaaattgtaagtggatgccaggcgcggtggctcacgcttataatcccagcacttggggaggccgaggcggatggatcacctgaggtcaggagtttgagaccagcctggccgacatgatcaaaccccatttctactaaaamtacaaaaaatgagctgggcgtgatgacgggcacctgtaatcccagctactcaggaggccgaggcaggagaattgcttgaacccaggaggcagaggttgcaatgagccgagatcacaccattgcactccagcctgggcaataagaacgaaactccgtcttggaaaaaaaaaaaaaattataagtggagaggtggatgaattgattgttcttttaacccctgttgtccccagagtcctcacatcttggaaccagctcctctagagcaagatttctcaccttcgcactattgatattttggac

SEQ ID NO: 18474 - DNA, 601 bp, Human
aatcccagcacttggggaggccgaggcggatggatcacctgaggtcaggagtttgagaccagcctggccgacatgatcaaaccccatttctactaaaactacaaaaaatgagctgggcgtgatgacgggcacctgtaatcccagctactcaggaggccgaggcaggagaattgcttgaacccaggaggcagaggttgcaatgagccgagatcacaccattgcactccagcctgggcaataagaacgaaactccgtcttggaaaaaaaaaaaaaattataagtggagaggtggatgaattgrttgttcttttaacccctgttgtccccagagtcctcacatcttggaaccagctcctctagagcaagatttctcaccttcgcactattgatattttggaccagttagttctccattatgaaggctgtcctgtgcattgtagggtctttagcaacatcccaggcctctacccactagatgcccacagcatacacacacgcacacatacggctatgactaccagaaatgtctccagacattgccaaatgacctctgtgtaaaattacccccgtttgagaactactgttctcaaagatgtaatat

SEQ ID NO: 18475 - DNA, 601 bp, Human
agccgagatcacaccattgcactccagcctgggcaataagaacgaaactccgtcttggaaaaaaaaaaaaaattataagtggagaggtggatgaattgattgttcttttaacccctgttgtccccagagtcctcacatcttggaaccagctcctctagagcaagatttctcaccttcgcactattgatattttggaccagttagttctccattatgaaggctgtcctgtgcattgtagggtctttagcaacatcccaggcctctacccactagatgcccacagcatacacacacgcacacmtacggctatgactaccagaaatgtctccagacattgccaaatgacctctgtgtaaaattacccccgtttgagaactactgttctcaaagatgtaatatgttacagtccaaatctgtatggactgtatttataggatcaccattactagaagagtaatctctgcaatctctttaaaactctctcttccacttccacttcattttcctggtagatctcctacttagaaatgctataaaccgcatactggggatcacgaagccctgaaaatcctgttacctgctcatgatcgccctttctgca

SEQ ID NO: 18476 - DNA, 601 bp, Human
gctctgtcacccaggctggagctggagtgcagcggcacgatctcagctcactacaacctccgcctacctccgcctccctggttcaaacaattcttacgcctcagcctcccccatagctgggattacaggcacacgccaccacacccagctaatttttgtatttttggtagagacagggtttcaccatgttggccaggctgatctctaacccctgacctcaagtgatccgcccacctcagcctcccagagtgctgggattacaggcatgagccaccacacccagccttttcttctttttttwaaaagatggggtcttgctgtgttaaccaggctggagtgcagtggtgcaatcccagtggcctagaactcctgggcacaggtgatcctctgcctcagcctcccacgtagcagggactaccggcacatgccaccaagcctggctttaaatctattaataacatttctatgatgataaaactagagcagactgcttcactataagcatttttttttttcttttttcttttttcgtggtggaatctcactcttgcccaggctggagtgcagtggctcaatcctggctcactgtaacctctgcctc

SEQ ID NO: 18477 - DNA, 601 bp, Human
tttctgtctccctaggctttctttttgtttttttgttttgttttgttttttgagagagaggatctcgccctgttgcccaggctggagtgcagtggcatgatcatagctcactgcagcctcaacctccttggctcaagtgatcctcctacctcagcctcctgagtagctgggactacaggcacatgccgccatgcctgactaattttttaattttttgtagagatagggtcttgccatatggcccaggctggtctccaactcctggcctcaagcgatcctcccacttcactctcccaaaatkttgggattacaggcattagccactgcccctggctttcataaatgtttggtttggggacctaccttctgccatgggtacaattatctcagttccatttttaaaataatagtaatactaataatgatgaacataaatgccgacagtaaatttaaagactggcaggaaatagacccaaatgttaacagtggctatttcttgatggtgaggttgcaagtgatttctttgaaatccttctcatttttacccccagttttcaacacttactatgtaacaccttaatcatcagggttggaattaagt

SEQ ID NO: 18478 - DNA, 601 bp, Human
ttatcctattctgtttacttttgtgtgtgttagaaattttccatggcgaaaagataaaatatacaaatatcccaggtcagttccatttttactttgggctgagcactaagggaggatttaaaaaaaaaaaaggcataatcctgtcctcaaagagcgtatcatttagcgagggagagggatgtggagagccataattccagaacagtagaagagacctggtgaatccaggaggcagaactgagacccaccttgatccacatttgtccacatttgcctgacaacactaactacatgccccacracggccaggcagatgcagtaagacttcagagagcccaggtctttagggcggaactgattgcttagtaaaccaccttcagccttgttttggggaaggctttctaaactgcatcaacttctctctgtgccttggaaatgagaagaagaatatgtccttgagtgggggggcattaattgagctctttttctgatcattaggacctttagccctagggtcacccggggcacggtcacccgtcccctagtgcctcagtgctcatacacacgtggtagaggacaggctgggcctctgccaactccg

SEQ ID NO: 18479 - DNA, 601 bp, Human
gtgggggggcattaattgagctctttttctgatcattaggacctttagccctagggtcacccggggcacggtcacccgtcccctagtgcctcagtgctcatacacacgtggtagaggacaggctgggcctctgccaactccgggacggcctggacatgggattattgagagagatttttaggctcgcatattttgttacatcatttgcctctttctctgcaagttgagcaaaataggagagaggatccagacgattgagattttgctgtttttactttaatgagtattcattgcttcccastttacaaagtacctttacataactggcatgtttgatttttaacaaggccctttggaggtaaccagagcaagtgccattagcctttctgtaggtgaataagaggaggcttggagaggtgcccagagccacacagcctcctaagaggccacactgacatggaatcaggtcatcagccctgcacgtggcatgtggtctctcggtatttccaatggccaatgcccaggacatcaggtctgtgagattaaaatagtagaaaaaaatgagggaaaatgtttcataagggttcccaagcatcaacgt

SEQ ID NO: 18480 - DNA, 601 bp, Human
tctcattttctgtgatcaaatcaaacatttaggagctgtctgctactgggtaaattgaatttcctcagttattactgaggctcgttggacaattctcagagcctttttctgtgtagctttgcttggtactatcagtctgttcagaagctccgtagcaaaatagatgtctggtacatgtattttcaaactcttcagggaaatgactgctgttgccagtgctggaaatcattttcatagctctttattaaccacaaaattatctgcccagtagcagcactgtgcaacagaaatagaaagtgarctatgtataattttaaattttctgtagccacattttgaaagaatgaaaaggaagaggtgaaatgaattttaataatatattttatttagcctgatatttctaaaatatgacttttttttttttttttttgagacagggtctcactctgtcacccagactggagtgcagtggtgtgatctcagctcactataacccctatctcccaggctcatggaatcttcctgcctcaacctcctgagtagctgggattataggcatgcataaccatgccaggctattttttgtattttttgtagagac

SEQ ID NO: 18481 - DNA, 601 bp, Human
agacaaaaaccaaccactctcttttctgcataattagccataataggacttgcctagtcaagaaacagcttacacgctgttgggcttggttctaaattcttacccaacagcattcttcctacctggactcctctcatcaaaagaggagcactttgattactaaagagtaggaacttctcacacctttgggcagaagagaagcactatagtgaactccataagggagacatggaattgaaccccttaggtaaactagaccgatgttttggaatcatagaatgtttcaacagcaaggaacctyaggggccaattgggtggcttttacagatcaagaaactgaggcccagaaaggagaagagacttgtccaagttcacaaagctgttgtttacacagccagtgtgtgaacgtttctggtgtctaatgcagagttcttcctgcagcacggacatctcaggcttgtcttttgttagaatattcctgccaaatgctttgcacaccgatttctcttgtcagtgctaatgagtcattgctcaaagcctcctcattttactagctttcatcaaggtagaggttgtaggaaaactggaatggcaaagggat

SEQ ID NO: 18482 - DNA, 601 bp, Human
acggacatctcaggcttgtcttttgttagaatattcctgccaaatgctttgcacaccgatttctcttgtcagtgctaatgagtcattgctcaaagcctcctcattttactagctttcatcaaggtagaggttgtaggaaaactggaatggcaaagggattatatttaacagatgagtgggtgggttttttgtcttcctgaactgtgagatggacatctttctgacaaagctttgaaagggtttttgttgcccgtgagcactgcctgtaaatcaccttcagtgaagattctcatttttcccrcaaaatatgccggatgcaacctgcttccgggcatttccccctgagggtgtgttaaagcccgagacaagcacagcagaatgaggctggtatcagatttttcataagcatgcttcctttaaaccacacgcttgacagggcgcttaaacgcaaatgcatttctcactctgagttggcattctgtgcctcaattttagacctatgtgaaataatgctggaaaaaaacaatgtagaattaatttctagaacctatgcatgaagtagtctaagtagcaaactagagtactgaaaatcaaccttggc

SEQ ID NO: 18483 - DNA, 601 bp, Human
gaggttgtaggaaaactggaatggcaaagggattatatttaacagatgagtgggtgggttttttgtcttcctgaactgtgagatggacatctttctgacaaagctttgaaagggtttttgttgcccgtgagcactgcctgtaaatcaccttcagtgaagattctcatttttcccgcaaaatatgccggatgcaacctgcttccgggcatttccccctgagggtgtgttaaagcccgagacaagcacagcagaatgaggctggtatcagatttttcataagcatgcttcctttaaaccacaygcttgacagggcgcttaaacgcaaatgcatttctcactctgagttggcattctgtgcctcaattttagacctatgtgaaataatgctggaaaaaaacaatgtagaattaatttctagaacctatgcatgaagtagtctaagtagcaaactagagtactgaaaatcaaccttggcaacccactaactgacaaaagagtaaattgtttttttcagtgacatatcattagcccctttttcaccttttgcctttgtgtgccccgtccccacccggcaggaggccagatcagctttgatgtcttt

SEQ ID NO: 18484 - DNA, 601 bp, Human
gagttggcattctgtgcctcaattttagacctatgtgaaataatgctggaaaaaaacaatgtagaattaatttctagaacctatgcatgaagtagtctaagtagcaaactagagtactgaaaatcaaccttggcaacccactaactgacaaaagagtaaattgtttttttcagtgacatatcattagcccctttttcaccttttgcctttgtgtgccccgtccccacccggcaggaggccagatcagctttgatgtctttcctgatggatgggacaagagatactgtctgcgacatgtggmaaatgacggttataagaccatttatttctttggagacaaaactatgccagtaagtagagaagtgtttgtgcaccttcattgttgcatttgcgcttgatgggggaaattgacaactgggctgtttttcctgtacctacactttacccacccgccctgctcaaactgagcagtggcttctgtcctggagaggtgggtgattgagccaccttcccctctaagctcagaccccctacgcctctgtggaggcaaggatcacactgcatgttagttgaaccttttcaccttggctttggaattaaa

SEQ ID NO: 18485 - DNA, 601 bp, Human
gacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccmctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgt

SEQ ID NO: 18486 - DNA, 601 bp, Human
aagttagatttgctctagaaattattactttgttttatgccatttggacatttatttatttaaccaacacttatgtgatcacaacatactcaggactgttctaagtaagcactttagaaatatgagcatatctaactcagggttttctttcccttcctttgtgattttcaaataaactttttaataaagtctaatacacatacagaaaagtgcatatattgggtgctacagctcgcttcttcctttcttttgaacccaatagtttaatcaataaccacccaggtcacagccacaccatatrctgccagacaggtaaacccaacccatctgtccctcactgcctctggcctcctgcctggttctcaatggtggcagaggaagtgctactcagtgcctgctgaccaggcttgccacacccagagcccggctggccaaggctctgccacaggtggcagcttctccctaacctgcttaccaaggccacctgccagctgtgtgtgcacagctattttccatgggggaaaaagcatctagattcctttcttcctttcaatctggatgcattagggtttctagatgctctcagatggccccccacctc

SEQ ID NO: 18487 - DNA, 601 bp, Human
aaagcagttaacatcgtgtctgcaacataataagggcccagtgcccaaattgccaccactattattatatcacatttaactctcacatcaacctttcagggaagacctgaccacctctgcactaaagtagcttgtaactctgataggtaggtaggtaggtaggtaggtagatagatagatagatagatagatagatagatagatagatagataaagatttataaatgaaagtgcatatgcaagtagaaaaaaaagtctaaagacatggcagtgttttctttcctccacaggtcattttatragttagatttgctctagaaattattactttgttttatgccatttggacatttatttatttaaccaacacttatgtgatcacaacatactcaggactgttctaagtaagcactttagaaatatgagcatatctaactcagggttttctttcccttcctttgtgattttcaaataaactttttaataaagtctaatacacatacagaaaagtgcatatattgggtgctacagctcgcttcttcctttcttttgaacccaatagtttaatcaataaccacccaggtcacagccacaccatata

SEQ ID NO: 18488 - DNA, 601 bp, Human
cctgcttacttttgttgtgaatttgggcaatttctcaagttcactgagcttcagttttctcaggtgcaaaaggaaatagtaatgcctgctttaaaggtttatggtggtgattgaaggagacaatatgtacaaagcagttaacatcgtgtctgcaacataataagggcccagtgcccaaattgccaccactattattatatcacatttaactctcacatcaacctttcagggaagacctgaccacctctgcactaaagtagcttgtaactctgataggtaggtaggtaggtaggtaggtagrtagatagatagatagatagatagatagatagatagatagataaagatttataaatgaaagtgcatatgcaagtagaaaaaaaagtctaaagacatggcagtgttttctttcctccacaggtcattttataagttagatttgctctagaaattattactttgttttatgccatttggacatttatttatttaaccaacacttatgtgatcacaacatactcaggactgttctaagtaagcactttagaaatatgagcatatctaactcagggttttctttcccttcctttgtgattttcaa

SEQ ID NO: 18489 - DNA, 601 bp, Human
tcaccctgcttacttttgttgtgaatttgggcaatttctcaagttcactgagcttcagttttctcaggtgcaaaaggaaatagtaatgcctgctttaaaggtttatggtggtgattgaaggagacaatatgtacaaagcagttaacatcgtgtctgcaacataataagggcccagtgcccaaattgccaccactattattatatcacatttaactctcacatcaacctttcagggaagacctgaccacctctgcactaaagtagcttgtaactctgataggtaggtaggtaggtaggtagrtagatagatagatagatagatagatagatagatagatagatagataaagatttataaatgaaagtgcatatgcaagtagaaaaaaaagtctaaagacatggcagtgttttctttcctccacaggtcattttataagttagatttgctctagaaattattactttgttttatgccatttggacatttatttatttaaccaacacttatgtgatcacaacatactcaggactgttctaagtaagcactttagaaatatgagcatatctaactcagggttttctttcccttcctttgtgattt

SEQ ID NO: 18490 - DNA, 601 bp, Human
gcagccaaggaaatcagctgattcatagcctcctaacgtggcccgcccagcgttacagggagagaggctagcccccttcagtctcggcttggcagaggcgcgcccaactgagactcccgtgcgcaggccagccttgaggcacgggacagggagcaggaatgtggatgttaaaggtttctgcctgaaaatgcagcagttcacgcacgcgcgcgcacacacacacacacacacacacacttccctacctctagtgtactgtgtcatagaagctcatcactctcaatgattcaaataattctayattattttacgatttgaaaggagctgctattttagctaattgtatattcttacggtaagtaaaaataaatttgaaaaagatcttcaaacaatgatctttttaaaactatcgtgttatcagattaaaatgaagtgtacttgtaaacactgcatttacagtgcccgttatatgccaagcactttgcctggactttatatgcatggtctgtgagaggcagtatggtgcagtggttaggcactctggctctgggctccaacaaacctaatcaccctgcttacttttgttgtgaatttgggcaat

SEQ ID NO: 18491 - DNA, 601 bp, Human
gcatcacattcaaagaaactctggaatgcactggaagaaataaacaaggatttctgatgactcccagagggtttgaattaagccgatggcaggaggctgggaactggggaaccacaggagtccaacactctcgggatgtccgccacagggactgttttgccagtgtgtcccagagtcaacgcctcttcagcaaggcgagaactgggccgcccttatccgctatccagacaccagcaccatcacccttgccctgtaaggtcttatagaccataaaggctctcctcgttgtattactccaagmcccattggagggaaacaggacacacaggggaccctgtgcccctaaacagaagccccagggagctggccaaagccccgcgcctgcgctgcgctttctggcaccctcactggaagatgcccacatttctcctccatctccttcactctccccaccaaatcacttacagcccaaaggaacagctgtcccgatcctcagggtggcctcaaacacaaactcgggtgcgttggctccgctgctggcgccgccaaagctgcgctgcggggctgcgcgcgcgcgaagcaagggggcagtgggaggctc

SEQ ID NO: 18492 - DNA, 601 bp, Human
taataacgtatttaaagagggaacttgaagacagtttaggcaggagattaaggagacctctcatgtgttttcatgtgttgtcatagccccatgtttggaaatgacaatatgtgacacaagagtgtcaaaatgaagacaccagaggatgacaacagtcaatcaaagcccagtagaatctaggaactggaagcaaggaaggtgagaatttgtcagtgtggcttcatcactacctattggtggaagacacatacctgataactactttgctagttcttagcacatcagggccattttctggagrcataatgtaatctacagaaacagctctcaagcctgacctttgctctacagatagcctcagtattcacctctgattatgtgtccagattgcagtttcattcctgttgatacgcctggcttgggtggggaccttccttccagatcctctaagttctctttcatatgcatctcattccagggagaaggggagagttctaagtcccaagttctaagacacatacaggtacacacccacacatacaagcacccaccctcactttatggaaagcatccagtggggagactcatgaacatcagtcat

SEQ ID NO: 18493 - DNA, 601 bp, Human
atgagaagtggttaatcatttacttccttttttcaggaaaggggaactctctgtcttctagacaaggtcaccaacatctaaccttgggctgtgtcttcccatacaaccctatttacgtcaaccttccaatgactgctcctggggacagagtggtgaaatggtaccatgggcattctgacaaccaactcagagaagagatgctacatcctttgccctctcagagggtcagaattgagaacatctcccagtacctagacatactctggtacatatgaagtttgtgatctatgaatttggaccrcagaatccaccactacatctagctcttacttctctccaatgccctgctggttcagtcaacagtaagtcaacagacagacatgtaagagctaatgtaagatgctaggcagaatgcaagatgtaagatgtaagatgtaagatgtaagcatgtaagatgctaggcagaatccagagacaaagttggaagatgtcaccctgtgtaacagaagtttctaggactctgcacactatgcatattaataacgtatttaaagagggaacttgaagacagtttaggcaggagattaaggagacctctcat

SEQ ID NO: 18494 - DNA, 601 bp, Human
cagtcagctccaagagccctagcacctttcatgtgcttttcctgaaagctgatgtgtgccatccataaagatcacagctgggcccaccaagaggaagctgtgcagagataatgcagccctcacagccacttccggagactacacagagattctagtggtttccacttaaaacgctccagtgcattggagaggcatttgccgggcatgcacgcttgtagatttcacatcccatgagtgtggagctactttcttctaccttctgtttgtcagttttagcttttctgactacttccttgatgttaagttgtcacttgccaggttttcccaaaacgtgggtttctcatctccaacaaccctaatctacttagctctctaattactaacttcttactagtctgtgagtcagaaaaccacatgacaaaattgacttagaactgtcacacgataagggaaccaggaactctccaaatagagttcctaactctttcagttctcagaattagtggaaagatcctgcagccatttccagtgcaacatcctagagatctgaggttccctggagaccaactctcagatgatcttgactgggattaacaacgga

SEQ ID NO: 18495 - DNA, 601 bp, Human
caagggagggcaggaaggggctgtgaggcctgttcctctgaaagcaagagacttctctgtgtttctgtgattgaagcccactccttttacattttcagtatccaaatgaccattgctgcctagaaagccacccatagcattgactctgatttgggcatggccagtgagacatccataatcatccgtccctaacaaaaatttctaaatgtggtatttgacttaagccacctttgaatcactctgaacaggatggcactgaacttttattaatccccccccaccaaattctttttttttttttcctagagaggcagggtctcactctgtcaccaggctggagcaagtgcaggggcctgatcatagttcactgtagtcttgacctctcagcctcaagcaatcctcctgcctcagcctcctgaatagctgggaccacaggcgtgctccaaggcaccccactaatttttaaatcattttttgtagagatggcatctcgctttgttgcccaggctggtcttgaactcctggctttaagcaatcctctcacctcagtctttcaaagtgttgggattacaggcattcgccaccacacctggcccaaatc

SEQ ID NO: 18496 - DNA, 601 bp, Human
tgcatctccaaagtgctaactcttgtctttaagaaatactgaagttgtctcttgggctctgtctgacttatctaatgaaggcagggctataaaaaaggaaacatgaccttggcagagagaaaggtgttaacagagtgctagcagggcaggacaacacttatcatcatgcaggcagggctcccaaatgggctgtctaaccagatctggcatgagaaatgcctcaggagctgagtggaccagctactccccgatttcactgactaagaggagataccagattccatccttgaacaagagggayagaaagaggcagtatagagaagtgcagcgactaactacacagcttaatgtgtatgactttcatcttagtagaatctcagaagtgaatgactctaagcttaaccgtgataagcagtaaacttagatatctacaaagccaaagagaggatacacactttatatgattgttgtcatgagactgatgttttagggaatatattattacaagattgtctgcatgtaaagcaatagatgtaccctgaaatagagaaaaggatgattctttggctgggttccctctgtctgcaacccaagacagtta

SEQ ID NO: 18497 - DNA, 601 bp, Human
tgacattttaccattattggagtcacgccatggtaaaaggattaagctccatgcagaccacaggggcctatggtccccctaacagagttgccacataccaggtgaagcaagcaatgcctatgggcactgccaaacagacaaagaaatgtgtggagagggaaaaagaaagtgaggaataaggatgcagccgacagtatgactgggaagccacgctgcagagggggaagatgatcaaaggcaagctccatttccctgggtgccccaaggttgcatttgaagcccaaagaaggctaaagggcaytggatatgcaggtgggtcaggccaccctccctggcccaccaatgcagcccttcggtgttggaaagagaagaaaagcctccatcttgggccctgtggagcagccacgctcaaactgatggccccagctcacgtgacagacagcgtccccccacaaggaggggtccagtgatgtcagcaccccagcctggagctgcacaaagcctggtctgtttcctccctgaaaacagggtctttgagaagctctgagtgactctattataaatccagtatgccgtgtgggattcatgcagttccagagtt

SEQ ID NO: 18498 - DNA, 601 bp, Human
gggagtgatgaaggctttatgatttactcattatagtaataatagcagcctagctaggtacaaaagcagttataaaccatttatattacacagaattattcaggtctccattctatcttatgttgtaaaattgttaattggatttccagtgagttgtttagatgattagtgataataaggaatggtaaatccatagcaccatttcaaagacttgttgtcactgatttctcatttagatgtgtgacgaagatactccacctgtaagggcaagtatgccaatgccacaagccgtgtttttgcragggctccagtttgggcattttgtccgtgtgcgcgtaaagcttcacacagaggttcgggcagcggctgtttctgttggatgcactgggtcacccaccagaaaagggcttttggacatttggggtttctacccacactttggttttctaaatgaggtggactgggagggaggtatcttctttcagatgaaagggaaggggcgagatggagttatcttatttctgggtaaaacaaaacaaacaaacaaaaaacaaaacaaaaatactgagctggattatactgttaggatgtaaagttcctt

SEQ ID NO: 18499 - DNA, 601 bp, Human
gggttgaactaaatgaatactcaagtgccttccagtccatttacagcctccatttcagctgcaattcccaactgtctccaattagcaaacctttgcacagacatcatgaaggcatcatgtgctccctgtagcttgtaaaacagctatgattttggtgccttagcaccatcttgtaacccaaatctccagctcaactttgctttccactgaagctcttcatcctgctccaacaggcaccttgtacccacacccaagttcccacaaaaactcaagagagaccagtgagttactctgatgtttrttttaatgcatcttagtccacacagttggtataaaatcagaaaatgcaaagcaaaaacaaaaggtctggagtcttagcatcagaagggcaccatatatacatctacagttggtggccaatacaagtcattgccagacagtccttggaggcacagaacagcctagacccagccaagctctaggaactcacggtcccaaggagtctagacgcttgttctgatgctccgaccgtaagaaaaatgtgggagtgatgaaggctttatgatttactcattatagtaataatagcagcctagctagg

SEQ ID NO: 18500 - DNA, 601 bp, Human
tgcggccttccctctagggttgtcaccctagctggacctggtaagcttgtgctggggaacgctaactccagcattaagcgctcgccgcctcggtcctgaggagggcagtgacgggtacggccgctcactcccagctcggcgctaacacggttaacctccagctcttacagctgccgtcgctccgcctctgccagttcaatgttttattggtgaacgtgatccggggccttccaagtcccgccaatccagatgtaggagaggtagggttaggcgcgtgccgcgagaacagagtggacggagmgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagt

SEQ ID NO: 18501 - DNA, 601 bp, Human
tggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgscggcggctacaggcggtgctgcagtgtctctccctcttgtcgccaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctga

SEQ ID NO: 18502 - DNA, 601 bp, Human
tgtaatgggaatgccttctgagtcaggcctctgcctgatctctagtgctcagtgagctgctccctgctgaggctgcccctctggctcgtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctaygaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagggatttggacatttggtgccatcttcagaagatccaggagtcctgggaatcgt

SEQ ID NO: 18503 - DNA, 601 bp, Human
tctgggcaaaaatgtccccatctgaaaaacagggacaacgttcctccctcagccagccactatggggctaaaatgagaccacatctgtcaagggttttgccctcacctccctccctgctggacggcatccttggtaggcagaggtgggcttcgggcagaacaagccgtgctgagctaggaccaggagtgctagtgccactgtttgtctatggagagggaggcctcagtgctgagggccaagcaaatatttgtggttatggattaactcgaactccaggctgtcatggcggcaggacggcgwacttgcagtatctccacgacccgcccctgtgagtccccctccaggcaggtctatgaggggtgtggagggagggctgcccccgggagaagagagctaggtggtgatgagggctgaatcctccagccagggtgctcaacaagcctgagcttggggtaaaaggacacaaggccctccacaggccaggcctggcagccacagtctcaggtccctttgccatgcgcctccctctttccaggccaagggtccccagggcccagggccattccaacagacagtttggagcccaggaccctccattct

SEQ ID NO: 18504 - DNA, 601 bp, Human
ccatctctctgagccctgggtgaggtgaggggcagatgggaatggcaggaatcaactgacaagtcccaggtaggccagctgccagagtgccacacaggggctgccagggcaggcatgcgtgatggcagggagccccgcgatgacctcctaaagctccctcctccacacggggatggtcacagagtcccctgggccttccctctccacccactcactccctcaactgtgaagaccccaggcccaggctaccgtccacactatccagcacagcctcccctactcaaatgcacactggcctcayggctgccctgccccaacccctttcctggtctccacagccaacgggaggaggccatgattcttggggaggtccgcaggacacatgggcccctaaagccacaccaggctgttggtttcatttgtgcctttatagagctgtttatctgcttgggacctgcacctccaccctttcccaaggtgccctcagctcaggcataccctcctctaggatgccttttcccccatcccttcttgctcacacccccaacttgatctctccctcctaactgtgccctgcacccaagacagacacttcacagag

SEQ ID NO: 18505 - DNA, 601 bp, Human
ggctgttggtttcatttgtgcctttatagagctgtttatctgcttgggacctgcacctccaccctttcccaaggtgccctcagctcaggcataccctcctctaggatgccttttcccccatcccttcttgctcacacccccaacttgatctctccctcctaactgtgccctgcacccaagacagacacttcacagagcccaggagacacctggggacccttcctgggtgataggtctgtctatcctccaggtgtccctgcccaaggggagaagcatggggaatacttggttgggggaggaraggaagactggggggatgtgtcaagatggggctgcacgtggtgtactggcagaagagtgagaggatttaacttggcagcctttacagcagcagccagggcttgagtacttatctctgggccagggactgtattggatgttttacatgacggtctcatccccatgtttttggatgagtaaattgaaccttagaaaggtaaagacactggctcaaggtcacacagagatcggggtggggttcacagggaggcctgtccatctcagagcaaggcttcgtcctccaactgccatctgcttcctg

SEQ ID NO: 18506 - DNA, 601 bp, Human
atctgcttgggacctgcacctccaccctttcccaaggtgccctcagctcaggcataccctcctctaggatgccttttcccccatcccttcttgctcacacccccaacttgatctctccctcctaactgtgccctgcacccaagacagacacttcacagagcccaggagacacctggggacccttcctgggtgataggtctgtctatcctccaggtgtccctgcccaaggggagaagcatggggaatacttggttgggggaggagaggaagactggggggatgtgtcaagatggggctgcaygtggtgtactggcagaagagtgagaggatttaacttggcagcctttacagcagcagccagggcttgagtacttatctctgggccagggactgtattggatgttttacatgacggtctcatccccatgtttttggatgagtaaattgaaccttagaaaggtaaagacactggctcaaggtcacacagagatcggggtggggttcacagggaggcctgtccatctcagagcaaggcttcgtcctccaactgccatctgcttcctggggaggaaaagagcagaggacccctgcgccaagccat

SEQ ID NO: 18507 - DNA, 601 bp, Human
gtaaggccaccatgggtccagaggatgaggctcaggggcgagctggtaaccagcaggggcctcgaggagcaggtggggactcaatgctgaggccctcttaggagttgtgggggtggctgagtggagcgattaggatgctggccctatgatgtcggccaggcacatgtgactgcaagaaacagaattcaggaagaagctccaggaaagagtgtggggtgaccctaggtggggactcccaccagccacagtgtaggtggttcagtccaccctccagccactgctgagcaccactgcctccccrtcccacctcacaaagaggggacctaaagaccaccctgcttccacccatgcctctgctgatcagggtgtgtgtgtgaccgaaactcacttctgtccacataaaatcgctcactctgtgcctcacatcaaagggagaaaatctgattgttcagggggtcggaagacagggtctgtgtcctatttgtctaagggtcagagtcctttggagcccccagagtcctgtggacgtggccctaggtagtagggtgagcttggtaacggggctggcttcctgagacaaggctcagacccgctctgtccc

SEQ ID NO: 18508 - DNA, 601 bp, Human
gacctaaagaccaccctgcttccacccatgcctctgctgatcagggtgtgtgtgtgaccgaaactcacttctgtccacataaaatcgctcactctgtgcctcacatcaaagggagaaaatctgattgttcagggggtcggaagacagggtctgtgtcctatttgtctaagggtcagagtcctttggagcccccagagtcctgtggacgtggccctaggtagtagggtgagcttggtaacggggctggcttcctgagacaaggctcagacccgctctgtccctggggatcgcttcagccacyaggacctgaaaattgtgcacggcctgggcccccttccaaggcatccagggatgctttccagtggaggctttcagggcaggagaccctctggcctgcaccctctcttgccctcagcctccacctccttgactggacccccatctggacctccatccccaccacctctttccccagtggcctccctggcagacgccacagtgactttctgcaggcacatatctgatcacatcaagtccccaccgtgctcccacctcacccatggtctctcagccccagcaggccttggctggcctctctgat

SEQ ID NO: 18509 - DNA, 601 bp, Human
ctctggccgctgaccccctaccccgccttgtgtcgcagacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctckctggacaacggcggctgcacgcattactgcctagaggaggtgggctggcggcgctgtagctgtgcgcctggctacaagctgggggacgacctcctgcagtgtcaccccgcaggtgagaagcccccaatacatcgcccaggaatcacgctgggtgcggggtgggcaggccccctgacggggcgcggcgcggggggctcaggagggtttctagggagggagcgaggaacagagttgagccttggggcagcggcagacgcgccccaacaccggggccactgttagcgcaatcagcccgggagc

SEQ ID NO: 18510 - DNA, 601 bp, Human
cctggctacaagctgggggacgacctcctgcagtgtcaccccgcaggtgagaagcccccaatacatcgcccaggaatcacgctgggtgcggggtgggcaggccccctgacggggcgcggcgcggggggctcaggagggtttctagggagggagcgaggaacagagttgagccttggggcagcggcagacgcgccccaacaccggggccactgttagcgcaatcagcccgggagctgggcgcgccctccgctttccctgcttcctttcttcctggcgtccccgccttcctccgggcgccccctgcgcacctggggccacctcctggagcgcaagcccagtggtggctccgctccccagtctgagcgtatctggggcgaggcgtgcagcgtcctcctccatgtagcctggctgcgtttttctctgacgttgtccggcgtgcatcgcatttccctctttacccccttgcttccttgaggagagaacagaatcccgattctgccttcttctatattttcctttttatgcattttaatcaaatttatatatgtatgaaactttaaaaatcagagttttacaacttttacatttcagcatgctgttc

SEQ ID NO: 18511 - DNA, 601 bp, Human
ccgccttcctccgggcgccccctgcgcacctggggccacctcctggagcgcaagcccagtggtggctccgctccccagtctgagcgtatctggggcgaggcgtgcagcgtcctcctccatgtagcctggctgcgtttttctctgacgttgtccggcgtgcatcgcatttccctctttacccccttgcttccttgaggagagaacagaatcccgattctgccttcttctatattttcctttttatgcattttaatcaaatttatatatgtatgaaactttaaaaatcagagttttacaactyttacatttcagcatgctgttccttggcatgggtccttttttcattcattttcattaaaaggtggacccttttaatgtggaaattcctatcttctgcctctagggacatttatcacttatttcttctacaatctcccctttacttcctctattttctctttctggacctcccattattcagacctctttcctctagttttattgtctcttctatttcccatctctttgactttgtgttttctttcagggaactttcttttttttctttttttttgagatggagtttcactcttgttgtccc

SEQ ID NO: 18512 - DNA, 601 bp, Human
attttaatcaaatttatatatgtatgaaactttaaaaatcagagttttacaacttttacatttcagcatgctgttccttggcatgggtccttttttcattcattttcattaaaaggtggacccttttaatgtggaaattcctatcttctgcctctagggacatttatcacttatttcttctacaatctcccctttacttcctctattttctctttctggacctcccattattcagacctctttcctctagttttattgtctcttctatttcccatctctttgactttgtgttttctttcarggaactttcttttttttctttttttttgagatggagtttcactcttgttgtcccaggctggagtgcaatgacgtgatctcagctcaccacaacctccgcctcctggattcaagcgattctcctgccgcagcctcccgagtagctgggattacaggcatgcgccaccacgcccagctaattttgtgtttttagtagagaaggggtttctccgtgttggtcaagctggtcttgaactcctgacctcaggtgatccacctgccttggcctcctaaagtgctgggattacaggcgtgagccacc

SEQ ID NO: 18513 - DNA, 601 bp, Human
tctttcagggaactttctacaactttataattcaattcttctgcagaaaaaaatttttggccaggctcagtagctcagaccaataattccagcactttgagaggctgaggtgggaggattgcttgagcttgggagtttgagactagcctgggcaacacagtgagaccctgtctctatttttaaaaaaagtaaaaaaagatctaaaaatttaactttttattttgaaataattagatatttccaggaagctgcaaagaaatgcctggtgggcctgttggcctgtgggtttcctgcaaggccktgggaaggccctgtcattggcagaaccccagatcgtgagggctttccttttaggctgctttctaagaggactcctccaagctcttggaggatggaagacgctcacccatggtgttcggcccctcagagcagggtggggcaggggagctggtgcctgtgcaggctgtggacatttgcatgactccctgtggtcagctaagagcaccactccttcctgaagcggggcctgaagtccctagtcagagcctctggttcaccttctgcaggcagggagaggggagtcaagtcagtgaggagggct

SEQ ID NO: 18514 - DNA, 601 bp, Human
aactctcaacatgccctcccacctgcactgccttcctggaagccccacagcctcctatggttccgtggtccagtccttcagcttctgggcgcccccatcacgggctgagatttttgctttccagtctgccaagtcagttactgtgtccatccatctgctgtcagcttctggaattgttgctgttgtgccctttccattcttttgttatgatgcagctcccctgctgacgacgtcccattgctcttttaagtctagatatctggactgggcattcaaggcccattttgagcagagtcgggcygacctttcagccctcagttctccatggagtatgcgctctcttcttggcagggaggcctcacaaacatgccatgcctattgtaggagctctccaagaatgctcacctccttctccctgtaattcctttcctctgtgaggagctcagcagcatcccattatgagaccttactaatcccagggatcacccccaacagccctggggtacaatgagcttttaagaagtttaaccacctatgtaaggagacacaggcagtgggcgatgctgcctggcctgactcttgccattgggtggtactgttt

SEQ ID NO: 18515 - DNA, 601 bp, Human
aacagtgcaggaacagcatgggcaaaggcaggaagacaccctgggacaggctgacactgtaaaatgggcaaaaatagaaaacgccagaaagggcctaagcctatgcccatatgaccagggaacccaggaaagtgcatatgaaacccaggtgccctggactggaggctgtcaggaggcagccctgtgatgtcatcatcccaccccattccaggtggtcctgctggactcaaagaagaagctggcctgcggggcagtgctcatccacccctcctgggtgctgacagcggcccactgcatggaygagtccaagaagctccttgtcaggcttggtatgggctggagccaggcagaagggggctgccagaggcctgggtagggggaccaggcaggctgttcaggtttgggggaccccgctccccaggtgcttaagcaagaggcttcttgagctccacagaaggtgtttggggggaagaggcctatgtgcccccaccctgcccacccatgtacacccagtattttgcagtagggggttctctggtgccctcttcgaatctgggcacaggtacctgcacacacatgtttgtgaggggctacacagacc

SEQ ID NO: 18516 - DNA, 601 bp, Human
gggcagtgctcatccacccctcctgggtgctgacagcggcccactgcatggatgagtccaagaagctccttgtcaggcttggtatgggctggagccaggcagaagggggctgccagaggcctgggtagggggaccaggcaggctgttcaggtttgggggaccccgctccccaggtgcttaagcaagaggcttcttgagctccacagaaggtgtttggggggaagaggcctatgtgcccccaccctgcccacccatgtacacccagtattttgcagtagggggttctctggtgccctcttcraatctgggcacaggtacctgcacacacatgtttgtgaggggctacacagaccttcacctctccactcccactcatgaggagcaggctgtgtgggcctcagcacccttgggtgcagagaccagcaaggcctggcctcagggctgtgcctcccacagactgacagggatggagctgtacagagggagccctagcatctgccaaagccacaagctgcttccctagcaggctgggggcacctatgcattggccccgatctatggcaatttctggagggggggtctggctcaactctttatgcca

SEQ ID NO: 18517 - DNA, 601 bp, Human
cgatctatggcaatttctggagggggggtctggctcaactctttatgccaaaaagaaggcaaagcatattgagaaaggccaaattcacatttcctacagcataatctatggccagtggccccccgtggggcttggcttagaattcccaggtgctcttcccagggaaccatcagtctggactgagaggaccttctctctcaggtgggacccggccctgtcctccctggcagtgccgtgttctgggggtcctcctctctgggtctcactgcccctggggtctctccagctacctttgctccaygttcctttgtggctctggtctgtgtctggggtttccaggggtctcgggcttccctgctgcccattccttctctggtctcacggctccgtgactcctgaaaaccaaccagcatcctacctctttgggattgacacctgttggccactccttctggcaggaaaagtcaccgttgatagggttccacggcatagacaggtggctccgcgccagtgcctgggacgtgtgggtgcacagtctccgggtgaaccttcttcaggccctctgcccaggcctgcaggggcacagcagtgggtgggcctc

SEQ ID NO: 18518 - DNA, 601 bp, Human
cccccgtggggcttggcttagaattcccaggtgctcttcccagggaaccatcagtctggactgagaggaccttctctctcaggtgggacccggccctgtcctccctggcagtgccgtgttctgggggtcctcctctctgggtctcactgcccctggggtctctccagctacctttgctccacgttcctttgtggctctggtctgtgtctggggtttccaggggtctcgggcttccctgctgcccattccttctctggtctcacggctccgtgactcctgaaaaccaaccagcatcctaccyctttgggattgacacctgttggccactccttctggcaggaaaagtcaccgttgatagggttccacggcatagacaggtggctccgcgccagtgcctgggacgtgtgggtgcacagtctccgggtgaaccttcttcaggccctctgcccaggcctgcaggggcacagcagtgggtgggcctcaggaaagtgccactggggagaggctccccgcagcccactctgactgtgccctctgccctgcaggagagtatgacctgcggcgctgggagaagtgggagctggacctggacatcaaggag

SEQ ID NO: 18519 - DNA, 601 bp, Human
taaaataactcaaatgaataaaagtggaatcagaataatcaattaaaattgcagttatcatggctagtgatggattacatgtagtttgttatatcagaaatattggcacttggaaatcttaatagagctttgaattagcagcatgtattgttgccctacactgtctagagcagaactctgacaatatctgttttcattttcactgggatttagctttagttaatacattcacatcagctttgtctgcctctccaagacttttttcatggctctcaaccaagacattgtcttccttttttckgggcctctggggaaccagcatctctgggagctagaggagctccaagggcaacaaaattgtgcacatcctgcagcttcttacgcagccattctactctctccatcgagttcagatgttttcccaggttatgcataagctgtatttcactcacagatctcttcctgggaagaagagaaacagagagggccacttcccattagctccccacttcgaaatgataaagtcaacattaaaaatccaattccaaggcaaaacagtacttacttaacagatttcccatccgattttgtaagaaaacaa

SEQ ID NO: 18520 - DNA, 601 bp, Human
tagtgaagatttggaaacctaatactttggtaatactaaaacgttgatgttcaaaatatccaaatgtgaaacacatgactaaaaaaatactttgtattgttctacctagtcatgatcaatgtaaacatgtgggtatcagtgataaccaaaaagatatacttgcaatgagtgagaaatacttcatttatttagacttatgatcattacatttttgttttacattttaaggtagaagagaggtttaaaagtgcaattttattcttttataaattatgcaataacatactttaaaaagaataamcaatagaaaagataattaaaataactcaaatgaataaaagtggaatcagaataatcaattaaaattgcagttatcatggctagtgatggattacatgtagtttgttatatcagaaatattggcacttggaaatcttaatagagctttgaattagcagcatgtattgttgccctacactgtctagagcagaactctgacaatatctgttttcattttcactgggatttagctttagttaatacattcacatcagctttgtctgcctctccaagacttttttcatggctctcaaccaagaca

SEQ ID NO: 18521 - DNA, 601 bp, Human
attttggatagagagaacgaagagtttggttggcctttttactttatcactgtggtttagtggagaggatctacagattggatggatggcagtgttgccgaggaagagagtattcactacagcacctgggattctggccttaagttatttggaacagaattggggccttcagagtgttattgtgaagttccagtgcctgaagtgtatggctttagaaggtaaagaccataccatgatgatgataataaaaattaataacaatagttacgttctaggccttgtgttacatgctttgaatgcrttatctacttactctccatgagaaccctagaggtagttactgtttttagacctagtttaaagataagaaaattgaggcttagaggtgaagtgtgcccaaggttacacagctttgtcagtggtagagttgggatttgatcctggatttgaatgattcctgaccctgtggccttaactgtgatgctatactgtcaggcctgcaatttatcttctttcttgctttgctacagacttaaaggtttcagcctaatttttcctctttgaaagcatccattgctcctgcatcttttatgattgattc

SEQ ID NO: 18522 - DNA, 601 bp, Human
attctccatcttgtgtttgctcagatctagagataaaacacatcgtcagggttcttaaatttagacagcttcggttgacatggtatgtgaggttcatatgataatcgtgagagataaacctgcactttcatgggaaaagccatggatagcagtagcagaagataattggcaacagatcttttctggatgttggaggagaggctttggaataacagtctcattgtgatgttttctgcttttgttataggtttgccatgagcagactaatgataatagctaacatttgttactgtattcattrgttttcaccgcagcccctactgttatctctgctttaaagataaggacatggaaacttaagaaggttgagtaactagtctgaagatgcacagtgaataagtgatggagttaggatttaaatgtgggtagactgaccctacaacttgtattcttctccacagtgctgctatttagcagacacagaaactttcatgagtaagagtagcaagttctgagtttttgacttttgagcttggggaagatgtgcctagaaggaatgagtaaacaacgagaaattatatgaggtgcacattttgagtgg

SEQ ID NO: 18523 - DNA, 601 bp, Human
tgaatatgggcatctctttccctttccttgatcccacactgaatgaacctgtgtgatttccccacttctctgctccttgcagaccccttgtctgtgtcccctgcccgctgggctgaggaatatttggagcaatcagaggagaagctgtggctgggagaacctgagggaacagccaccgatcgctggtgagttcagatacctctttccgaatcccgtgaaaggagtatggacagttttcccagcctcctccatccacgttctcgaaccaacttactttattctttttttttttttttttttwatcattcttgggtgtttctcgcagagggggatttggcagggtcataggacaatagtggagggaaggtcagcacataagcaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtgaacacagcacatgtttcagagagcacagggttgggggtaaggt

SEQ ID NO: 18524 - DNA, 601 bp, Human
gacttcaaggagggtagataatatggatgagaggaaacttagagaatcctgtggttgcaagatggtggcattgagttgttgtattatctaatgaagacacctgaagagcattcgcatcacttctggctgtcatatacaggccatcatatcttaaggaagtatccagagcagtgaggataatagctatttacagatagtatcttaagctttttggtaaggcgttggtgaagattcccatttgatgttctcaatggctctgagaggcaggaattacttttattaggaaactgcattatagatracagtaatctctgttttctgtagagtggcttaaaacacgtattaatgatgaacaatagttgaggttgaatgcagaaggatttattttattgaactgtaatagtctagggcaagggccagcaaactggcttgtgggataaatctttatgtttttagtgatccactagctgaggatggttttaacatttttaaatggttggagaaaatcaaaagagtaatactttgtgacaagtgaaaattatataaaattcaaattttagtgtccataaataaaatgttattggaagacagccgtgctcat

SEQ ID NO: 18525 - DNA, 601 bp, Human
ttagagaatcctgtggttgcaagatggtggcattgagttgttgtattatctaatgaagacacctgaagagcattcgcatcacttctggctgtcatatacaggccatcatatcttaaggaagtatccagagcagtgaggataatagctatttacagatagtatcttaagctttttggtaaggcgttggtgaagattcccatttgatgttctcaatggctctgagaggcaggaattacttttattaggaaactgcattatagatgacagtaatctctgttttctgtagagtggcttaaaacaygtattaatgatgaacaatagttgaggttgaatgcagaaggatttattttattgaactgtaatagtctagggcaagggccagcaaactggcttgtgggataaatctttatgtttttagtgatccactagctgaggatggttttaacatttttaaatggttggagaaaatcaaaagagtaatactttgtgacaagtgaaaattatataaaattcaaattttagtgtccataaataaaatgttattggaagacagccgtgctcatttgtttacttatgtctggctgctttcgcactacaacag

SEQ ID NO: 18526 - DNA, 601 bp, Human
atgttctcaatggctctgagaggcaggaattacttttattaggaaactgcattatagatgacagtaatctctgttttctgtagagtggcttaaaacacgtattaatgatgaacaatagttgaggttgaatgcagaaggatttattttattgaactgtaatagtctagggcaagggccagcaaactggcttgtgggataaatctttatgtttttagtgatccactagctgaggatggttttaacatttttaaatggttggagaaaatcaaaagagtaatactttgtgacaagtgaaaattayataaaattcaaattttagtgtccataaataaaatgttattggaagacagccgtgctcatttgtttacttatgtctggctgctttcgcactacaacagtagaggtgagtagttgcagcagatccacgaagcctgaaatatttattatctggcccttcgcagaaaaagtttgctgatcactggactagcgtcattttctgccttctgagtttttatattatgcagagatgtccaaaaacacacttgttttcaatataaatatactttctatacatttatctcaaatctactatgtctttctt

SEQ ID NO: 18527 - DNA, 601 bp, Human
tcatcacattattgaaggataacaagaaatgcactttgcatagctagggacactttgtctcattactataagcagatcctgttgagacattctgccccgtggtgagaagtcaaggtgtgggaatacaagcctgtgatgacttcctaaaataagcttatttccagcgcagatgaatttgtagactttcctagcttcccaggtatcatgaacaggagatgggagcacaaacctgataccaaatgattttacttgtgtcatacatgatctttataatatggagaatttgccagcaattaattcmggaacctgtttggaggccctcagcttctctgcctgctggttgtcatcctcacatccctgctgttctgacggtgccacctctcagtccatctctcacgtgcttttcttgtaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagtgagtgactccatagtctcatttctggctagagactgcttcctc

SEQ ID NO: 18528 - DNA, 601 bp, Human
acattctgccccgtggtgagaagtcaaggtgtgggaatacaagcctgtgatgacttcctaaaataagcttatttccagcgcagatgaatttgtagactttcctagcttcccaggtatcatgaacaggagatgggagcacaaacctgataccaaatgattttacttgtgtcatacatgatctttataatatggagaatttgccagcaattaattcaggaacctgtttggaggccctcagcttctctgcctgctggttgtcatcctcacatccctgctgttctgacggtgccacctctcagtscatctctcacgtgcttttcttgtaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagtgagtgactccatagtctcatttctggctagagactgcttcctccatcttgagaaaggccccaaggagagtagtgcagatgggttagggcctgggtgatggcctaggataggggcttgagagcgagatgg

SEQ ID NO: 18529 - DNA, 601 bp, Human
gaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtargggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcc

SEQ ID NO: 18530 - DNA, 601 bp, Human
tggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctstattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatgggga

SEQ ID NO: 18531 - DNA, 601 bp, Human
gtctcatgactagtaaccgggactgggctgtctcattctagagccttccttctacactctctctccgtcctctcacccctgctcccgttcctcccctttggaattctctcccgagtcacgccggactttttgggtctggcggaggcccacggagcacctccttgcacagcaaaggcccagcgccctgggactggcgtgcgcacgcactcggaaacaggaatagacgcgtagacctgtgcgcgcacgtgcaagcaacacgagtcagggggtgcacaggggcccccaccttcctctagactgccccccgccgggttccacacgaaagcccccggccacccccgcggagacccagcagccccagcccgcagcattacccagttgcgggcccgaaaagcctgcacgcatcgagaacccagagcgcccctgccgccgtacaccagcacccggcgcgcctcgcctgcagccgccgccgccgccatcctgctcctgccagcccggctcccgcagctccgaatgcctcgagccggagcgccgcgccccgccccggccggccaaccccgccaagagggaacgcgcggcggccgcgccccgctccgcgccc

SEQ ID NO: 18532 - DNA, 601 bp, Human
gactttaggattggaaatcagacagatcaggtttgaatcccagctctgccagagtggctttctcactccgatgccgggcagaggttcccaacaaaagaggttgtttgttgatgattaacagggtcagtgtaagaattaaatgaaatggaagatgctaaagctcctggcacaggggatgttcagtccttactcagggtctcttggtctgaagtccccagagataattatctctaccttaagctgtaaacacagcatctattcatcaacatttgttatattattaattaacttgttatcccaygggggatactgaaacaatgaaaagtctccatcatcctagccctccctaagatggcaggaagaagctcggaggggaaagaccaagagccagaggtaaatcagctctccagattctgccaagaccaaggtaaaccaaagtgccaccaccaggagaaagcacagccttcaccctctaacacatgacgctaacaggatctactgccttaaagatattgggggcattaagagtctatgggaactctggtactgggaacacagtgcctggcccttggcagaagtgctgcctctgtcaccaccatgc

SEQ ID NO: 18533 - DNA, 601 bp, Human
gctgtgttccaataaatcttcagagctgaaatgtgaatttcattaattttcatatacaacaaaatataattcttcatttgattttcttttcaaccacctgaaaatgtaaaactattcttaactcttgggctgtacaaaaacaggtggcagaccagattcagctcacaaaggatccctgtcctgcagcagagagggatggactttaggattggaaatcagacagatcaggtttgaatcccagctctgccagagtggctttctcactccgatgccgggcagaggttcccaacaaaagaggttktttgttgatgattaacagggtcagtgtaagaattaaatgaaatggaagatgctaaagctcctggcacaggggatgttcagtccttactcagggtctcttggtctgaagtccccagagataattatctctaccttaagctgtaaacacagcatctattcatcaacatttgttatattattaattaacttgttatcccatgggggatactgaaacaatgaaaagtctccatcatcctagccctccctaagatggcaggaagaagctcggaggggaaagaccaagagccagaggtaaatcagc

SEQ ID NO: 18534 - DNA, 601 bp, Human
caataaatagggggaaaaaataagtgcagctgtgttccaataaatcttcagagctgaaatgtgaatttcattaattttcatatacaacaaaatataattcttcatttgattttcttttcaaccacctgaaaatgtaaaactattcttaactcttgggctgtacaaaaacaggtggcagaccagattcagctcacaaaggatccctgtcctgcagcagagagggatggactttaggattggaaatcagacagatcaggtttgaatcccagctctgccagagtggctttctcactccgatgcygggcagaggttcccaacaaaagaggttgtttgttgatgattaacagggtcagtgtaagaattaaatgaaatggaagatgctaaagctcctggcacaggggatgttcagtccttactcagggtctcttggtctgaagtccccagagataattatctctaccttaagctgtaaacacagcatctattcatcaacatttgttatattattaattaacttgttatcccatgggggatactgaaacaatgaaaagtctccatcatcctagccctccctaagatggcaggaagaagctcggagggg

SEQ ID NO: 18535 - DNA, 601 bp, Human
acatcaagggccagcaaattttctgtaaagggccagatcacaattaccttaggctttgctggccatatggtatctgttgttactcaaatctgcaattgtaacagaacacagcaataaatagggggaaaaaataagtgcagctgtgttccaataaatcttcagagctgaaatgtgaatttcattaattttcatatacaacaaaatataattcttcatttgattttcttttcaaccacctgaaaatgtaaaactattcttaactcttgggctgtacaaaaacaggtggcagaccagattcagytcacaaaggatccctgtcctgcagcagagagggatggactttaggattggaaatcagacagatcaggtttgaatcccagctctgccagagtggctttctcactccgatgccgggcagaggttcccaacaaaagaggttgtttgttgatgattaacagggtcagtgtaagaattaaatgaaatggaagatgctaaagctcctggcacaggggatgttcagtccttactcagggtctcttggtctgaagtccccagagataattatctctaccttaagctgtaaacacagcatctattcatc

SEQ ID NO: 18536 - DNA, 601 bp, Human
catttaaataaaagaaaaagaaaaagaaagaaaaataaaggagcagagtggagacaggtaagaggcttcaatgaaaacacaccctatattgggctccatcccaggccctcctacctccaaacactctactccgcctccacattcacctctaaaacacaaaccctgcacttctagagacatcaagggccagcaaattttctgtaaagggccagatcacaattaccttaggctttgctggccatatggtatctgttgttactcaaatctgcaattgtaacagaacacagcaataaataggggraaaaaataagtgcagctgtgttccaataaatcttcagagctgaaatgtgaatttcattaattttcatatacaacaaaatataattcttcatttgattttcttttcaaccacctgaaaatgtaaaactattcttaactcttgggctgtacaaaaacaggtggcagaccagattcagctcacaaaggatccctgtcctgcagcagagagggatggactttaggattggaaatcagacagatcaggtttgaatcccagctctgccagagtggctttctcactccgatgccgggcagaggttcc

SEQ ID NO: 18537 - DNA, 601 bp, Human
ctgtactccgggctaggcaacagaaggaggccttatctccatttaaataaaagaaaaagaaaaagaaagaaaaataaaggagcagagtggagacaggtaagaggcttcaatgaaaacacaccctatattgggctccatcccaggccctcctacctccaaacactctactccgcctccacattcacctctaaaacacaaaccctgcacttctagagacatcaagggccagcaaattttctgtaaagggccagatcacaattaccttaggctttgctggccatatggtatctgttgttactcwaatctgcaattgtaacagaacacagcaataaatagggggaaaaaataagtgcagctgtgttccaataaatcttcagagctgaaatgtgaatttcattaattttcatatacaacaaaatataattcttcatttgattttcttttcaaccacctgaaaatgtaaaactattcttaactcttgggctgtacaaaaacaggtggcagaccagattcagctcacaaaggatccctgtcctgcagcagagagggatggactttaggattggaaatcagacagatcaggtttgaatcccagctctgc

SEQ ID NO: 18538 - DNA, 601 bp, Human
tgtatcatttttcactttttccaaattttcctcaatgaacacaaatggctttcctagttagagaaacaacagctttaaaaaaaaggaagaacaggccaggcgcggtggctcatgcctgtaatccgagcactttgggaggctaaggcgggcggatcacaaggtcaggagttcaagatcagcctggccaacatggtgaaaccccgtctctactgaaaatacaaaaaattagctgggggtggtggcaggcacctgtaatcccagctactcaggaggctgaggcaggagaattgcttcaacccargaggcaaaggttgcagtgaacggagatcatgccactgcactccagcctgggcgacagagcaagactccgtctcggggaaaaaaagaaataaaaggaagaacatacagccaaaggaagaacatacagccagtggtcacctctccccagggttcccctcacaatgtttgggggcctttttgaaactacctggtcagcctgctcagtgaacgagtctgtcattttaacaatgatgctagcgctggcctcttcattctccaccacatcaacgctggcaacccactggaaggagaaaacagcttt

SEQ ID NO: 18539 - DNA, 601 bp, Human
gagactgaggcacaagaattgtttgaatccgggaggcagaggtggcagtgagctgagattgtgccactgcactccagtgtcaacagtagagcaagactctcttaaaacaaaaaacaataataatcagatatgtagacaaagacgttcatcacaacattcttgacaatagtaaaacaaaaatcctgcaaaaaactcaaatgtacaataaacaaactaaataaattgtggccattccataaaatggaatatcacacatctacaaagaggttttttcagtaatctggagaattatttaagtataaaaaaaaaaaaaaacaaagcttaccataaactataaaatacaaaattacctaaacttgtaaaaggagtaacatacaatatgcatagaaaaagacaagaaaataggccaaaatgttaacagtgaactaactcaaaatgattatataatttatctttgtatcatttttcactttttccaaattttcctcaatgaacacaaatggctttcctagttagagaaacaacagctttaaaaaaaaggaagaacaggccaggcgcggtggctcatgcctgtaatccgagcactttgggaggctaaggc

SEQ ID NO: 18540 - DNA, 601 bp, Human
cctgtaatcccagctactcaggagactgaggcacaagaattgtttgaatccgggaggcagaggtggcagtgagctgagattgtgccactgcactccagtgtcaacagtagagcaagactctcttaaaacaaaaaacaataataatcagatatgtagacaaagacgttcatcacaacattcttgacaatagtaaaacaaaaatcctgcaaaaaactcaaatgtacaataaacaaactaaataaattgtggccattccataaaatggaatatcacacatctacaaagaggttttttcagtaayctggagaattatttaagtataaaaaaaaaaaaaaacaaagcttaccataaactataaaatacaaaattacctaaacttgtaaaaggagtaacatacaatatgcatagaaaaagacaagaaaataggccaaaatgttaacagtgaactaactcaaaatgattatataatttatctttgtatcatttttcactttttccaaattttcctcaatgaacacaaatggctttcctagttagagaaacaacagctttaaaaaaaaggaagaacaggccaggcgcggtggctcatgcctgtaatccg

SEQ ID NO: 18541 - DNA, 601 bp, Human
gcctgccacactgagtggttgggaaaataaggcgcttcacatagtgatgtgaagttatccttgggaatgtgggctacagcactaaaaaccattaaacacagagtcagctgcgcacagtggctactcaggaagtcccagctattcgggagaatgaagcagaaggatcctttgagcccaggagttccagtccagcctgggcaacacagtgagaacctgactcaaaagtcatccaggcagctcaccagaagggcttctcaagaaagttaagcactgcttaagagcatcaaagatttttctttcttttttttttttttgttttgagacagagtctcactctgtcacccaggatggagtgcagtggcacaatcttggctcactgcaacctctgcctcccaggttcaagtgattctcctgcctcagcctcccgagtagctgggactacaggcgtgcaccaccacgctcagctaatttttgtatttttagtagagacggggtttcaccatgttggccaggatggtcttgatctcctgacctcgtgatccgcccatctcagccttccaaagtgctgggattacaggtgtcagccactgcacccagccta

SEQ ID NO: 18542 - DNA, 601 bp, Human
caaaatgtatagatttatacatgtatattttggagagacagactggaaggaaatataaataaatgattaactatatggtagaactataaatgatttcccttttctttttgcttatttgtattttctatatcatacatgcatcacttctaaaattttaaaaatttgttataaaaaccagataaggatcataaaacatcagtattgagattaccaaggaaagtgcaactaaatgaaaagcagacccacgtacagaccaagtggcacctgaacttattaaagttcgtatctggagacctatgakcctgactccaccactgagtagcttgttggccttgtcacttagtcgcgcaaacttgtcttcacagctgtaaaatggcctgcctgcctgccacactgagtggttgggaaaataaggcgcttcacatagtgatgtgaagttatccttgggaatgtgggctacagcactaaaaaccattaaacacagagtcagctgcgcacagtggctactcaggaagtcccagctattcgggagaatgaagcagaaggatcctttgagcccaggagttccagtccagcctgggcaacacagtgagaacctgac

SEQ ID NO: 18543 - DNA, 601 bp, Human
tatgttcaaaatgtatagatttatacatgtatattttggagagacagactggaaggaaatataaataaatgattaactatatggtagaactataaatgatttcccttttctttttgcttatttgtattttctatatcatacatgcatcacttctaaaattttaaaaatttgttataaaaaccagataaggatcataaaacatcagtattgagattaccaaggaaagtgcaactaaatgaaaagcagacccacgtacagaccaagtggcacctgaacttattaaagttcgtatctggagacytatgatcctgactccaccactgagtagcttgttggccttgtcacttagtcgcgcaaacttgtcttcacagctgtaaaatggcctgcctgcctgccacactgagtggttgggaaaataaggcgcttcacatagtgatgtgaagttatccttgggaatgtgggctacagcactaaaaaccattaaacacagagtcagctgcgcacagtggctactcaggaagtcccagctattcgggagaatgaagcagaaggatcctttgagcccaggagttccagtccagcctgggcaacacagtgagaa

SEQ ID NO: 18544 - DNA, 601 bp, Human
gtcatctggcttttacattccaatctatgtcaaactgacactttagaaagagcaaatgagtagcagagttgtgctcacagttttatgttcaaaatgtatagatttatacatgtatattttggagagacagactggaaggaaatataaataaatgattaactatatggtagaactataaatgatttcccttttctttttgcttatttgtattttctatatcatacatgcatcacttctaaaattttaaaaatttgttataaaaaccagataaggatcataaaacatcagtattgagattacyaaggaaagtgcaactaaatgaaaagcagacccacgtacagaccaagtggcacctgaacttattaaagttcgtatctggagacctatgatcctgactccaccactgagtagcttgttggccttgtcacttagtcgcgcaaacttgtcttcacagctgtaaaatggcctgcctgcctgccacactgagtggttgggaaaataaggcgcttcacatagtgatgtgaagttatccttgggaatgtgggctacagcactaaaaaccattaaacacagagtcagctgcgcacagtggctactcagg

SEQ ID NO: 18545 - DNA, 601 bp, Human
attagaagctttgtttggggatgtaatgaagactacacgtgttaatgaaaataaagcactgagaatggtgcctggcaactaacaatgatgccatgtcaactttcactattaaattcactaaggtcaatctgtatgacttaggtatgggaacattgagaccacagtgagaaaaataagaacaacaaaaatgaagtgctaaaataagtcatctggcttttacattccaatctatgtcaaactgacactttagaaagagcaaatgagtagcagagttgtgctcacagttttatgttcaaaatgyatagatttatacatgtatattttggagagacagactggaaggaaatataaataaatgattaactatatggtagaactataaatgatttcccttttctttttgcttatttgtattttctatatcatacatgcatcacttctaaaattttaaaaatttgttataaaaaccagataaggatcataaaacatcagtattgagattaccaaggaaagtgcaactaaatgaaaagcagacccacgtacagaccaagtggcacctgaacttattaaagttcgtatctggagacctatgatcctgact

SEQ ID NO: 18546 - DNA, 601 bp, Human
gtgatcctcctgcctcggcctcctgaagtgctgggactactggcatgagccactgcacccagccattttggcctttattactttattcacatgaaactattttgctttaaggcagcttagcatagcagttaagagaacagccgtcagacccccactgcccatgtccaaatagtggctatgcaaccttttatctgtttgaccttggacaaataccagggcctttctgtgcctcagttacccccatttaaaaggaggataaaattagaagctttgtttggggatgtaatgaagactacacgtrttaatgaaaataaagcactgagaatggtgcctggcaactaacaatgatgccatgtcaactttcactattaaattcactaaggtcaatctgtatgacttaggtatgggaacattgagaccacagtgagaaaaataagaacaacaaaaatgaagtgctaaaataagtcatctggcttttacattccaatctatgtcaaactgacactttagaaagagcaaatgagtagcagagttgtgctcacagttttatgttcaaaatgtatagatttatacatgtatattttggagagacagactggaa

SEQ ID NO: 18547 - DNA, 601 bp, Human
ccaacacaggctagcatctttacggatactcagtttctttttctcttctttttaagccagtttacagtacctggcaattaatgctttgagaattagacggaagactaagctctgatgagcattttagacattgaagcccaagtacacttcagtgtgatttttaaaaaacaatctagagtctctgtgtatacattctgaaaggtagagacatgagcatcccttgaaatacaacaattaataaataaaagtagggaaaggttaaaaaaaaaagaaaaaagcacctagagcttcactgcctgcmcatagttaacatcctggtgtatttctttccagactctcttcacaaatcacagaattataatccaaaaagaagatcaaccctgttttccccaccccaatccaaaaatccctttaactgcaactctgaaaaaaatgccaacgaaaaattgtaagaaaaatcatgagccaagaaaaaatacagtcaatagcaatatgttggtaatattaagtacatgggggttcactttaatgatctctctgcttctgtttgtttgagattttaaagcattgaaaatatatgtatgccctcttgttataattt

SEQ ID NO: 18548 - DNA, 601 bp, Human
accttctcttcacccaagagctttccaacctcagcagtcaccttcaacacaagaacaaaaaaatgtataaactgtaaggtaagccaacacaggctagcatctttacggatactcagtttctttttctcttctttttaagccagtttacagtacctggcaattaatgctttgagaattagacggaagactaagctctgatgagcattttagacattgaagcccaagtacacttcagtgtgatttttaaaaaacaatctagagtctctgtgtatacattctgaaaggtagagacatgagcatcccttgaaatacaacaattaataaataaaagtagggaaaggttaaaaaaaaaagaaaaaagcacctagagcttcactgcctgcacatagttaacatcctggtgtatttctttccagactctcttcacaaatcacagaattataatccaaaaagaagatcaaccctgttttccccaccccaatccaaaaatccctttaactgcaactctgaaaaaaatgccaacgaaaaattgtaagaaaaatcatgagccaagaaaaaatacagtcaatagcaatatgttggtaatattaagtacatgggg

SEQ ID NO: 18549 - DNA, 601 bp, Human
actctctccccgagcaactgtaaagattccgggatatacacaaaaaaacagctggcctgtcacctagtgcaaacccaatccttgtcagctggaaaaagagcagagcagaacaaatgagtgactcaggaaaggactcacacttggatttggcattgcccccggcccatcctccagcaacgcaaagaattgcatccaccttctcttcacccaagagctttccaacctcagcagtcaccttcaacacaagaacaaaaaaatgtataaactgtaaggtaagccaacacaggctagcatctttacrgatactcagtttctttttctcttctttttaagccagtttacagtacctggcaattaatgctttgagaattagacggaagactaagctctgatgagcattttagacattgaagcccaagtacacttcagtgtgatttttaaaaaacaatctagagtctctgtgtatacattctgaaaggtagagacatgagcatcccttgaaatacaacaattaataaataaaagtagggaaaggttaaaaaaaaaagaaaaaagcacctagagcttcactgcctgcacatagttaacatcctggtgtatt

SEQ ID NO: 18550 - DNA, 601 bp, Human
gcacaggccatgctgatttcattctgcctctactttaaactcaaactcaatgccccccgtcccctcacgtcctccaggggaagcttcttctttatccgtaaaatggattaagagcattaatcactctctccccgagcaactgtaaagattccgggatatacacaaaaaaacagctggcctgtcacctagtgcaaacccaatccttgtcagctggaaaaagagcagagcagaacaaatgagtgactcaggaaaggactcacacttggatttggcattgcccccggcccatcctccagcaacrcaaagaattgcatccaccttctcttcacccaagagctttccaacctcagcagtcaccttcaacacaagaacaaaaaaatgtataaactgtaaggtaagccaacacaggctagcatctttacggatactcagtttctttttctcttctttttaagccagtttacagtacctggcaattaatgctttgagaattagacggaagactaagctctgatgagcattttagacattgaagcccaagtacacttcagtgtgatttttaaaaaacaatctagagtctctgtgtatacattctgaaagg

SEQ ID NO: 18551 - DNA, 601 bp, Human
ctttaacagtcctcatcccatgaaagtgcccagcagccccagcaagcaaggtaagcaaccccactccacagatagggaaataaaggcttaccaggagtcccatccagggcagcctttgcgccagccaaggtcaggaggcctccttccttgagatgcttggtagccagatggctggagatggtcgatgtccatatgctctgcttccacatcaggtcacagttcttaaagagagctgagtgaaaaaaacatgtgggctcagcattcccaggaaagaaaccaaaaggtgagctcaactcatgcrgccccacactcagggaggccctccctcctggtccccaggtccctatctacagcaaggtctaacacaaacagcacagggctcagtggtcagagacacaggttcaaatccaggccatgggattgcctgaggttcagcttccttacctatacactggcaaaatgttggccaataaattttacaaaataaacctggagtttactgatttgctggactggctttaattcaaagattgttttattttatgaatggtatcagatttgtaataagaacctatatgtctacgtcaggttttctctgtga

SEQ ID NO: 18552 - DNA, 601 bp, Human
ccaccaccataaacataaggacaggcaaacaaaagatcagaactcttctccctaaaatgattcaggcccaaaagaagacaaaatccatctatctgttaagcagcttagagggtaaaggctttaacagtcctcatcccatgaaagtgcccagcagccccagcaagcaaggtaagcaaccccactccacagatagggaaataaaggcttaccaggagtcccatccagggcagcctttgcgccagccaaggtcaggaggcctccttccttgagatgcttggtagccagatggctggagatggtygatgtccatatgctctgcttccacatcaggtcacagttcttaaagagagctgagtgaaaaaaacatgtgggctcagcattcccaggaaagaaaccaaaaggtgagctcaactcatgcagccccacactcagggaggccctccctcctggtccccaggtccctatctacagcaaggtctaacacaaacagcacagggctcagtggtcagagacacaggttcaaatccaggccatgggattgcctgaggttcagcttccttacctatacactggcaaaatgttggccaataaattttacaaa

SEQ ID NO: 18553 - DNA, 601 bp, Human
tgagaaaataaatctctgttgtttaggccacccagtctgtggctacccaaacaaactaatacaggtcataaaaaatgcaaaagaaatgacataatggaaaaaatacacagttggtagatgattagggttttggttcaagtaagtctgcaacttacttcctgcacaaacccagacaagttacttaactctccaagttttagtttcctaacctgtaaactgaaaaagataatattgatgagattaaagtgagaatatatgtgaaatgaaaagagtgactataagacctaccatttattgtgartaacagtaagacttgccatttatgggtgcctaccatgtgcactttctacatagctacacctctacagttttacagtactcttcaagttagatgtcactgtcactattttacaattaaggaaactacagtagacatctggtcagagactgaagaactggttcagggtcacacatctaggataaagaatccacccccaaccctctcactctctttttgttttctaatgtagagatagggtctcactatgttgcccaggctggtcttgaactcctgggctcaagcaatcctcctgcttcagcc

SEQ ID NO: 18554 - DNA, 601 bp, Human
ctttctgcctccctatgctgcccctttctacccctgcttaaattcctttagccctatcccacagggagtgttatgggctgaaatagatccccccaacattcgtatattgaagtcctaattcccagtacctcagaatgggactgtattcgaagatctttaaagaggcaacaaagttaaaatgagcccattgagatgggccctagtccaatatgcctggtttccttagaagaggaggaaacgaggacagacacacagagggaagaccacatgcagacaaaaggagaaggcagccatctataaraaaagaggattcagaaggagccagccctgcagataccttgatctccagacttttagcctccagagttatgagaaaataaatctctgttgtttaggccacccagtctgtggctacccaaacaaactaatacaggtcataaaaaatgcaaaagaaatgacataatggaaaaaatacacagttggtagatgattagggttttggttcaagtaagtctgcaacttacttcctgcacaaacccagacaagttacttaactctccaagttttagtttcctaacctgtaaactgaaaaagataatat

SEQ ID NO: 18555 - DNA, 601 bp, Human
ggttaaagatgaacaaattcattaacatctgaggcagaacagctgggcagaaataagcctggagtaaataataataatggctcacacttactattgactctctgtaatacctttctcatccatttagatccattgagacatttacaaggtacaaccaccatatatataaaggagacactattttatcttattttacagatgacaaaacgcagactcagaaaggcgaagtaacttgccgaacgtgtcacagtaagtggcagagccttaagagaagtccaacgtgcacagttccagagcctgmagtcttaaccactacccaaaatgtaatcaaaggatacctgcaaaccaaaggaaagtaggagactcttctgtcatttagaaaaatcagtcttttggtcctagggttttgttttttaaaatgtcaagctaagactcatttctctgtttactttctactgcctctgttccgtgtcatcttaaataaaaatcagatctcaaccaaccagacagctaacatttacacagctttaatgattgctatagccatggacttgtaacatcacatgctctaagaaatggaagaagaaaatgagagggaagg

SEQ ID NO: 18556 - DNA, 601 bp, Human
gaatataattatattatctctatataattatattatcagtaattgctataattactgattataattatatattaattactgatcaatgtattactcagaccaatctgctactaactagctaggttgtcttagacaaggcacctaaaatcactgaactttttttcctccataatcaagggaaaataataggacctactttacagatacctctggtgatgaaataagatcaagcttagcccaacaagccaagcacccagaagacagatgcctaaaaatatttctttctttttcgccaagtctsttgaggtataactgaaacacaataaacttaaacacatttagggtgtaccatttgagcaaattttgacattgtgtatacctgctacctattggtcttcctttcctcccactattcgatggatatttgctgacagaagcaagggatgtcttttattaaggtaggtttccctctgccccgcaggcatgtggcaggaatggagtctttcctctttatgttcccccactgtgcccaactgtagctgctcactaaatgctgctatcacagaataatgatagcaagaaggaatgatgagtcactgta

SEQ ID NO: 18557 - DNA, 601 bp, Human
ttctcagtaactcgtgagtttctcaatattccagacaaactaacttttaaattatttaatctatgatgaagtgaaaagaataaggcatggaaaagcctctatcgagtcatcaaattatggtgcttttctttttttttttttgagacaagcttactctgttgcccaggctagagtgcaatggtgcaatctcagctcactgcatccttcacctccagggctcaagcaatcctcccacctcagcctctttttttgtttgtttgtttggagacagagtctcactctgtcacccagactggagtgyagtggcgcaatctcggctcactgcaaccaccgcctcccaggttcaagcgattctcctgcctcagcctcctgagtagctgggattacaggtgactgccacaacagctggttatttttgtattttttagtagagatggggtttgaccatgttggccaggctggtctcgaactcaggtgaaccacccgctgtggcctcccaaagtgctgggattacaggcatgagccatcgcgccctgccaaattatggtgctttttaaaaagtatgtgaatgtgacatgggcacacactagaatgggcacag

SEQ ID NO: 18558 - DNA, 601 bp, Human
tctgtaagtttttatagagcttaatctccagcccctgcttccttccaggaggtcggtaggtggagctgaaagttctaacctcctaattgcttggtcattctaagaagtagctccatcctgaggctgtctaggggccccaacctactaatcaccttatcagtataaactcaggtgtgatccagaggggctcataacgacacacaggaatagagtacttaattgtgagcatacccttagcacaggacaggcactcaatgaaggtttcccatcaaatcaatagaagtaatgtgccctggaaccygactacctggcttcgtgtccaggctctgctgcttgctagtgactgacactgggagaggctactaaaccttggaatcctcagtttcccatttcgtgaaatgggaatgacaatcccaaatcctaaggataatacaacaatcaaataaaataccatgtacaagtgtagcagacagggagggtctccaaggactataggagtttcatcagcttgaacaatcagcctgtttcacaggctcctgcccttcagcctggtttttcccacaacttgcatggaatgcagtcaccaagtcaggtgaaacca

SEQ ID NO: 18559 - DNA, 601 bp, Human
tttgcacaaccccctcttcaggtgcaataatttgctagaatggctcgaagaactcaggcaaacgctttttttatagttactggtttattataaaggatacaactcaggaacagccaggtggaatgacacagaggcagggtaggagagggggtgggcatggaacttccacgcctgctccagccacgccaccctcccagtgccctccatgtgttcaacccagatgcttatcacatctgtaagtttttatagagcttaatctccagcccctgcttccttccaggaggtcggtaggtggagctgmaagttctaacctcctaattgcttggtcattctaagaagtagctccatcctgaggctgtctaggggccccaacctactaatcaccttatcagtataaactcaggtgtgatccagaggggctcataacgacacacaggaatagagtacttaattgtgagcatacccttagcacaggacaggcactcaatgaaggtttcccatcaaatcaatagaagtaatgtgccctggaacccgactacctggcttcgtgtccaggctctgctgcttgctagtgactgacactgggagaggctactaaacc

SEQ ID NO: 18560 - DNA, 601 bp, Human
tcccccatggagtctcctcatcacagcagtaaggacacaaactgcagctggggatcactgagcacttgttatggccagacactgtgttgagtgcttgccgcacactatcacgtttaatcctaacaagcatgatggacctcatgatacaggtggggaaactgaggcctcagcaggtcaataatgtgctcagcatggccggtggtgagggagcgagccaggattcatgtcggcactacccattctgccactgtgctgcctgtctccaagtccagctactctgagattccgtctgatgtgcaaygcatcctcagagtcccagagacctcccaagaccacccggattgacgatctcagggaacacagacttgtcctctggaccacagcaggcagagaataggggctggaagctgctcagtcatggacatgtctgtaatactcactcaactaggaattctaagggtgtccaggagctgaagtcagcctcaggcattgatttcctgttcatcggggtatccagggtaaccctgcaatggacacagataagcacgtcattcatgtcgctcctttctaacaacaggtgcccagtcccccttggccagga

SEQ ID NO: 18561 - DNA, 601 bp, Human
acccacagctgcaccaaacaatggaaaaagagatagaaaaaaacagactattacaataaaatgttaaatacagtaacagggcctttcacaaatctgaggagaggagcaactgaccccacttgcagcagtcaaaaagaccctctaagaagacaggaatgaaaaagggcaaaagaaattcacaagaaacaagaagtagatgataattctttaacacaaaacatttacatttgagtacatcatccattttgacaattcaccagctgagacttcggaccttcattaactaaaaagtgctcagcakttccttcctgggagactcccagtgccaatctgtaaccttctgggccagcgctgatgtgtaaaggtccagtcattcaggcccctactctggggtttgaacaagctcatatgagcacatgggctcaaaaaacaaagcgttgctaaaactctctaaagtactgtcatgtcatggcctcatctctggggacagggtagggcttggtgagggaaggctctgaaagagaccagtgccgtttggttgtgtagggttttgtgtgttggttacacatgtttttttgttgttttgtttttttatacttta

SEQ ID NO: 18562 - DNA, 601 bp, Human
taatttggccaggcgtggtggctcacacctgtaatctcagcaatttgggaggctgaggcaggtggatcacttgagcccaggagtttttgagaccagcctgggcaactgggtgaaaccctacctctaaaaaaatacaaaaaatagctgggcatggcacatgcctgtagtcccagctactcaggaggctgtggtgggatgattgcttgagccccggagatcaaggctagggtaagccatgatcgtgacactgcactccagcctgggtgacccagtgagaccctgtctcaaaaaaaaaaaaaaytgtttttaaagattttaattagttcattcaaagagagagacacatgcacaatactttgctatattaccttctcataaatttatgagagaaacagatgcaattcatttatttggcatttttttaatcaaacatttatagagtacccacagctgcaccaaacaatggaaaaagagatagaaaaaaacagactattacaataaaatgttaaatacagtaacagggcctttcacaaatctgaggagaggagcaactgaccccacttgcagcagtcaaaaagaccctctaagaagacaggaatga

SEQ ID NO: 18563 - DNA, 601 bp, Human
acgtgcctgtaatcctagctactcaggaggctgaggaagtagaatcacttgcacccgggaagcagaggtaagccgaggttgcaccattgcactccagcctgggcatcacaatgagactccgtctcacaaaaaataataaataaataaataaataaaagccactaaaggtcaggcattatggctcacccctatgatcccagcactttgagatgccaaggcgggcggatcgcttgagcccaggtgtttgaggccagcctggacacaatggcaagattccatctccaaaaaataataaaaaatwaataaaagccagtaggcatgatggacacatacccaggcccccagtgagttcagtggtgtactcattctaatctctgagtggcaggatttggcataagtttaactttcattttggtatttttctacattgttggaattcttttgtgattttaaaagattctaatttggccaggcgtggtggctcacacctgtaatctcagcaatttgggaggctgaggcaggtggatcacttgagcccaggagtttttgagaccagcctgggcaactgggtgaaaccctacctctaaaaaaatacaaaaaa

SEQ ID NO: 18564 - DNA, 601 bp, Human
agttcgagaccagcctggccaatatgatgaaaccccatctctactaaaaatacaaaaattggccgtggtagcacgtgcctgtaatcctagctactcaggaggctgaggaagtagaatcacttgcacccgggaagcagaggtaagccgaggttgcaccattgcactccagcctgggcatcacaatgagactccgtctcacaaaaaataataaataaataaataaataaaagccactaaaggtcaggcattatggctcacccctatgatcccagcactttgagatgccaaggcgggcggatcrcttgagcccaggtgtttgaggccagcctggacacaatggcaagattccatctccaaaaaataataaaaaattaataaaagccagtaggcatgatggacacatacccaggcccccagtgagttcagtggtgtactcattctaatctctgagtggcaggatttggcataagtttaactttcattttggtatttttctacattgttggaattcttttgtgattttaaaagattctaatttggccaggcgtggtggctcacacctgtaatctcagcaatttgggaggctgaggcaggtggatca

SEQ ID NO: 18565 - DNA, 601 bp, Human
tcaggagttcgagaccagcctggccaatatgatgaaaccccatctctactaaaaatacaaaaattggccgtggtagcacgtgcctgtaatcctagctactcaggaggctgaggaagtagaatcacttgcacccgggaagcagaggtaagccgaggttgcaccattgcactccagcctgggcatcacaatgagactccgtctcacaaaaaataataaataaataaataaataaaagccactaaaggtcaggcattatggctcacccctatgatcccagcactttgagatgccaaggcgggcrgatcgcttgagcccaggtgtttgaggccagcctggacacaatggcaagattccatctccaaaaaataataaaaaattaataaaagccagtaggcatgatggacacatacccaggcccccagtgagttcagtggtgtactcattctaatctctgagtggcaggatttggcataagtttaactttcattttggtatttttctacattgttggaattcttttgtgattttaaaagattctaatttggccaggcgtggtggctcacacctgtaatctcagcaatttgggaggctgaggcaggtg

SEQ ID NO: 18566 - DNA, 601 bp, Human
ttctgtggttaccacctggattaggcttcctgagctcggtcggtttttccctgtgatccagtcatggaaagttctggaacagaaaataaaagttttttttatattctcaaagcaaaaatctgggcacatgctgaccttcacagtgacggcttgtggggtggggggaaggggtggcacagcagcgactgtttaaaagccactaagggctgggcgccatggctcacacctgtgatcccagcactttgggaggccgaggcgggcagatcgcttgaggtcaggagttcgagaccagcctggccamtatgatgaaaccccatctctactaaaaatacaaaaattggccgtggtagcacgtgcctgtaatcctagctactcaggaggctgaggaagtagaatcacttgcacccgggaagcagaggtaagccgaggttgcaccattgcactccagcctgggcatcacaatgagactccgtctcacaaaaaataataaataaataaataaataaaagccactaaaggtcaggcattatggctcacccctatgatcccagcactttgagatgccaaggcgggcggatcgcttgagcccaggtgtttgagg

SEQ ID NO: 18567 - DNA, 601 bp, Human
ctttaaaaacagcaactgtctggtgactagagatctgggcttagctctgccagttactggcaacaaggtaatgtctctctgggcctcagtttcctcatctgtaaaatgatcgggttggattaaaccactactagttctcgaccaggacagcctacattggccatatgtggagagctgcttctaaatgcacagggccatcccatcacccccagattttgacatgtccaaggcagaatcaggcctgtgttcttgtgttgaaatatttatttcaggatttaaatccacccccttctgagaacaycagattaaaagacctccagcaatccatgattctagtatactcatctctgactgctgtatataagatgtgatttgattaaagaagacagacaacaagtgcatttattaggaacaacattctgaatactcacgagtagttatcttgcacacttaaccctaggccagaggacacggggcaaccacacaggaaaaggataccaggacagagtccatgtagttttgcttataccacaaaaggagttaaggcagtttaattcaaggatgcgaaaactacgtctatgacataaacatgacattcaaa

SEQ ID NO: 18568 - DNA, 601 bp, Human
tccctctctcgaaacctcctaatcctttttagccccactggaagagggattcgggtctggcagaagagtgtacccggatgattcccgtgtgtctccaaactcctacagcctcacgcagccctgaagcttgtcctggcttctctccaggctggacacagaggcaggccagcctcacttaacccctgacgccttccacaccagcggtgggggggaagccatgccaagcttcagtgtcagcggctgtgataagggcggcttgaggaaggggtggggtggggcacggggtgggtgttggggcggytcccttactgcggacactgagcttctcccaggagctatggtccaggctccggttaaggtagaggaggccggtgtcctcctggatgcagatccagttgttctcatgcagccgtgtgcggtacgtgccgtagagatgctggcccaggcggaagctgggcacctcctcaggggcgtcccgcagggcatggacgtacagcaagggcgtgccggccgcctggtccacatacagcttctcccagtaagcatccctcgagaagtagaggcccaatgccactgtgggaagtagggaagtgagtgaggg

SEQ ID NO: 18569 - DNA, 601 bp, Human
ccctgccaggtacaagggcagccagctgctgataagaagtcaggctttccttgggaactgccgcttctccagagagttgcaggtcatttgctaaatcaaaaccttgggatttttccagccccacttactccctctctcgaaacctcctaatcctttttagccccactggaagagggattcgggtctggcagaagagtgtacccggatgattcccgtgtgtctccaaactcctacagcctcacgcagccctgaagcttgtcctggcttctctccaggctggacacagaggcaggccagcctmacttaacccctgacgccttccacaccagcggtgggggggaagccatgccaagcttcagtgtcagcggctgtgataagggcggcttgaggaaggggtggggtggggcacggggtgggtgttggggcggctcccttactgcggacactgagcttctcccaggagctatggtccaggctccggttaaggtagaggaggccggtgtcctcctggatgcagatccagttgttctcatgcagccgtgtgcggtacgtgccgtagagatgctggcccaggcggaagctgggcacctcctcaggggcg

SEQ ID NO: 18570 - DNA, 601 bp, Human
cggcaagttccatcaccgaagcgccatagccatttcagctgggctgcgagggctttcccagcctccatctcagccctaggtgggcggctgctcctcagagctgctcttcccatattctctggcattctctttgctttttgctagcctgtccctcattgctccaatcccctgttgtaattaattctttacacaaactctccctgttaaattaccctgtggtttcttcctccacaggaactggctgtgcatgaagcctctccccaccttggagggcttaggcctcctacgaaatgcaggcccrgggcaaattccacactggcccccacccagggactcccattcctcaagctccaccctggaggctcaggatgaagagggcagcaactaagtgcgtagaaccacgaccaacctcagatgctgcctcctccaggaactgcctgggctgcgccggagggagttgcccacccaagtctcctccctcccctgcaccctggctgtccctggcagataggcctgggtagggcagggatgcctgctctgcattcatagcctgaggcttgcctctcaccagcagacagggctcagggtggttgtgagggct

SEQ ID NO: 18571 - DNA, 601 bp, Human
gcaccctcccacctttgctctgctagcccccaccctgaccacccaatttacgatagaggaatggaggtctcctcgtctgttcccctcctcttcagcgtttccctcttcccagtttcctccccagctagctccttccagaagccacctgatttccttggcatgctcagacgctctgtctgccccacaagaatgaaagctgcaggcaggcaagattccaacccgttgtgttcattgttatatccttagctcctagaacagtacctggcccctggcaggcatgcaagaggtacttctggaataytgaatgaactgatggcatgaaggtgaagaataaaccagatggcttgtgtcaagggctcgcagagcaagaccagcagtagcaggcactgtggggcggccccacaaggtcggcactcaccctccaggagcctgtaggccacgctgatgttggggcacaagaactgcacaggcagcaggcggaactggtggaaggtgcctgggggtcggttctcccgaatgcggaaggagggccttgtctctgggaagcagagctcccggggcttgagggagctgcaggctggaaaggaggtgttgaagaagg

SEQ ID NO: 18572 - DNA, 601 bp, Human
acctagtcagctgccttctcccctctccactgggatccagctcatcccaccctctgactggctgcagctgcctgcttctcgccatgcctcggcttccacccgtatcccggcatcacaccccacatcctcctgttcagaggtttctcctgtagccttctgattgtctcccagcttcgcccctgaaccttcccaccccaaaccattcctaacacagtagtctgactaatccttttaaaactaagtcaggtcctgccagcactccctccctccaaagtcttccatagctccccatgttcctccrgagaaagccctgcaagccactcccagacctgccccctgccccaggaactattctgccccatcagcctcagctcttccctgtcgctcagtgcactccaggcacacgagggtcacactgtggtgccctccaaggggctaggcctgcctacccggcaccctcccacctttgctctgctagcccccaccctgaccacccaatttacgatagaggaatggaggtctcctcgtctgttcccctcctcttcagcgtttccctcttcccagtttcctccccagctagctccttccagaagccacctga

SEQ ID NO: 18573 - DNA, 601 bp, Human
taacgcataatgatttccgaccgcctagtgtgcatccccactctacacctccttgtccagtgcgtcgccaggctggtcatcctctgaaggccggatgtcgagacaaaagcgaatgctccgtgccctgcatggcagctcgcgctagactacatcgcccctgaagcagggccaggaaccacaacacagtcttcaacgagcctgacctcggatttgtcctccagaaataatccagaaaagggggcatgctgaaggcggaaggtcaccgctgaagaccccacaacccaccccaaggaggcggggkcaactccacaagcctcccaggcagaaccatgccttgcgcatgaattacgtatgtgggaaatgcttatcatataatgctttcctctgttgagtgtgattacaaaaaaccccccactaaactaaatttaatcacataatttttagtgaaaaagggcagcatgcaaaaaaccaagtgctccatcaaccctgccccagagaatgaaaggaatctggggaagcataagtgatggcttgtcttcctttactgagattttaatattcttgccatgtttgtgtgataaagttagtgtgaatttaggac

SEQ ID NO: 18574 - DNA, 601 bp, Human
tagggacggcctttcaccatattggtgaccttggctgctttttaaaaactgttaggtttttttttttttcaattatggaagcaatatgtgttcattttagagaacgtgagaaagccacgattctaccacttgaaaacaaacacagtggacatctggggtatgatgtgacattaacgcataatgatttccgaccgcctagtgtgcatccccactctacacctccttgtccagtgcgtcgccaggctggtcatcctctgaaggccggatgtcgagacaaaagcgaatgctccgtgccctgcayggcagctcgcgctagactacatcgcccctgaagcagggccaggaaccacaacacagtcttcaacgagcctgacctcggatttgtcctccagaaataatccagaaaagggggcatgctgaaggcggaaggtcaccgctgaagaccccacaacccaccccaaggaggcgggggcaactccacaagcctcccaggcagaaccatgccttgcgcatgaattacgtatgtgggaaatgcttatcatataatgctttcctctgttgagtgtgattacaaaaaaccccccactaaactaaatttaat

SEQ ID NO: 18575 - DNA, 601 bp, Human
ccctcccgttgggggctaactgctggtgggagggagtgccctcccggcagatgctccccgcccgggcagcgcgccgcgcccgcctgcagcggcacaagtatgccccagacgcgagccctcgggcctcgtcctggtccttgcctcccgaggcaaggcccagctgggtgctggcaggactcccccttcccctccccctaggacagacggcgcagacggaggcgaaggacaaatgaaagcgcgaatggtcggccacacggttgggtggctacacggacactaaaccgaccgagaaacgaactgyggccggagacagacactgggtagaccacagcacgcgcggacaagcacctccttccgcttgaactccaccacggcgctggcggtgtcgacgcccgcggggaaggtgggcgccgagtcgtcctcgtcgtacacggtcaccgggaagggcaccatcaccacctcctcgcgcgcgccggcgtgcacggtgcacacggccaccagctcgtacttctcccgctgctcgcggtccagggcccagcgcgtgctcacctccaggctgtccggggcgcagcggaagggcagaccctcacctgcgcaccaa

SEQ ID NO: 18576 - DNA, 601 bp, Human
tccctgagccactgagcctcgcctgtgtaacaggtacaatgcagacctcttataaggagaattacagccgatgcccaggcaccctgctggcaggtcccatccaggtccccagagagcaggatgagcacctccactctcccctgaggaagctgggccccacagggtgaaggtcaggtcaaggtcacacaggaacagccggcagagccgagctccgaggccaggtgtacatcagagcgctctgttccaagcatcctcctaccccaggctggagggggttgtgaggaaagccgctgggcacctgggatggctctgcccaccaggcctctgctgtcaccccagggaggcccacatagcctttactcacaaattgtgctttcgaccagaccccctttccctgccaaacctgcacgtggtgtgcccagagaagcggaacaaggcaacgtactacctacctcagtccccacgcccactctcccacggcccctgctgggtgggccggctgcaggaaggccgaggcccagcaggtggcggtcgcgctccaccagcgcgagccggagaagggcggggcgggcggcgccggaggtgatccgccttcccgtcc

SEQ ID NO: 18577 - DNA, 601 bp, Human
cagatgtgtgttgtcagagccaggtctggggacagtctgacctgggttcaagttcccacggggtcactggccagcctggccgtcaccttccctgagccactgagcctcgcctgtgtaacaggtacaatgcagacctcttataaggagaattacagccgatgcccaggcaccctgctggcaggtcccatccaggtccccagagagcaggatgagcacctccactctcccctgaggaagctgggccccacagggtgaaggtcaggtcaaggtcacacaggaacagccggcagagccgagctcsgaggccaggtgtacatcagagcgctctgttccaagcatcctcctaccccaggctggagggggttgtgaggaaagccgctgggcacctgggatggctctgcccaccaggcctctgctgtcaccccagggaggcccacatagcctttactcacaaattgtgctttcgaccagaccccctttccctgccaaacctgcacgtggtgtgcccagagaagcggaacaaggcaacgtactacctacctcagtccccacgcccactctcccacggcccctgctgggtgggccggctgcaggaaggccg

SEQ ID NO: 18578 - DNA, 601 bp, Human
tgcatcgaagacacgcagcgtggccaccacggtgtcctgcaggatgcagagggcgttggtcagtgcaggcgagatgggcccctcagaccccccaaaaccagagaccttaggatgctgcacgtcccacacagcccataggtggaccagatgtgtgttgtcagagccaggtctggggacagtctgacctgggttcaagttcccacggggtcactggccagcctggccgtcaccttccctgagccactgagcctcgcctgtgtaacaggtacaatgcagacctcttataaggagaattacagcygatgcccaggcaccctgctggcaggtcccatccaggtccccagagagcaggatgagcacctccactctcccctgaggaagctgggccccacagggtgaaggtcaggtcaaggtcacacaggaacagccggcagagccgagctccgaggccaggtgtacatcagagcgctctgttccaagcatcctcctaccccaggctggagggggttgtgaggaaagccgctgggcacctgggatggctctgcccaccaggcctctgctgtcaccccagggaggcccacatagcctttactcacaaatt

SEQ ID NO: 18579 - DNA, 601 bp, Human
cctgtaagcccctgttttaagataccctgcattttggggccaaaccaatgtataccttctgtgtgttgatttatgtccttgcttgtaactcctgtctccctaaaatgtataaaagcaaactgtaactccaccaccttgggcctggggaccacttactcaaggcttcttgggtttgtgttttctccaggctgtggtcactcatcctggctcagaataaacctctttaaaatgttttacagagtttcgttttttgggtaacagggtgtgtgtgtgtgtgtgtgtgtgtgtgtgtgtgtgtgtstgtgtgaggcatggggggttaaaggtctacattaccaaggccctgggaaggacacactagagccctccagacagctcccccagagcatggcagaactaccctccactgcaggaacctccagcagacccaatgaccccgcaggccaagccctggaagtcatgccatcggtgtacctgccgcgtgctgccactgtggatctcatgtggtggaaacaatgatgggaggggcactctggcacacagggtgttcagtgccagggcaaggaggctgtctcccctctgacaagtggggcctccatag

SEQ ID NO: 18580 - DNA, 601 bp, Human
cccagccacaagactcgggagcatggttgccccagcccatgcaggaccagggggcctccctgggactttgagcagagcctctgggaaagaggagcctcttctcctggggatgccaggctctgggactttgaccagagcccctgggaaagaggggcctctcctggggatgccaggacctggagtcaggcagctgaattctttcaacctcttggcaactcttgcagctgcttgaaaccaaaagttccacagatggcgagacgggggcgggccagagcagggctgggctctcccaggcccacamgtgaccacagcaaaaaccagcctcctgggcctcctcactttcccctacaaagcccacttccaaatgctcatgtgactctcaaaattgttcagggttcctgtccctaattcacagctttacaaactggggagaaaggtgagaccacagtgaggctgaggctggactgggattcaggcccccgttgctcctgacagagggcaggtgacccaacttcagcaatgcctgctcttgccccgccccccatgagaccccccggggccctctgtcttgtcgcccctctgtctctgatcccactcccat

SEQ ID NO: 18581 - DNA, 601 bp, Human
aggtccaccctgccctggtgtcccctggtcagagcactgaaccccagccacaagactcgggagcatggttgccccagcccatgcaggaccagggggcctccctgggactttgagcagagcctctgggaaagaggagcctcttctcctggggatgccaggctctgggactttgaccagagcccctgggaaagaggggcctctcctggggatgccaggacctggagtcaggcagctgaattctttcaacctcttggcaactcttgcagctgcttgaaaccaaaagttccacagatggcgagaygggggcgggccagagcagggctgggctctcccaggcccacacgtgaccacagcaaaaaccagcctcctgggcctcctcactttcccctacaaagcccacttccaaatgctcatgtgactctcaaaattgttcagggttcctgtccctaattcacagctttacaaactggggagaaaggtgagaccacagtgaggctgaggctggactgggattcaggcccccgttgctcctgacagagggcaggtgacccaacttcagcaatgcctgctcttgccccgccccccatgagaccccccgggg

SEQ ID NO: 18582 - DNA, 601 bp, Human
accatgtagtgaagttcggcacacttgggccgccgcagggccttggtgtcattcacaaacaggatccccgaggtgtcctcggctgaggtgaccacccctagcgtgctgcagttggcaccagaggaatgcagcttgtactggacgttgatgccactgaacgcctggcagttttccacacagactttcccgatctaggggggcacaggggaacaccttagccaggcagctggaccggcctgtaatggcctgagggtagagattcccacacagcctaagtcctggaacagcccccaactgggcmtggagacagcagcccccccgagcaccctgtcctccacccctcagagccttcatacccacccacctgccccagccctgccctgccccgttccactcaggccacatgttaccagctgcccctgttcctgggagctggaggtcaaggcaacccagggcctcgaggttcagtttggtggcaggaaaagccccaggcaggccctgactcaaccctttactcccctttcctccctcactcagacaacaaagccgccggaatgtctcccaggctcctccctggctgctcccagctgccccagcagtg

SEQ ID NO: 18583 - DNA, 601 bp, Human
tctcaaagggcaggaggcccaggctccagaagcccccaggaccccgaccctccctccctggagcaggcactcacatgacccctccactgttacaagcagctgggcctgggcctgcctagaggtctgctggtcggtggccaccaccatgtagtgaagttcggcacacttgggccgccgcagggccttggtgtcattcacaaacaggatccccgaggtgtcctcggctgaggtgaccacccctagcgtgctgcagttggcaccagaggaatgcagcttgtactggacgttgatgccactgaaygcctggcagttttccacacagactttcccgatctaggggggcacaggggaacaccttagccaggcagctggaccggcctgtaatggcctgagggtagagattcccacacagcctaagtcctggaacagcccccaactgggcctggagacagcagcccccccgagcaccctgtcctccacccctcagagccttcatacccacccacctgccccagccctgccctgccccgttccactcaggccacatgttaccagctgcccctgttcctgggagctggaggtcaaggcaacccagggcctc

SEQ ID NO: 18584 - DNA, 601 bp, Human
aagccatgggtgaagccaggccccctcctaacatttcatctgaacaaaggactctgcctccaaaactggagcctggtggcctgacccgcacattgcagtgtccctcgtctggctcagggccgcactttccctgtcagtgtccctactgaccattctctgcttctgaaatctgtgtgtgccgacttctgggacctcagcaggggcctggacagtctgtgggtccctgccttccccctgtccctgaccctgcctgctccctccccatggctagggtgatgctgaaatgcacaggaggctcagsttgatgcatagaactgacagccctggcaactctggctgaagtgcctgtgggatccaggtttcccctactatctcctacctgttcccatgccctgattaaaccctgcttacggaggcagtcctgagggcaaatgttgatgtcttgggtctccacaacatcgcagtggccgtcggggcaggtcttggtgctgggagagcaggtggagaagttcctggtgatccctgcacaggacacacagcaggctgtcacccatgtgggagccccgccacacgcccccaccacctcctaggcagatcctgc

SEQ ID NO: 18585 - DNA, 601 bp, Human
atgctgtgaccctgaccactgcctctcacctagatgggaacggcacctcatcatagtcccaccccacagactgtccccacacagcgccctatggaaatgggggcagaacacaggcctcgtctgcccagcgttggcagcccctcacaggatggcctctgtctccccagctggcctccctccctggaaggcagctggggagggcaggggatcttccctgccccgcagggaccctcaccaggatcttgaaggcatccacggagacctggttctccatggagtccagcgagggccggcgggcacyggaagaggagtagctgaccgggaaggcctgggcgggcctccggaaggtcatctcagctgaggagatgggtggcttgtgggcaaacttgtggtagcagtggatgcagaaggcagacagcagcaccgagacgatgaaggagaagaggacagcggctgcgatcaccgtgcggcacagctcgtcgcacagtggatctgtgggtgggggtggtgtgaggcttggcaccgccagaggctcggcaccactgggtacaggctgcgtatgctctgcctcatggctctccagcctgccgtgtccgcgcca

SEQ ID NO: 18586 - DNA, 601 bp, Human
ggagaagaggggggaaaagtgtgaggatgacaggggaggaagaaggcaagacccttaaaggaggccccatggacaagttccaatgtgcagagaaccggctgtcatctgagccagcggcaacgctgcctgtctctgccctgggcgggaccccacagccaggcccctgaaagctgctacatgacaggtgtggtcacagcatggcttggactcagtacttcgaccctctctggttcctggtctactgtctcccctgacccctgccccaggactaaatgagcaccaggcccagcccaggacctcygactacagtggaagtgtccaggacaacttctctacatagccacccctgcaaagaaaggcgccaccatgttccgcctcagagtgtggaagcactgctcctcaagggctgccactggccctcacgcacccgctcaccctgcctgctggcactaccaccctgccctcccaccaaagttctatccacacattgggcccacttgggactgctccggatgccttcccagacccccaccctggcccccagtacttgaactctgaccagggaggccaaagcctgccatgatccaggaaccctcccttg

SEQ ID NO: 18587 - DNA, 601 bp, Human
acggccaccgtggtgtaccctgctctgcctttcagatggaaggccgttgccttgaccacttttccaaattcgccttctcctagagtttttccaagaaccaagttcttccgagggaattcccactttggatcctcctatgttggaaatgagggaagggggagaagaggggggaaaagtgtgaggatgacaggggaggaagaaggcaagacccttaaaggaggccccatggacaagttccaatgtgcagagaaccggctgtcatctgagccagcggcaacgctgcctgtctctgccctgggcrggaccccacagccaggcccctgaaagctgctacatgacaggtgtggtcacagcatggcttggactcagtacttcgaccctctctggttcctggtctactgtctcccctgacccctgccccaggactaaatgagcaccaggcccagcccaggacctccgactacagtggaagtgtccaggacaacttctctacatagccacccctgcaaagaaaggcgccaccatgttccgcctcagagtgtggaagcactgctcctcaagggctgccactggccctcacgcacccgctcaccctgcctgc

SEQ ID NO: 18588 - DNA, 601 bp, Human
ggtggtctcttcaccaagaccccaggagacactgggctgagaggaatgaatggggcagactggagtgaagacagctgtcagctcaaaatcaaagggctttttaaatgtttaaagcttagatcttcagtggcactggcacagcaacacctctagagccttccagggagagcaaagtcctcgctctgcttctctaggcccaagtggcccatggtaggggtcccccaactgcagccgctctagaacagcattgggggctcttcagggtcccatgctgggcaggaggggcctcacccgccccccrccccggagactcccccaggggcactgtgcctgtgcctggcaggtacctttcagcatcttcacggccaccgtggtgtaccctgctctgcctttcagatggaaggccgttgccttgaccacttttccaaattcgccttctcctagagtttttccaagaaccaagttcttccgagggaattcccactttggatcctcctatgttggaaatgagggaagggggagaagaggggggaaaagtgtgaggatgacaggggaggaagaaggcaagacccttaaaggaggccccatggacaagttccaa

SEQ ID NO: 18589 - DNA, 601 bp, Human
ggtctcctgggtctttatctgagaaatggtgacaatgttcctgccatgcagggcggggctggggtcacctgaggtcacagcacacctggtgccctgtggtacccagggtaccctagtacccaggatgcactgtccattcctagagctccctgccccatgggcccagccccgaactgggtgaggacacatggcagtgtcacaccagagacctctgagtagccctgtgggcccagggagtgccgctagcgcggggcccctctgatggaaagtgaccactcagcccgtggactcagctagacayaagctccaggctggggcctgagccaggcttccagaaagagggagaacaggaaacagggcaggagcagtagggaaagggagaaagagggagaacagggctgtatggagcccccagcctgggtgcagtggctgcccacctcaccctgcagctggccttaccatcctggctgcaggccccatacaatttgatgacatgtgggtggttgacctgcttcaggacgttgaactctgacagcaggtctcgaagctcactcggggaggcgttctctgaaatgcagcacagagcaggttgcaaacgatc

SEQ ID NO: 18590 - DNA, 601 bp, Human
cctccaactctactggtgccgaccacagtgcctgctgcgcactcccggtgtttgggttccctatccctctcgcacacacccacacacgcatgctgggaagcccctgagcagcatggtggtttggaaaaccaacaaaccaggctggtctcctgggtctttatctgagaaatggtgacaatgttcctgccatgcagggcggggctggggtcacctgaggtcacagcacacctggtgccctgtggtacccagggtaccctagtacccaggatgcactgtccattcctagagctccctgccccaygggcccagccccgaactgggtgaggacacatggcagtgtcacaccagagacctctgagtagccctgtgggcccagggagtgccgctagcgcggggcccctctgatggaaagtgaccactcagcccgtggactcagctagacacaagctccaggctggggcctgagccaggcttccagaaagagggagaacaggaaacagggcaggagcagtagggaaagggagaaagagggagaacagggctgtatggagcccccagcctgggtgcagtggctgcccacctcaccctgcagctggcctta

SEQ ID NO: 18591 - DNA, 601 bp, Human
ctcgtgtgggtgcctccttctcgaggtgcctgaggcaggcgacactgccctgggaggcacccctccctgatgctaggacgccaagcctttttgcctcctgggtcctgccccagtgcaggctggggatgctgatggaggcagaggcctgcgcagatgcaagggttcctgcctggcgctgggctctgcacacagcctgctccctgttcccacctgtcctgtcccaggcccagcctccaactctactggtgccgaccacagtgcctgctgcgcactcccggtgtttgggttccctatccctctygcacacacccacacacgcatgctgggaagcccctgagcagcatggtggtttggaaaaccaacaaaccaggctggtctcctgggtctttatctgagaaatggtgacaatgttcctgccatgcagggcggggctggggtcacctgaggtcacagcacacctggtgccctgtggtacccagggtaccctagtacccaggatgcactgtccattcctagagctccctgccccatgggcccagccccgaactgggtgaggacacatggcagtgtcacaccagagacctctgagtagccctgtggg

SEQ ID NO: 18592 - DNA, 601 bp, Human
ggagccccgcctcatccccgggactgggcacctggctcctcttcacgtaggaatcctcttcataaacatctcgggacaagccgaaatccgaaatcttcatcttccgcccctcagctaccaggatgtttctggctgccaagtcccgatgaacgagctgtgaggaaaaatagcacgagtcgtcaggccatggccaggcagcagcggtcactggctcagcctggtgtgaccagcagaggggtggtgtgtggcccgggtagcggcctggtgagacctgggccgggggtgtggcatggcaggggcrtggtggagtcagggtgtgacatggcaggggcgtggtgagccatagcatggcatgccatggcaggggcatggtgggctagagtgtggcatggtgggggagtggcaggccagggtgtgggtggcaggggcgtggtgggtcagggtgtggcctggccggggctggctgggtgcagagccatatgcacgcaccttcatctcggccagatactgcatcccctgtgagatctgccaggcaaatgagatgaggtcgcccatggtgagggcccgctcatccgggtggtccagggagctggagttgcgg

SEQ ID NO: 18593 - DNA, 601 bp, Human
ggacccagggtcagaaagatttggggtgagggctataaaaagcttagagctccactaatcttcggtatctttcctaggcttcccaagggcactgcctgccccatggtgcacctgggatccctgggagccccgcctcatccccgggactgggcacctggctcctcttcacgtaggaatcctcttcataaacatctcgggacaagccgaaatccgaaatcttcatcttccgcccctcagctaccaggatgtttctggctgccaagtcccgatgaacgagctgtgaggaaaaatagcacgagtygtcaggccatggccaggcagcagcggtcactggctcagcctggtgtgaccagcagaggggtggtgtgtggcccgggtagcggcctggtgagacctgggccgggggtgtggcatggcaggggcgtggtggagtcagggtgtgacatggcaggggcgtggtgagccatagcatggcatgccatggcaggggcatggtgggctagagtgtggcatggtgggggagtggcaggccagggtgtgggtggcaggggcgtggtgggtcagggtgtggcctggccggggctggctgggtgcagagcca

SEQ ID NO: 18594 - DNA, 601 bp, Human
gcatgaggtggcctctgaaaagtgcggcaagggcctcgggtcagtatgctgccagggaggggtgccctggaggccctggaggagaaggacatggcagaggctgagcggagttctaattgggtccttggggacccagggtcagaaagatttggggtgagggctataaaaagcttagagctccactaatcttcggtatctttcctaggcttcccaagggcactgcctgccccatggtgcacctgggatccctgggagccccgcctcatccccgggactgggcacctggctcctcttcacgtasgaatcctcttcataaacatctcgggacaagccgaaatccgaaatcttcatcttccgcccctcagctaccaggatgtttctggctgccaagtcccgatgaacgagctgtgaggaaaaatagcacgagtcgtcaggccatggccaggcagcagcggtcactggctcagcctggtgtgaccagcagaggggtggtgtgtggcccgggtagcggcctggtgagacctgggccgggggtgtggcatggcaggggcgtggtggagtcagggtgtgacatggcaggggcgtggtgagccatagcatg

SEQ ID NO: 18595 - DNA, 601 bp, Human
ggaatccgaccctaaagagaagatggaataaagacattgaagttactctaactctctaggaaggaggggtaaaggagaaggccaggccctatccctgagctttcagtaaccagaggagtgctgtagacactcctgggcacagaactggccacacacatctttgaaggggctggagctccagcctgaacctcctgtggattgctgagatgctggcgggagtcagctgcccacccacaggcacacagggccagcttgtcacatgccacaggcctgctggtagtgcagagcagtgcttccctaygcatgggcctggaactccccctgcaagatctcccctggggttctgagggccaatgtgtttgggaaaccaacatctagcatttccatgttgggcactttgccagcagctaccacactgaaggagccttgagggaagggatttgtctgtgtgccttgggggaggctgttttttctctcttattgtattgcagggtgcttttagcatctctgaatgagtgcccccagccccctacatccctcatcagtgctggggtctgacctaacaaatcctttccagggtgacttgagaaacagcttctcc

SEQ ID NO: 18596 - DNA, 601 bp, Human
atatccacccccaccaccaagcacctgctgaccctgtcggcttcaagcacagatgctcacagatgtcagcctgggtctggctgctcagatggatgtagcatgaaggtggggaagggctgcctgcctgcctggcccctactccatgaagctgaagtccttgcccaagccactcccatcagagcagccacacgcacaagggacacatgaggcttaagatgaattcatgattaatgaattaatgatacattaattaatatcatgaattaatcttaataattcttaagattctcacacttaaagyggtgagaatgcaggccaccagactcagagtgccttgtatagttcttttgccatttctatgtgcttggaaaatttcataaaatcttagaaggaaaaaaagctatagaaaaacattttaactgtgaaggaaaactcgctttgcaatgggaacaaaatcatatcacaaaacagcatcgcatgagcccatttagggcaataaaaagcatacatgtgcacaccacggagcacaccagagggcagccagaggtcactgggcggtgtggtccagtgacattcagtctcttctttatgcttttctctg

SEQ ID NO: 18597 - DNA, 601 bp, Human
tcactctcctcttaaccatcatcttctccaggtctttgctgatgtccgcaaacaccggccttttgtccggctcctgcttccagcattgcagcatcaggcggtacctggtgggaagagcagacaggccaatatgatccaagcagggccaggtctcagaaggacagcccaccacagccatcgcaccctgccctgtaccctgggcccagtgtgctctgtctccaactccaaagctatttctgcatcgctgacatctctgagcctcgtgggactggggcatggcctgttgcaggatcccagcccrtgggccactgtgctcaggtctctcagagctgtggtccagaatcctacaagcttcccttccctccaagggagattcatttttacttcccttgcaaagacactggtaaacagctcactggatactatgcttgctctggcagctaagtgagaagtgccagtccttaaaactctcaagaagaatgaattgattgagggcttttaggtgtggagacagacaaacaagaacctttggcaatcacacgtctgtcctgcaccgtccttgcttgcctgggtgcccaggcagaccacagcgctccagctg

SEQ ID NO: 18598 - DNA, 601 bp, Human
ggggctggctgtttgccacagtctccactgctccttactcactgccctcctccagccggacccccctctgggcatctgaattttgggcacttgctttaactcaactttctcattttccattatggaaaactatttctttttggctttggaatattttcctcccatgcctgtctgtagagagcttttcctaaatgtcaagaatcttggtttcttcatgacttgaaaagaagcccaagcggcctggcctgagaagggttcaatctgctgtctgcatgcaggggagagcatgactctctctctytgcacaatcccactgtggccccacactgggaactctgagggctaaaactactgccctggggtgaggctggagtctccccaagccactttcagcttgtgggaattggacccaggcactcactctcctcttaaccatcatcttctccaggtctttgctgatgtccgcaaacaccggccttttgtccggctcctgcttccagcattgcagcatcaggcggtacctggtgggaagagcagacaggccaatatgatccaagcagggccaggtctcagaaggacagcccaccacagccatcgcacc

SEQ ID NO: 18599 - DNA, 601 bp, Human
gggcccagcgttttcccggctgtttctcagcactgttctaggaaggccagcaccagtgatcgcttctgttttgaacaaccctgcattctcaggacttgaagttttcatccaagcgagacagtgatgtgaagttttcctatggggtcctaggtcctgcatcccgctatccaagtcggaagaagtgacaactcagtaaatgtgccaatgttaagacaaggcctgtgtgtaaaccccgtgagggcagggctgtgctggtcttgtttatctgcattcccagcctctgagacatagtatgggtccyagcagctgcctgatgaatattggttgaaaatgtgtagacctcacaaactgtacttccaggcacacaggctgactctggccaccccccgatatgctttgtttggcctgcgttcggctctgggaaatttaaatgaattgttaacaataaaaactgggagacaacataaacctcataaaattcagaagacccagcccattcctggctcctttttctgcaggccacaggtactccagcaaggaaccctttggagggggctggctgtttgccacagtctccactgctccttactcactgccctcc

SEQ ID NO: 18600 - DNA, 601 bp, Human
gcatggaatctctccattgtgctaaatctaggaatcatcttaatcatgatgaaaaccaaatgtcttcctaaggaaaggttgcatgatttaaaaaaaatcattctcaagatctcgaatgctgagcccaggcccatcctcggggcccctcttcccctccagccctggaggggcattgacactacccccaggccccccccgcagtctctcattctgaataaggacaggtcatcagggccagcatttttcctactgccttttttgtgtgtgtgcttcatgtttaaatttttttgccttgtttggyggcaactagaaaaatccaacagttcaggtccaatttcatacaccaggtagtaagtgttggacccacacatgtgaacacagaatgttggtggtcactgatggacacagaccaacactgggtgctgctgggcactgaagagaaaggaatgcttaaccactaagactcagagctcttacccggtgtggcatgtctgctaggagggaaaatcaccggctatcagaagtaaaaccaccttggaagttaaaacaaactaccaaaaacgagtctgccacctgggaactgaacacggctcggccaatg

SEQ ID NO: 18601 - DNA, 601 bp, Human
gcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccakgagcgagcacagcgcccgggcgagcgccggggggagcgagcaggggcgacgagaaacgaggcaggggagggaagcagatgccagccggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaa

SEQ ID NO: 18602 - DNA, 601 bp, Human
agcgagctgacttcgggcctctcatccatcaggagccacttttccatatttagccacactttctcctagagatactaacccggccatttatttacttactacaaataattaccctaaagtatgatttaagatcgcagaggagagacactgggtggactgagcgagactgaggagagcagggcaaacgttcttggagggtttactgcccgccaaggacggagaaatagctctggtataactgctacccagttctccccctttctctcccgggcgagccaaatctttttcacgttttcaaccrcaacgcagcgagccaagcatttaacgcgctcccccttctctgccacaggcaagccgggagaggtgggtctcgaggggctccaccgggtgggtagaagagccgcggttgctttaaagacaagaaaagaaggtccagggctccctaggccccttcgatctcagcgcctgcctctctccacgctaaccagggtacgccgacgaccggagggcccacttcgcgcgggtgcggggatcggggtgggagcaagcgttgtcgggttggcggaggcacagaggcggggcagggagctgcgggcctgcc

SEQ ID NO: 18603 - DNA, 601 bp, Human
cggcggccgtcgagtgagcagggctcagatgagactacgttacactagctgttaggcgcctactgtgtgctaggcttcaggcgtgtttttccgacctgacagcctctggctgtgcagcagcatctccagcctagcctcgggcccaggacatttatttatcaagaggggatctccctccagagttgccgcaaaagtgcccagaggttagaggactataaagccacagtgtgctggggaggctgtggacctactttcaagaatctcggtgccggggttaagaactcatctgaacgcaatggcrgcgggagtgggtgggtggagaggacttttctctttgggaagctgtatgcaaagaccacccttcagtgcttgtccattagttggagctcggtaaacatttgtagaacatcagcgccaacgtgcccctgtcctagacagcagtttccctcggttttctgtaattctgaaacgaacgggctcttggcctagggtgtttcaggagcgagctgacttcgggcctctcatccatcaggagccacttttccatatttagccacactttctcctagagatactaacccggccatttatttacttacta

SEQ ID NO: 18604 - DNA, 601 bp, Human
acttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccargagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtattggagagaggcctggcctgagatatccgagctgacaccagtgatgtttc

SEQ ID NO: 18605 - DNA, 601 bp, Human
gtctttcatagatacagaaggcaagacccagagatggaaagcaatctgcctaaggtcacacagcaagctgaaagtaggtctggttctggaactcaagtctcttgcctgtctagcaggggcagcagttggatccttgttccccggggccatttccaaaccaatgcttctcatattgagtctagtttagagggccctagttccgaggctctgggctgtagtcttgggttgggctggcctggctgggtgtctggtcaacccagttgctgccatagccgtgaccaccaggaaggaccttagaacmggccagtctatcaggtccaggatgatctggagtgccgaggctggacccttttcacaggagagagaatgcagtcatgttcccctcatgttgcctccctaggctgctcctctccgcactgtcagccacctcaccttctgcaaggtgtggcggggcagctggctgcacgggccaaagacaggtccatggtccttggttgtgagctgctccagttgggcacggagctcctgttcctcttcaggtaccatgcggaacgtgcccacctgggcagagaaaggaaaaagaggaacagccaaccgcatc

SEQ ID NO: 18606 - DNA, 601 bp, Human
catggccctgaattaccatttggagaaggaagaagtaggaaaaggaaaatcattagcctgcagagggcccactcagaccccatttccgtccaccagtgcccaagattcgatttcttgagggaaccaccccctttttttttttctttctttcttttttgagatagagttttgctcttgttgcccaggctggagtgcaatggcacgatctcagctcaccgcaacctctgcctcctgcgttcaagcgattctcctgcttcagcctccccagtagctgagattacaggcatgcgccaccacgccyggctagttttgtatttttagtagagatggggtttctccacgttggtcaggctggtctcaaacccccgacttcagatgatctgcccgccttggcctcgcaaagtgctgggattacaggcgtgagccaccgcaaccggccgatgatttcttgaggcatcctgtcttcatccagccagcagtgccagagcggttctgtccccggggttcattcccaggtctgacaccatcttcagttccactgcacatgaggcttaggtaactgccctgagagaggcactatccaccttcctgcagcattcca

SEQ ID NO: 18607 - DNA, 601 bp, Human
gtgcgtctgtaatcccagctacttggaaggctgaggcttgaggatcgctcgaacccaggaggcggaggttgcagtgagctaagatcatgccactgcactccagcctgggtgaccagagcgagactccatctcaaaaataaataaataaaataaaataagtttgtagcagtttttttttttaaattaaaggaatctttttcaggctcagtggcgcatgccaaagttctcccaagacaaaccctaattccccaacttggggcagcccccttaacggctcagacaagcaaaattgcgtacatatgagcacaaagaactcgggctcctaaatagattggaacctgtgctttccagaatctcttccagcctatagtccactaatccctgttctctctgttgctctcagcatttagcatgtggcagggcagcccccagctcatggcacacagctgttacccccacttggcacttggcagggatacccaggaagagccatgtattattgaccatcaagctccacctgcaaagctactgggttttccagctgccctggcacatcctaggaattctctccctgcctggaaagggctaggtggcaggtggc

SEQ ID NO: 18608 - DNA, 601 bp, Human
cgtgcgtctgtaatcccagctacttggaaggctgaggcttgaggatcgctcgaacccaggaggcggaggttgcagtgagctaagatcatgccactgcactccagcctgggtgaccagagcgagactccatctcaaaaataaataaataaaataaaataagtttgtagcagtttttttttttaaattaaaggaatctttttcaggctcagtggcgcatgccaaagttctcccaagacaaaccctaattccccaacttggggcagcccccttaacggctcagacaagcaaaattgcgtacatatgagcacaaagaactcgggctcctaaatagattggaacctgtgctttccagaatctcttccagcctatagtccactaatccctgttctctctgttgctctcagcatttagcatgtggcagggcagcccccagctcatggcacacagctgttacccccacttggcacttggcagggatacccaggaagagccatgtattattgaccatcaagctccacctgcaaagctactgggttttccagctgccctggcacatcctaggaattctctccctgcctggaaagggctaggtggcaggtgg

SEQ ID NO: 18609 - DNA, 601 bp, Human
gcgtgcgtctgtaatcccagctacttggaaggctgaggcttgaggatcgctcgaacccaggaggcggaggttgcagtgagctaagatcatgccactgcactccagcctgggtgaccagagcgagactccatctcaaaaataaataaataaaataaaataagtttgtagcagtttttttttttaaattaaaggaatctttttcaggctcagtggcgcatgccaaagttctcccaagacaaaccctaattccccaacttggggcagcccccttaacggctcagacaagcaaaattgcgtacayatgagcacaaagaactcgggctcctaaatagattggaacctgtgctttccagaatctcttccagcctatagtccactaatccctgttctctctgttgctctcagcatttagcatgtggcagggcagcccccagctcatggcacacagctgttacccccacttggcacttggcagggatacccaggaagagccatgtattattgaccatcaagctccacctgcaaagctactgggttttccagctgccctggcacatcctaggaattctctccctgcctggaaagggctaggtggcaggtg

SEQ ID NO: 18610 - DNA, 601 bp, Human
ccagcactttgggaggccgaggtgggcggatcacttgagctcaggagtttgagactagcctggccaacatggtgaaaccccgtctctactaaaaatacaaacattagctgggcatggtggcgtgcgtctgtaatcccagctacttggaaggctgaggcttgaggatcgctcgaacccaggaggcggaggttgcagtgagctaagatcatgccactgcactccagcctgggtgaccagagcgagactccatctcaaaaataaataaataaaataaaataagtttgtagcagtttttttttttaaattaaaggaatctttttcaggctcagtggcgcatgccaaagttctcccaagacaaaccctaattccccaacttggggcagcccccttaacggctcagacaagcaaaattgcgtacatatgagcacaaagaactcgggctcctaaatagattggaacctgtgctttccagaatctcttccagcctatagtccactaatccctgttctctctgttgctctcagcatttagcatgtggcagggcagcccccagctcatggcacacagctgttacccccacttggcacttggcagggatacc

SEQ ID NO: 18611 - DNA, 601 bp, Human
aacatgccacaaaatctctatcatcgaaacagtatgatattggagtatgaatagataaagagaccaatggaacagaatagaaagtccagaaatagaccaagcacatacgaaaatataaaacatgataaagatggcatttcaagtcattgaaaaaagatggactttttaataaattgtgttggcacaactagatagcattatctaaaattagtttgggccaggtgcggtgtctcatgcctgtaatcccagcactttgggaggccgaggtgggcggatcacttgagctcaggagtttgagacyagcctggccaacatggtgaaaccccgtctctactaaaaatacaaacattagctgggcatggtggcgtgcgtctgtaatcccagctacttggaaggctgaggcttgaggatcgctcgaacccaggaggcggaggttgcagtgagctaagatcatgccactgcactccagcctgggtgaccagagcgagactccatctcaaaaataaataaataaaataaaataagtttgtagcagtttttttttttaaattaaaggaatctttttcaggctcagtggcgcatgccaaagttctcccaagac

SEQ ID NO: 18612 - DNA, 601 bp, Human
tgcaaaagtagctagaaaagccccccaaaaagcagatcactaaggacaaaactagccctaacagattaaacatgccacaaaatctctatcatcgaaacagtatgatattggagtatgaatagataaagagaccaatggaacagaatagaaagtccagaaatagaccaagcacatacgaaaatataaaacatgataaagatggcatttcaagtcattgaaaaaagatggactttttaataaattgtgttggcacaactagatagcattatctaaaattagtttgggccaggtgcggtgtctyatgcctgtaatcccagcactttgggaggccgaggtgggcggatcacttgagctcaggagtttgagactagcctggccaacatggtgaaaccccgtctctactaaaaatacaaacattagctgggcatggtggcgtgcgtctgtaatcccagctacttggaaggctgaggcttgaggatcgctcgaacccaggaggcggaggttgcagtgagctaagatcatgccactgcactccagcctgggtgaccagagcgagactccatctcaaaaataaataaataaaataaaataagtttgtagc

SEQ ID NO: 18613 - DNA, 601 bp, Human
aacaggctgtaagatctaacccgcaacaataattaaggcttgaggtcctgaggggagagctaattggtacattcttcactggggtaatttgctgcaggctttgatctcggacattccacttctgtgaatgtataccaagaaaacaagttcaaatgtcacatccatgcttagaggccagaaggtttatcccagtactcttgcaatagtgggaacattggagacaacctaaatgtccaacaatgggaactggtgaaattatggtacatttatgccatggaatactctggaacaattaaaaacmatacagaagactaataatacaggaaaatgtgcatgatatattattgtagaatataatcccattattgtaagaaaaatgtgtgggctgggtgcggtggctcacgcctataatcccagcactttgggagaccgaggcaggtggatcacctgaggtcaagaattcaagaccagcctggccaacatggtgaaaccccatctcaactaaaaatacaaaaaaatcagctgagcatggtggcaggcacctgtaatcccagctactttgggaggctgaggcaggagaatcacttgaacttgagaggca

SEQ ID NO: 18614 - DNA, 601 bp, Human
gtctggcctctgccgctttattgctgtgtgacctcgagatgtctcttaaatctctgagccttcgtttccaggtttgaaaaatgaagcagggaaggagggagagaatgctctcaaggagtcgatggaagaatgaaagggaatacttggcaaactgtcaatcactatgcaggtgcttatggttgggactgtggctgtcactgctctttatggcgcgaggtggtccaacttctcagttccctgcaagcaccatgaaaggaggcccagcctctcagcctccccagctgtgggaggctgccgtgcracagaactctaagcctcacctggagcatgtccaccatcttcctgagatctgaagtccggagactagcagcctgctgcatggtaaagcccttgaagttctcaatgatgcagaagccattgatttgagtttcctcattctccagcagcttctccaggatgaagcaatatgcctgcaagatcttgggcacagagagaacaggctgtaagatctaacccgcaacaataattaaggcttgaggtcctgaggggagagctaattggtacattcttcactggggtaatttgctgcaggctttgatct

SEQ ID NO: 18615 - DNA, 601 bp, Human
tttctcggggtgaatccacattcaaagagaggcagtgcgacatatgtggacagacaacatgggattccaggtcagaagatgcaggttcaagtctggcctctgccgctttattgctgtgtgacctcgagatgtctcttaaatctctgagccttcgtttccaggtttgaaaaatgaagcagggaaggagggagagaatgctctcaaggagtcgatggaagaatgaaagggaatacttggcaaactgtcaatcactatgcaggtgcttatggttgggactgtggctgtcactgctctttatggygcgaggtggtccaacttctcagttccctgcaagcaccatgaaaggaggcccagcctctcagcctccccagctgtgggaggctgccgtgcgacagaactctaagcctcacctggagcatgtccaccatcttcctgagatctgaagtccggagactagcagcctgctgcatggtaaagcccttgaagttctcaatgatgcagaagccattgatttgagtttcctcattctccagcagcttctccaggatgaagcaatatgcctgcaagatcttgggcacagagagaacaggctgtaagatct

SEQ ID NO: 18616 - DNA, 601 bp, Human
actacagttcagctggcaggagatgttttcagaaggctgtgttctcagcttgggcctgggggccaaagagctgctcagcaacggccttgccatcatacttgggcagcgtgcccccgaagtcagagggcaggatgttctcatcgatctcctggtagaaaccagaaaggtcatccccgtggacaaagacctgcagggaagcaagggagacagaactgagcaggaggaggtgccctaaggatgagggttgagggaggaaaggggcaggaggacaaagccccatcatgtgcagtctttgcctggygacacctctctccgcaggtctccatgttgggtgtcagtgggatccacatagctcaggaccatggtagagtgtgaggagggctcaggtgaggccccaccctcagccctcttgtctcattgtctgggcggcccacgtactcaccctctcaagcagcttgctcttcaagaagggcttgaccacattgtaggtcgtggtgaagtaccatggctggtggatgaagtggatggctttgaaccgggctgggaaggaatcctgcggtgacagagagataccccgttccccatggccccagtgacctca

SEQ ID NO: 18617 - DNA, 601 bp, Human
tgcctagaggccaccaggactgctgcgtttgccaaatcatttgaacatatatcctctctcttttatcttcttttattgcattttgggggcgaatagggggatattttaacccgggctccttgcctgttttcacagactctaagtcgtaaaactctgttacaaaggaaatgactgagaaaatgaattcgagtctttgaaatacaaccttacacaaaaatcactgtcttaaagcttcaagggcaggtggaaatataactatccccagttcttcttgttcaagggaattccccctcctttattmcccatcccccaacttgagaacagggtgacacctgagctcactcgggcttagggagtctaaggggggaccacagtcatctcaagcagccctttcctagccttgggtccaggacagttgaggagaggcccagagattctaactacagttcagctggcaggagatgttttcagaaggctgtgttctcagcttgggcctgggggccaaagagctgctcagcaacggccttgccatcatacttgggcagcgtgcccccgaagtcagagggcaggatgttctcatcgatctcctggtagaaaccag

SEQ ID NO: 18618 - DNA, 601 bp, Human
gcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaacygctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggagg

SEQ ID NO: 18619 - DNA, 601 bp, Human
taaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatragaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcat

SEQ ID NO: 18620 - DNA, 601 bp, Human
tttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccrgacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggtttt

SEQ ID NO: 18621 - DNA, 601 bp, Human
aataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatcttyaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacat

SEQ ID NO: 18622 - DNA, 601 bp, Human
taaagaaaaatatataaacatatgtttgcatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactaygcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccaca

SEQ ID NO: 18623 - DNA, 601 bp, Human
gctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccraattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagaca

SEQ ID NO: 18624 - DNA, 601 bp, Human
aaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaatwatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagact

SEQ ID NO: 18625 - DNA, 601 bp, Human
agaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagyatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaa

SEQ ID NO: 18626 - DNA, 601 bp, Human
agaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatacttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaag

SEQ ID NO: 18627 - DNA, 601 bp, Human
gcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatacttaagaaatgcatagcacyctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcatac

SEQ ID NO: 18628 - DNA, 601 bp, Human
cctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatasttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagt

SEQ ID NO: 18629 - DNA, 601 bp, Human
agtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacasatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgattttt

SEQ ID NO: 18630 - DNA, 601 bp, Human
ttcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgaytcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacattt

SEQ ID NO: 18631 - DNA, 601 bp, Human
ttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatkactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggg

SEQ ID NO: 18632 - DNA, 601 bp, Human
ttggcatcccaaagcactgggattacaggtgggagccacagtgcctggcctcattcttctttttctttctggttctcaggccagatactctcaattgagtcttcaagttttctgattcctttgctagttcaaatttgtcaagtccctctagtaaacgtctcactttagctattgtactttttaactctaacagttttattttttcataatttctcttatctatttgataactgttcatatactttaaattcttcaggcacaggttttttctttgaatatcaaaatattagctggtttaaartctttgtctagtaagtccaatgtttggtcttcctaagcaatatttgctattgactccccccaccattatatgagccatattttcctgttttctttgactgttttgtatatttgttgttgttgttaaaaaccggacattttaagtagtatgacaattctggaaatcacattcttcctttcccagtgtttgttgtgctctatgtccagaagtcttgagaaatcaaagggtttcttgtcagaagatctcatgacagtgaaaagaataaaaggatggaggcaaaaattgacctaattttctggc

SEQ ID NO: 18633 - DNA, 601 bp, Human
gcaagctccgcctcccgggttcatgccattctcctgtatcagcctcccaaatagctgggactacaggtgcctgccaccatgcctggctaacttcttgtatttttagtagagacggggtttcaccgtgttagccaagatggcctcggtctcctgacctcatgatctgcctgcctcagcctcccaaagtgctgggattacaggcgtgagctactgtgcctggccttctgaggaattttttgttttaaaattattgcaaaatatacataaaacaattttaaacattcaaaagtgtgtaattcartgcattaaatacattcaaaatgttgtacaaccatcaccattatcagtttctagaacttttatcatcccaaacagaaaatctgtacccactaaacaataattcctcacttccaccactaacccctgatatcctccattctattttcagcctctataaatttgcctattctaggtacctcatataagtggaatcataacaatatttgtccttttgtgtctgcctcatttcacttagcttaatgttttcaactttccttcatacatacaatagcatgtatgagatcttactccttcttatgac

SEQ ID NO: 18634 - DNA, 601 bp, Human
tagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcaatttattcytaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgtatcagcctc

SEQ ID NO: 18635 - DNA, 601 bp, Human
gtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcartttattcctaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgta

SEQ ID NO: 18636 - DNA, 601 bp, Human
gccatgattacactccagggtgaactccagcctgggtgacagagtgagaccccgtctctaaatgtaaaacaaaacaaaaaaaagaaaatcagttgattagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatasccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcaatttattcctaagtattttgttcttttgatattattgtaaactgaagtgtttgcttaatttcattattggattcttcattattagtgtatagaaatacaatagatttgtgtatattgatcttgtatcctaaaac

SEQ ID NO: 18637 - DNA, 601 bp, Human
gtgttatattagaaaccattgcctggtctatttattccagcaccacatgctaaaaagactattctttgcttcattggattatcatggaatctttgttgaaaaatcaactgattgtaggctgggcgtggtggctcacatctgaaatcccagcactttgggaggctgaggtgggagttgagcccaggagttcaagtttgccttgagccatgattacactccagggtgaactccagcctgggtgacagagtgagaccccgtctctaaatgtaaaacaaaacaaaaaaaagaaaatcagttgatwagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatctta

SEQ ID NO: 18638 - DNA, 601 bp, Human
cactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattatgaatagtgatgctatggacatttgtgtacaagtttttataaaaacatgttttcamttctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcattttttttttttttttgcatttccctgatggctaattttgttgagggtattttcatgtgcttattggac

SEQ ID NO: 18639 - DNA, 601 bp, Human
ccactagcaataactgcgcatggcccctccctctctgtcctcagtctctggcaaccactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattaygaatagtgatgctatggacatttgtgtacaagtttttataaaaacatgttttcaattctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcatttttttttttttt

SEQ ID NO: 18640 - DNA, 601 bp, Human
cctgccagctatcttacacagcctgatgaaaacctgaaaggataaaggagaaaatgcagcctaggcagaaaaacactggcagaatctgtgaaccacaattaagcttatttcaatcttttctgatgctttaataggcaggaatgtgtgtttccattgccagagcctttctccgtctggtgaggggaaagaggctcaaatttttaggcatggtaaaagctttaatttgttaaatgtaagtattaaaactatacaatttttaaataacagctttgtcgagatataattcacataccataaaacttttttttttttttttttttttgagacggagttttgctcgttacccaggctggggtgcagtggtgtgatcccggctcacttcaacctctgcctcctgggttcaagtaattctcctgcctcagcctttagagtagctgggattacaggtgcccaccaccacacccagctaattttttgtatttttagtagggacacggggtttcatcatgttggccaggctggtctcgaactcctgacctcaggtgatccacccatcttggcctcccaaagtgctgggattacaggtgtgagccactgagcc

SEQ ID NO: 18641 - DNA, 601 bp, Human
agcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtyctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctccccacatatctcagagtttatgatgtcaatggg

SEQ ID NO: 18642 - DNA, 601 bp, Human
aagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattagtaatgtcagttccttaagttgaccttgtcttgggtttgagaacattggtttgctgttgcagttgttacaaacagcatctactgtaaaaatacrttgcaaccatgtttgtgaggcattaggccaatggggtggggggtatttggaaggggtttctttaacctgctgctctctgtagaaggaaaactctcaggatttacatactctgcctgcaaaggatcagggagggcaatgatctttatttgtgggcaataccattataggtcactgatgtgctgttttctttgtttgccagttaagtgtgtatggaaactccagttggcactttgacgaagtgcgaaaccaatgttattttcatcagtttatgaaagagcaacctgatttaaatttccgcaa

SEQ ID NO: 18643 - DNA, 601 bp, Human
cagcatctgcctgtgttgccatggacatgtggactcagtgtaactacgtcttccaactcaaaaagatttatgtaaaatctcccagttgttaaatgttttccagatgttctctttaacatgaaatggacaaaaggcctaggacagagccccatgaaactctcacattcaagggcccacagcgttgacttaaggagtggccagagatgtgggagggcagccgggagagtcataccatggggccataaatgtgagcatttccagacagaggagaccagcgacatcgtcaactattgctgagtaccaacacttgaagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattagtaatgtcagttccttaagttgaccttgtcttgggtttgagaacattggtttgctgttgcagttgttacaaacagcatctactg

SEQ ID NO: 18644 - DNA, 601 bp, Human
atcccccacagaagtataaaaaatacacattctcattaattcctgatattgcccaactttgtaatttttatttaaaaattattattattttgtgtcagggtctcattctgtcacccaggctgaagcatagtggctcaatcatagcttactgcagtctcgagctcctaggctcaagcaatcctcgccacctcagcctccttagtagctgggaccacaggcacacaccatcatgcgtggctgagtttttttatttttttgtaaatatgggctctcactatgttgcccaagctggtcttgaacytctggcctcaagcagtcctcccgcttcagctctcaaagtgctgtgattactggcatgagctaccatgcccagcccagacttaaaacaatattgccttgagatcttaattttatatttatttaattactaatgatgatgtgtctaattcctaatacagtaattatctaattcctaatgatgttgaacatcttttcttacatttattcatttaagtgtccatttctgtgaaacacctctttatggtttctttcccctactttcttttgaattatttatccctttgaaattgctttcttcagt

SEQ ID NO: 18645 - DNA, 601 bp, Human
aggatatcgcatgctcagctctacaggatagtgtcaaattcattatcaaaatggttgtaccaatttatatcccccacagaagtataaaaaatacacattctcattaattcctgatattgcccaactttgtaatttttatttaaaaattattattattttgtgtcagggtctcattctgtcacccaggctgaagcatagtggctcaatcatagcttactgcagtctcgagctcctaggctcaagcaatcctcgccacctcagcctccttagtagctgggaccacaggcacacaccatcatgygtggctgagtttttttatttttttgtaaatatgggctctcactatgttgcccaagctggtcttgaacctctggcctcaagcagtcctcccgcttcagctctcaaagtgctgtgattactggcatgagctaccatgcccagcccagacttaaaacaatattgccttgagatcttaattttatatttatttaattactaatgatgatgtgtctaattcctaatacagtaattatctaattcctaatgatgttgaacatcttttcttacatttattcatttaagtgtccatttctgtgaaaca

SEQ ID NO: 18646 - DNA, 601 bp, Human
taatcatcgatttcataccaaaccacacgagtgataaacatatttggtttcaattgagtcggacacggacaggaaaatatactgattattatatctggcatgactgtacccatgaaaatggcaaaaccattccacccaacaactgggtaagtatcaacctgtctgacttacaaaggggtaaaaggcagatatgtagtgattgaactgatttagtaaaacccttttgagggaaaaatgaatgaatatagtttatcggaagggggcaagtttctgaaagaaatagaaataaggtttccagttrttatttactcaggcttccaattattatttagatttctgatttcatcatagagatgatgtgttctagcaaattcaaacctattttctctccttccacccttccttcacttcctacccggtccaacttggattccatgtcccattagtttgataaccatttttctactatccatacccctttgcatttttttttcttgagatgtagttttgctcttgtctcccaggctggagtgcaatagcacaatctcagctcactgcaaactccacctgggttcaagcaattctcttgcctcagccttac

SEQ ID NO: 18647 - DNA, 601 bp, Human
gattttctctttcttttttttttgagaaagggtcttgctctgtcgcccaggctagagtacagtggtgtgatcttgagtcattgtagcctccgattcccaggttcaagagattctcctgcctcagcctcccaggtagctgggatcataggcatgtggtactgtacccagctaatttttgtatttttaatagagacggggttttgtcatgttggccaggatggtctcgagctcttgaccttaggtatcctcccaccttggcctcccaaagtgctgggattacaggcgtgaaccactacacccracctaatttgatattttttgtagagctagatcttcctatttgaattatactcaaattcaacaaaattctaagtatttttgccttcatgtaaatatttctatcttaggcatatttgttatattttttgtcctttaactaaaacaaagtagggtttattcatgactttgacttttttcttcaggtattcaagataaactggactacatcacagctttaaatataaaaactgtttggattacttcattttataaatcgtcccttaaagatttcagatatggtgttgaagatttccgggaagtt

SEQ ID NO: 18648 - DNA, 601 bp, Human
actggtctcgaacacctgagcccaaacaatctgcccaccatggcctcccaaagtgctgggattacaggcacgtgccaccatgcccggcccagtataaaaatattaatgagatttttacattctttctttttgtacagggtcttcaaaatccaatacatgttgttcccttacagcacatctcaattccaaccagccaccctgcaagtgctcagtagccacatgtggctcttagacagaacagtgcagtgtagaccacatgaccgacaggggccatgcgttactctgctctgttccttgacayttagcccagcagctggcatagattagctgctcaaaaaccatgtgtagaataaatgaacaataccacagtcttggttttaaatataaaatatgagtaagtcacagagattttttttaatgctatgttaaatgtcatcgattactgatagatgactaatttgattttctctttcttttttttttgagaaagggtcttgctctgtcgcccaggctagagtacagtggtgtgatcttgagtcattgtagcctccgattcccaggttcaagagattctcctgcctcagcctcccaggtagctggg

SEQ ID NO: 18649 - DNA, 601 bp, Human
acccctgcctgcagacacttccgagaccaacaccgcccaaaagaaatacaatgggagccacataagaaattgtaaattttgtagtagccacattaaaaaaaggaaaaaagaagcaggtgaaattaattttcatatgttctgtttaatccaatgtatcatttcaacacataatcagtataaaaatatatacatattgttatttttttttgtattttaagacggggttttatcatgttacccagactggtctcgaacacctgagcccaaacaatctgcccaccatggcctcccaaagtgctgsgattacaggcacgtgccaccatgcccggcccagtataaaaatattaatgagatttttacattctttctttttgtacagggtcttcaaaatccaatacatgttgttcccttacagcacatctcaattccaaccagccaccctgcaagtgctcagtagccacatgtggctcttagacagaacagtgcagtgtagaccacatgaccgacaggggccatgcgttactctgctctgttccttgacacttagcccagcagctggcatagattagctgctcaaaaaccatgtgtagaataaatgaac

SEQ ID NO: 18650 - DNA, 601 bp, Human
gtgttgaggttgcactccttctcagaccccgtgcactgacaacatttatcacctttttaaattaattgatgcatttacttatttatttatatttattatttttttttttttgagatggagtctcactctgtcacctaggctggagtgcagtggcacaatctcacctcactacaacctccgcctcccaggttcaagcaattctcctgcctcagcctcccgagtagctgggattacaggaatgcaccatcgtccccagctaatttttgtattttttagtagaaatggggtttcaccatgttgrccaggctggtcttgacctcctgacctcaagtgatccacctgtctcagcctccctaagtgttgggattacaggcgtaagccactgtgtcctgccttctcacccttttttagacatgccctgtctattcttgctccctcctttcctttgctgtgcctggaagcccttcactctgatcccctttgcccacaccatcctggaccttctctgtccttaccctcaggggtcatcagcttcctctgcccctgggggtcaagggccaatgccctgatgcccttaaagcactttctgcagctcttcctt

SEQ ID NO: 18651 - DNA, 601 bp, Human
ctccttctggataggtccaacattcctgtaaacatggtggtttctaatcagctctgatgtttgtcatttccaatacctgttcttggaggaatgttttacttcctgcaatccataggcatttgtctttgaggttgaagggatttcattgttgttattatgaagatcccattccagctttgagtctggttttggtgattgccctctctccttctaaaatgtggggtgggatcccttgtttactttctccagccactttgttttcatcctcatgttcctttgtgcctcatcataagatatattktgttgctgtgctggcttagatcaaaaccctcttgctgcctgttgataccgtgtgagatcttgcagctacccatatgggggaactggggtacagagacagaaataagcagcctgtcaggccaggcgtggtggctcacgcctgtaatcccagcactttgggaggccgaggcaggtggatcacgaggtcaggagattgagaccatcctggctaacacggtgaaaccccgtctctactaaaaaaatacaaaaaaaatcagctgggcgtggtggcgggtgcctgtattcccagctatttgggtgg

SEQ ID NO: 18652 - DNA, 601 bp, Human
acatacttcagagtaaaattatgccagatggcaggcatacactgggaacttctgagcaaattggttggtatggtcactctacttcaaggcaacaataggaaacaaataaggaaactaacaaactaatgttttacaatgataattggtttgaagaaaacaaaacaggatgatatgaatgtggaaagtaggaatgggcttaatgtatctttaaaatgctacaaatgaattcttgaaacctgcagctttctttaatcactagtagaaggcttttctttttcacgctcctatcattctctctctcctttttttttttttttttttttgtggatggagtttcactcttgttgcccaggctggagtgcaatggcataatctcagctcactgcaacctccgtcacctgggttcaagcaattctctcggctcagcgttccgagtagcagggattacaggcatgcaccatcatgcctggctaattttgtatttttaatagagacgagggttctccatgttggtcaggctagtctcgaactcctgacctcaggtgatttgcccccccttggcctcccaaaactctgggattacaggcatgagccaccgcat

SEQ ID NO: 18653 - DNA, 601 bp, Human
aaaccagaacatacttcagagtaaaattatgccagatggcaggcatacactgggaacttctgagcaaattggttggtatggtcactctacttcaaggcaacaataggaaacaaataaggaaactaacaaactaatgttttacaatgataattggtttgaagaaaacaaaacaggatgatatgaatgtggaaagtaggaatgggcttaatgtatctttaaaatgctacaaatgaattcttgaaacctgcagctttctttaatcactagtagaaggcttttctttttcacgctcctatcattctctctcttctttttttttttttttttttttgtggatggagtttcactcttgttgcccaggctggagtgcaatggcataatctcagctcactgcaacctccgtcacctgggttcaagcaattctctcggctcagcgttccgagtagcagggattacaggcatgcaccatcatgcctggctaattttgtatttttaatagagacgagggttctccatgttggtcaggctagtctcgaactcctgacctcaggtgatttgcccccccttggcctcccaaaactctgggattacaggcatgagc

SEQ ID NO: 18654 - DNA, 601 bp, Human
tgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccayccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttct

SEQ ID NO: 18655 - DNA, 601 bp, Human
ctcagcctccaccctagcggaccccgcgccagcacttgttaacccgttaccacctgttgacttggcctccctgcacttccatttcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttcmttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcaccc

SEQ ID NO: 18656 - DNA, 601 bp, Human
ctatgcctgtggatgagagtgtgtgtctattcttttccaaggaattcaaagtggtttgtaaaataacactcaattgaatacagttcaagttacagaaaagagagtcagagtttgggtgtataccccaaggtggaactttaggaacaagtaggtaataagcatcaatttctttattcttttagtatgtgtgtcatttgatggatgaactatacaaatgtttctgagagattagtagcagccctcaagcacttttctctgtcctcagtgttcacagagaccaaatgatcacatgaagtaactytatcaaagactaatctgttctttccattttagggccacaaataggtctctttatacacatcacaggggcatatcaaagtcatattttaaaaatcagaatggattaaaattgacaaacatttttcatgatggtaaaagaaatcacagatccatcaatgattttgattcttaagaatattcttgattattttttaaaagactatgagtttttaaaactgttctctgaaatagaattatgtaggtacagaaacattcatttttaaaaagtcataaatattagggcaaaattaaaaatctggaa

SEQ ID NO: 18657 - DNA, 601 bp, Human
gtctaaataatgaggcagtggcacatgcctataatcctggctactcaggaggctgaggtgggggcatgacttgagcccaggaattcaaggatgcagtgagctatgatagcatcactgcagtccagcctgggcgacagagcaaggccctgactctaaaaactgaaaataaaaaactgaaaaaaaaatgtgttgtgaactttgatgagatgcattcatataaatcatcccaagtataaaatttcccccactgatctatgttgaagagatagtgtagctttctttcactttgcagacatagacrgagcacatgtttcagctaggcaactcaatgtggtcatcctccacctgactgttcatcctgtgactcttactgctatagttgccaccagagaatgtgaaaaagctcagaggagaaagaagagaggaagaatgggcaatgtgtctgtgttgagtgtgtgtgtctatgcctgtggatgagagtgtgtgtctattcttttccaaggaattcaaagtggtttgtaaaataacactcaattgaatacagttcaagttacagaaaagagagtcagagtttgggtgtataccccaaggtggaacttta

SEQ ID NO: 18658 - DNA, 601 bp, Human
gccaagacatagatctcatggcttaaaatacgtgctatctgattccttacccaaaattttgccaatccctggactatactattgtgtcttcacatggtcattttttatcttaaattctgtgtgtaagttcaactctcaattagaactcagaatgtaaccaataaaaaatttatagaatgtgctatgtgttaaatgccatgagagacattgaaaatgatttcaatgaacagttaaaaggtaactaagtcaaagaaacttgtgcttgcagaacttggaaatctgaggacaaacggaaagataytgataaactgcatgtcactgattcagtattccaaattccatctaaaaaggtataattcacacttcataaaatatttaaaattaactcatcaattttttcctcttgtaacaccctatttcaatgactttctgaaaatatgttttaaggtagaaaaaaagtaatttaattgaagatttgtgggaagattaagtcaacataagaaaagtctaaataatgaggcagtggcacatgcctataatcctggctactcaggaggctgaggtgggggcatgacttgagcccaggaattcaaggatgcag

SEQ ID NO: 18659 - DNA, 601 bp, Human
aaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgmagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattgagacatagatttttttttctttt

SEQ ID NO: 18660 - DNA, 601 bp, Human
aaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcycacaaaaactgcaaggtagttgcagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattg

SEQ ID NO: 18661 - DNA, 601 bp, Human
agataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaayctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccctaaaggtgataagtgatgtagtctcaactaaaactttggtttg

SEQ ID NO: 18662 - DNA, 601 bp, Human
tttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcrgccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccct

SEQ ID NO: 18663 - DNA, 601 bp, Human
tttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttmttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaac

SEQ ID NO: 18664 - DNA, 601 bp, Human
actcagttatccctgttgtgcatgttatgttgactttgtcagcttagtgaggtgaagcacattttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtaygcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcct

SEQ ID NO: 18665 - DNA, 601 bp, Human
gaagtgacagattgagaccctatctcagaaaaaaagaaaaaaaaaagaatgccactaaaccacaccactagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacrtacacctacaaaataggtgccaagtggttatgtgactagcaaggtataaatgctgtagggacaccagagctgatggcttccctgagcggaggtgtcccacacacaccctatcttgtcttcccaacctcaaaagagcacagagtggagaagaaggtcagaagtaatacctgagagttttgagaactcagttatccctgttgtgcatgttatgttgactttgtcagcttagtgaggtgaagcacattttgacttgagaatttgctatcaatttcactgatggccactgctgcttattgagca

SEQ ID NO: 18666 - DNA, 601 bp, Human
tacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcatgcctgtaatttcagctactcaggaggctgagtcaggagaataacttgaacccaggaggcggaggttgcagtgagccgagatcacaccactgcacttcagcctggagtgaartgacagattgagaccctatctcagaaaaaaagaaaaaaaaaagaatgccactaaaccacaccactagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacgtac

SEQ ID NO: 18667 - DNA, 601 bp, Human
aaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcrtgcctgtaatttcagctactcaggaggctgagtcaggagaataacttgaacccaggaggcggaggttgcagtgagccgagatcacaccactgcacttcagcctggagtgaagtgacagattgagaccctatctcagaaaaaaagaaaaaaaaaagaatgccactaaaccacaccactagaacttataattaattattttttataaatatcttatgcaacatattttatatttttgtagtgcaaccccaaagagataggtatataacttaaaaaaacgagataaatgagagtcctcataag

SEQ ID NO: 18668 - DNA, 601 bp, Human
atagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaaaacagggttaataggggtggaaaagtaggtagaaaatagggacatataggccataggatccaagcaagtagcagatgtgtaagatgaamaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggt

SEQ ID NO: 18669 - DNA, 601 bp, Human
actccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaawacagggttaataggggtggaaaagtaggtagaaaatagggacatataggccataggatccaagcaagtagcagatgtgtaagatgaaaaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatac

SEQ ID NO: 18670 - DNA, 601 bp, Human
tttaaaaacactaaaactaatatttatttatttagcaaaccagaatttaaaacattagaaattaaagtgttttatttctttgtaaaaaacttatcaagagtaatgtaaatagtgtttgtcttcttctcattgtataacttcctatacggagtggacatgttttttatattttacagaattgtcatactctattctaaatttgaattaggagtttgagaccagtctgggcaacagagtgagatgctatatctacaaaaaatattaaaaattagccaggcatggtaatgtatgcctgtagtcycagctacttgggaggccaaggcaggaggatctcttgagcccagaagtttgaggttacagtgagctatgataacaccactccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacag

SEQ ID NO: 18671 - DNA, 601 bp, Human
taaatcaaagacaatgagatagaagtagagagtagaattatgattattagaggctgacaacggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacaytgtatacatgtatggaaatataattctggatcccacaattatatacaattattacatattcactaaaaataaaagaaaaattaaaaatagagtagcatatgacccagcaatccctcttctgggtgtagatccacaagaaaagatttcagcatatctgtttccaagggccccaacacagtggctcttgcttggaatcccagtgctttgggaggctgaggcaggaagatcacttataactatataaggaattttaaaaacactaaaactaatatttatttatttagcaaaccagaatttaaa

SEQ ID NO: 18672 - DNA, 601 bp, Human
gtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggctgacaasggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacattgtatacatgtatggaaatataattctggatcccacaattatatacaattattacatatt

SEQ ID NO: 18673 - DNA, 601 bp, Human
ttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagkggctggtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggct

SEQ ID NO: 18674 - DNA, 601 bp, Human
tgatatactgacagtgtatttaacataaggtgtatttttcagcatcgcttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttygtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagtggctggtgttatttaactaaccatagtacctggaa

SEQ ID NO: 18675 - DNA, 601 bp, Human
cagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcatcgcttcctctgggacaccttcactctttatcacaacctctttccccattatacggataccttcacctcactacgttcctctgactgcatatttagagtctcctgaattgcagcagtgacaacatcctcagggtrgctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttga

SEQ ID NO: 18676 - DNA, 601 bp, Human
tctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcatcrcttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacac

SEQ ID NO: 18677 - DNA, 601 bp, Human
ggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcawcgcttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccac

SEQ ID NO: 18678 - DNA, 601 bp, Human
agaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgamcattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcatcgcttcctctgggacaccttcactctttatcacaacct

SEQ ID NO: 18679 - DNA, 601 bp, Human
taccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatcygagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatc

SEQ ID NO: 18680 - DNA, 601 bp, Human
acgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccayttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgtttt

SEQ ID NO: 18681 - DNA, 601 bp, Human
gatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacakccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatg

SEQ ID NO: 18682 - DNA, 601 bp, Human
aagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccragattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaat

SEQ ID NO: 18683 - DNA, 601 bp, Human
ctccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaa

SEQ ID NO: 18684 - DNA, 601 bp, Human
agaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaa

SEQ ID NO: 18685 - DNA, 601 bp, Human
attagctagttttcaatacaactaatttaaaaatctcaatcttcagaagtatatatattattatatcttcagggaaagaaaaaaatatatatatatatcctaaaactagaagaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagarctgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgg

SEQ ID NO: 18686 - DNA, 601 bp, Human
aaatacaataaacaatttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctwtttaaaaatactttataaagaattcagtttcaataagactgatatgttcttagaatgctcagtgattgttttacaatttcataggaatcttgaatactgggccacactaatcactagatactttaaatatcatctttggatataagcacaatggagcttacctgttgccacaccatgcaccactccctccttggttttggagcctacaaaaacaaattcaagacataagtctcaagctagccttaaattgctgattagctagttttcaatacaactaatttaaaaatctcaatcttcaga

SEQ ID NO: 18687 - DNA, 601 bp, Human
acatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacaatttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatactttataaagaattcagtttcaataagactgatatgttcttagaatgctcagtgattgttttacaatttcataggaatcttgaatactgggccacactaatcactagatactttaaa

SEQ ID NO: 18688 - DNA, 601 bp, Human
gagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacawtttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatacttt

SEQ ID NO: 18689 - DNA, 601 bp, Human
ataggaacattttatttgtataggcactattgtgtttaatgctttccgatcatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctyggtaaatttaggccaaatgaataatataatcagaaatgtaataattgcacaataatatttgtacaaatagctataccataacaatacaaagataaatacaataaacaatttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaa

SEQ ID NO: 18690 - DNA, 601 bp, Human
gtcctcatttccattttagaagtcagtgataggaacattttatttgtataggcactattgtgtttaatgctttccgatcatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattrtaaacctaattgacttgttcaaattctcggtaaatttaggccaaatgaataatataatcagaaatgtaataattgcacaataatatttgtacaaatagctataccataacaatacaaagataaatacaataaacaatttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgt

SEQ ID NO: 18691 - DNA, 601 bp, Human
agaagatctgactcctgtgtttttagtcatatccacaacactgtattaagattcccatatcattgtcctcatttccattttagaagtcagtgataggaacattttatttgtataggcactattgtgtttaatgctttccgatcatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcstcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacaatttactgactgtccaagggtgtttcctgaaatgcactctgaattatcaaaggaatattgtaatcaacataatttaaggtcaaaatattttactgtaatca

SEQ ID NO: 18692 - DNA, 601 bp, Human
acacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttccgatyatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcac

SEQ ID NO: 18693 - DNA, 601 bp, Human
aagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttscgatcatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataat

SEQ ID NO: 18694 - DNA, 601 bp, Human
ctgttttatttttacactctgatttttaaatcaaaagtattcatttaaagaaatatttttctccactagttgtaaaaatgttgcacaagaaagttcactataaaactataagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcmtatccacaacactgtattaagattcccatatcattgtcctcatttccattttagaagtcagtgataggaacattttatttgtataggcactattgtgtttaatgctttccgatcatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgatt

SEQ ID NO: 18695 - DNA, 601 bp, Human
tgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacrattagttagcacttaatatgtacccataataaacattttacatcaggcataatatgcaaattattctccctctctttaaccattgaagtgtaattatcttatttcttctcataattagacttaagcactttatattaaataaccctattcaaaaagttaattcatttatctgatgtgggagaggaatgattatgatagcagccgatttatcccaatgtgtttctcatagccatactagttatgacagcatttttggttatttcactactgccagggtggtccatgggtgcaatcgctgta

SEQ ID NO: 18696 - DNA, 601 bp, Human
atttataagaatcaaaaccttcagaaaatctccagtgttagaaatttctttatactatacttgcatgaaaaataggtaactttatatcatagtttatttttaaagtaccttaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccrgcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattagttagcacttaatatgtacccataataaacattttacatcaggcataatatgcaaattattctccctctctttaaccattgaagtgtaattatcttatttcttctcataattagacttaagcacttta

SEQ ID NO: 18697 - DNA, 601 bp, Human
gtaaatatgtatatttaaatatacatatgtaaatatggatttaaagaaaataaatttaaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtaccttaaaaaacatatcattcagtaagtttaattaaacacattttcatatatttctataatatgatgyattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattag

SEQ ID NO: 18698 - DNA, 601 bp, Human
aatctaacctttgacattaaacaaaattataaaattaatatatggttttgaattgttatacaagtaaatatgtatatttaaatatacatatgtaaatatggatttaaagaaaataaatttaaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtacctkaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattagg

SEQ ID NO: 18699 - DNA, 601 bp, Human
tttagaatagatatagccaaatctaacctttgacattaaacaaaattataaaattaatatatggttttgaattgttatacaagtaaatatgtatatttaaatatacatatgtaaatatggatttaaagaaaataaatttaaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtaccttaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaat

SEQ ID NO: 18700 - DNA, 601 bp, Human
gaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttaaaacaatttactaaggaaatttaaatcataatatgttgaaaattagttttgttcattatgatgtaataaatttataagaatcaaaaccttcagaaaatctccagtgttagaaatttctttatactatacttgcatgaaaaatargtaactttatatcatagtttatttttaaagtaccttaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggg

SEQ ID NO: 18701 - DNA, 601 bp, Human
ttttctttatattatttcatagtagataataaataatttagaatatactaaaacgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttraaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtaccttaaaaaacatatcattcagtaagtttaattaaacacattttcatatatttctataatatgatgcattaagttgataactgaaataatttcctgagatcaaacagccaggatttaagttggt

SEQ ID NO: 18702 - DNA, 601 bp, Human
ctatctctctactcactgacattccaaatgacgggtgacaaaacaaaaggaaaagagacacactcatattagtacattttgggtctaataaatggtaactgtttttcggcaattgagttctttgaaatcagggattctgctttatttttctttatattatttcatagtagataataaataatttagaatatactaaaacgaatttagtgtctacctctaatgtctgcattaatataaataataggtttatatttgactttagctactttaaaaataaaattccaaaaaggaaatgtgatascaacttttagaatagatatagccaaatctaacctttgacattaaacaaaattataaaattaatatatggttttgaattgttatacaagtaaatatgtatatttaaatatacatatgtaaatatggatttaaagaaaataaatttaaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttata

SEQ ID NO: 18703 - DNA, 601 bp, Human
ctctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaaggaaaagagacacactcatattagtacattttgggtctaataaatggtaactgtttttcggcaaytgagttctttgaaatcagggattctgctttatttttctttatattatttcatagtagataataaataatttagaatatactaaaacgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatataca

SEQ ID NO: 18704 - DNA, 601 bp, Human
cttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcgagattaaaaataggttttgaattttttacagatccagccataaattttataatatctagatarccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaagg

SEQ ID NO: 18705 - DNA, 601 bp, Human
gtgttgctccctatttgtcttttaggctagaattttgtacaactacctaacaactccgtgccacttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcragattaaaaataggttttgaattttttacagatccagccataaattttataatatctagatagccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttg

SEQ ID NO: 18706 - DNA, 601 bp, Human
ttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgccyggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatgccag

SEQ ID NO: 18707 - DNA, 601 bp, Human
ttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgygcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatg

SEQ ID NO: 18708 - DNA, 601 bp, Human
cattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacrcccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacag

SEQ ID NO: 18709 - DNA, 601 bp, Human
tgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcrccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacg

SEQ ID NO: 18710 - DNA, 601 bp, Human
ggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggygcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccag

SEQ ID NO: 18711 - DNA, 601 bp, Human
aaactttcttgttcagttaaataagccagaaacagaaaggcaaacaaccacatgatctcactcatgtggaatctaaagaaaaaaaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacatatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgc

SEQ ID NO: 18712 - DNA, 601 bp, Human
ttgagtttacaagcagaagtttaatttcatgtcaaaaactttcttgttcagttaaataagccagaaacagaaaggcaaacaaccacatgatctcactcatgtggaatctaaagaaaaaaaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtatagktttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcct

SEQ ID NO: 18713 - DNA, 601 bp, Human
gttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaaraaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctca

SEQ ID NO: 18714 - DNA, 601 bp, Human
aaagggttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaaaaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcg

SEQ ID NO: 18715 - DNA, 601 bp, Human
ccgtaatctcaccagcttataaatgtaacacaaaacgtacacagccataccttgcccaactggtcctttttgacaaagccagtggctgctgcaatgctccctgctccctccactgtcttctgggctactgctgtcacacccgtcaccactgctcctccaacatttgtcacttgctctttggtcttctcagccactggtacaaataaagagcaacaacagattaaagggtggtagaataacagtgacttaaaatcattccacttccactagccatcggcttccatacacctgtatctacacwtgccatagataactgagtggtcagaagaaacaaaagccaccaagatgtccaagtgagtgtggttcaaccaaacattgaatcttggctaagatattttggctaaagtcatgcagtattaaaaagtgcttcaagtttaacgatcaggaatgtaaagccatgagtgatttggatttggtttatactatggaaagtttacagaaagcaattcttacaggtgcagttatatttgaaccagactcagcatgaatatttctttatttcaattcagtgccaatcctttgatctcactcagcaagttaa

SEQ ID NO: 18716 - DNA, 601 bp, Human
agaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggtttcaccatgttggccagactggtctcsaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaattggtgttaactaattagtattaattc

SEQ ID NO: 18717 - DNA, 601 bp, Human
tgtgtttagtactgtgtcttgcataaaagaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggwttcaccatgttggccagactggtctcgaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaa

SEQ ID NO: 18718 - DNA, 601 bp, Human
agagccttgaatgtgctaatatgtgctaatgtgtcttatggctctctaaggagggtgtagtcaaaatcatcttctacactgcttagttcccgggaacccactttttttttttttttattcatggtcgaatattatttattgtcagaaaggtacagcattcacaccaatatcagacaaaatagattttaactaaaaaattatttcgagacaaaaataacaatatatgttaataaaaggctcaattaaaaatgtataacaattataaacacatacacatcaaacaacagttccccaaaatacrtaaagcaaacattgacaggattgaagggagaaatagaccactctacaatagtagttggggtcttcaacaccccactttcaataattaatcacagccacttaaggaaccagtgcataccaaaacacacttctggcagtgttgcttcagggaattccgagtgtagggttaatgttccattttctctacctcttctaaaattcctccttcttcaaatggctattaataactttatatttttgtcctttgtgtcagttcttaattcatgttgcttataagcatgatttttattattaaagtgag

SEQ ID NO: 18719 - DNA, 601 bp, Human
cttggcaggaactgggaggcgggaggagggaggctactggaaataggtgggagtgtatggtggggggtgagaattggggaccttcttgcagcttaagtaatttgggggaaagttttcaaagggggttggggttgggggcggtaagtcgagcagcaaaggcgtttagggggcagcaccgggagtcgttttcatctccagcgtttccaaaatagaaatagaaggggaggggagggagggggcggggagtgaccgctcaggtcagactgcaataacttatttatttatttatttttaagaaaarttatgagctgtggttgcaggcaggagggaagatggagttgtgtgcagaggaagccgagtggtctgggtcgccgcctcctccccgccgacctgacagtttggcggatttcactgacccctctccctctttttctctgtgccccccgccccgccccgagcagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagagg

SEQ ID NO: 18720 - DNA, 601 bp, Human
tcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcgggtgagtcgcccctcgaccccaccggacaagctatctccgtcccgcctggcacaccccctgccctccgcctgggagattcttcgtggggactttatgcttcccgggagggacacactgccctttgcgcccgtgccgctcccctctctacccagagcctaagaggcatccaaacaacacacacacaaacacacacaccccaactcaatcccagcatccgaagagattaacttttttattgggaggtaaaatgcccttaacagccttacaagacctctcccttcttctctgctcccccaccccaaaagcacacacagggctcttacacaagtagcaattaggtcttccggaccctccgggccccagaccctcccctgataaaagggggctgtccagtgtgtaccggcgggttaatcattgggcgacttatctccggtgcagcgcgcctcttgcgcgggt

SEQ ID NO: 18721 - DNA, 601 bp, Human
taaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcrtatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccac

SEQ ID NO: 18722 - DNA, 601 bp, Human
tttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctrcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctt

SEQ ID NO: 18723 - DNA, 601 bp, Human
actatatatgagtagaatcttgtagtgactcctcagaggaagcctaaataccatcggggtctggcgttcacacccacaagcaatgcccaaacctccaagagactgggcagatctgtgctcaaatcaaaactcattgttgggggtgatagagttgacttcacaggccctgaaagtcttggctccttgcactaggagtgctctgggtacgggtacaggctgccccttgtagggcatagttgctcttgtttcctctacttgtggctttatggtctaggcctttcaggagtttggggctctggcrgagagggcctgctgggagcacatctggccaccctgcagagtgaaatcaaaccaggcctggctgcaacctcaacaccctcctggaaagaggagaatactggggatatcctggggtctttctggaagtgggagaatcagctttgacttgggcagtgtgcagaatagagtgaggggggatgtcagaaagatgagagggatatgaggcctcaacatcaaaatgcaagcacctggcatttttattatctctgcccacctctccgttggtctctctgcctttcctgccaatgaattgtgttatgtt

SEQ ID NO: 18724 - DNA, 601 bp, Human
actgtccctgttaatgccacagggctgcctggcctggcacacagggctgtggcgccttgtgcaaatggataacgttgttctagctccagcctttcattcaaagtgaaaactgttagaaagggaaggaaaactttgctattttaaggaattgtagcgtgctgcctgatatgaaggaagaaataacagctgtgccttgcttgtgcgcagcactcgattgccgcttttgctttcgacctcaccacaacacagtgagatctactgttcatgttcccattttacaggaggtgaaactgcagcttartgaggtagagagtgacttagttcagacacagaatgctgttgggagagtaataactatgatatggtctcttgactcccagctatatctgtgttgctatagggaaggggaaaaataatactgaaagagaagtaaaaatacaatcacacttccaaacatcaaccaccaaaaactgaactgaatttcctgaagcacttggttttcaaatctaagctgaacatcaatgctgttattcttgaggcccagaagcaacttgctcatttcaattaagcttcagcatgaacttcctatgtacacagccca

SEQ ID NO: 18725 - DNA, 601 bp, Human
cgagtgctgtcctggatatgaaaaggtccctggggagaagggctgtccagcaggtgaatgaatcctccgggccttgcctgttggtgtgggtggaagggaatggtgggagagaggagtacccacataaaaggcagcagagtgtgaatgggggcagtggcacaaggacatggcattctccccacgtgcccactggccccaggctctatgcgaggggctgaggaatggaagctggaaacagcgcatttcctgagctgctcctcctggcctccttaccacactggtggagtagactccaactgtrgcctgtccatgcccttcccagcaggcacaggctcaggctcaggctcttggcctctgcctctggctgggagtgattctaaacacatccagcagggtcagcctgatagcccatcagtttccgatcagctctgctagagagccgatgggatgtgggaggagggggtcactggtgggctggcaaccccaagccatccccatctccctctgtgtctaaacttggccctttggagttcggtagggagaagagccataggccaggtgggctcacccagagtcagcagagagtcccacaaatggttgc

SEQ ID NO: 18726 - DNA, 601 bp, Human
ccactatcctaatggggtaggggatccccagccatactgcatggcccttggtgcataatgaacccatttctgttccatgtgtgggctggtttctggggtttaagctgtagacaacccaccctctttgtgcctgcttctccttgggccctctattccacagcttgtggaacccacattttgctactgtgtttgaaaacactgttttctcctcccggggctttgggactatgcctctgttgtgttgactgctcatccttgctgcttctctgggcagattgtaactgtgaactgtgcccggctsctgaaagccgaccaccatgcaaccaacggggtggtgcacctcatcgataaggtcatctccaccatcaccaacaacatccagcagatcattgagatcgaggacacctttgagacccttcgggtaagggactgccctgggtggaggcccaggcttgggacacattgcctcccaagaggggcctagcaggaactcttctgcaggagaggtagaggatggctcctgtaggggaacatagagcaggttcccctgaatgcccttgaacatggagaattcattgaccagacattcagcttgacctaa

SEQ ID NO: 18727 - DNA, 601 bp, Human
aagaaaatgatgttcccacatagttggcagcacgtgaacagcaattgatccctttgcatcacctcctcttactgtttagatttggtaaatatttcttccttccctcttctgaccctccattttgccgatctttccttcttataacacatacttactaggtacctgctacttcccgggtgggcctatgtgccaggagtatagaggtgaacaaggaaggcaaagttctattctcagtagagctaatactctatctggagagagacaacaaacaaatcaacaaggtagccaggggctgtgataatttatgtcaagtgggcaggtaaatcgggagtgacagtagtgcagggaggattggaaagtcagggagttctctctggaggaggtggcttttgatctgcagcctaaaggatgagaatgggtccattatacaaaatgctggggcaagagcacacccagtagaggggagagtaatagcaaaggctcagggcaggaagggcaagggagaggccagtgggtgaggtcacatgtgaagggcatacaatgggcaaagacaaggccagagtggccaggcccaatcctccaggacttgcagacctgggaa

SEQ ID NO: 18728 - DNA, 601 bp, Human
gccaggagtatagaggtgaacaaggaaggcaaagttctattctcagtagagctaatactctatctggagagagacaacaaacaaatcaacaaggtagccaggggctgtgataatttatgtcaagtgggcaggtaaatcgggagtgacagtagtgcagggaggattggaaagtcagggagttctctctggaggaggtggcttttgatctgcagcctaaaggatgagaatgggtccattatacaaaatgctggggcaagagcacacccagtagaggggagagtaatagcaaaggctcagggcrggaagggcaagggagaggccagtgggtgaggtcacatgtgaagggcatacaatgggcaaagacaaggccagagtggccaggcccaatcctccaggacttgcagacctgggaaagagtgcatctccatcctgggagcagcaggaaaccactcaggcctttagaagatccttctggcagctgtgtagagaatgggtggtgtgatccttccatgcatgggctcatgtacgtgattaccaataactgtcgagtgacagtgtgaggagggctgcaagccatgagtgtaggcacagcagacagact

SEQ ID NO: 18729 - DNA, 601 bp, Human
aggccaggcacagtgactcacgcctttaatatcagcactttgggaggacaaggtgggcggatcacctgagatctggaatttgagaccagcctggccaacatggcgaaaccccatctctactaaaaatacaaaaattagctgggcatggtggtgggcacctgtaatcccagttactcaggggctgaggcaggagaaccacttgaacccaggaggtggaggttgcagtgagccaagcttgcaccactgcactccagcctgggtgacacagcgacactccgtctcaagaaaaaaaaaaaaaaaacagttatagtagtcaacttttgactctccatttcagatttcgtcatgccctcctcaatgagctgctaagttaggcagtgcattgattattgctgcaggagagggaaggaaggagctaacgtgttttcacatgttttccttttggagatgagaaaggaggactctgccttccccctaccctgcccctttctactccaggacctctgaaaggccatgagcacaaagctgctgcctgagtcccctgaaatgcagggtacgccccaggtctctgatgtaccccaccacacttttcctctcaaac

SEQ ID NO: 18730 - DNA, 601 bp, Human
gtcatgccctcctcaatgagctgctaagttaggcagtgcattgattattgctgcaggagagggaaggaaggagctaacgtgttttcacatgttttccttttggagatgagaaaggaggactctgccttccccctaccctgcccctttctactccaggacctctgaaaggccatgagcacaaagctgctgcctgagtcccctgaaatgcagggtacgccccaggtctctgatgtaccccaccacacttttcctctcaaacatattccaggatcacttgatttcttttgaatctatttaaacmcaccgtgtcaatgtgctatataaaatgtctaatgcatttcagacaccctatacatctatacatttaaagtgttctccttctatctgtgcagggatgggaaagggcatatttctgaaagcacagatgggaagacgggatttgttccgtgtccaggtgattatggtacctctatgcgcctggccggcactggggacagaggccatgaaaatgaatacagcacagcctttgcctccaagaaacttaagacctagtagaaatggcaggctttaaaacaggttgttgggatctgatttggtgagt

SEQ ID NO: 18731 - DNA, 601 bp, Human
ccgggcatggttataatcccagcactttgggaagccaaggcgggcagatcacttgaggctgagagttcaagaccagcctggccaacatggtaaaaccccgtctctactaaaaatacaaaaattagctgggtgtggtggtggccacctgtaatcccagctactcaggaggctgaggtaggagaatcacttgaacctgggaggcagaagttgcaataagcccagatcatgccactgcactccagcctgggcaacaaagctagactctctcaaaagaaaaaaacaaaacaaaacaaaacaaaacaaaaaaaactccttattataaactgtaagaaaaaaaaggcccctacttcgtcccttttgcaaatctgccttttcctactcactaaccagctggttcagagcaaggacactctgtttggtgccatcgctgcagactggaaggaagaggtccttgccccacacccaacagtctcctgctgttaccggcaggttggcaggcaggcaggcgagaagcagccagggctggtggtgtgtccagtttgaagactagtttccagccctggccctgctcaccctccaagtggccctggcaggttcctct

SEQ ID NO: 18732 - DNA, 601 bp, Human
agtagtgcccaagctgtcccatggtcactgacccagttagaatgactgaatggactttggcttgtgtctcattaggaatcctagccccattctagtcttccagtgagatctgtccatgagtgaaggaatctcacaggaaaaaacaaaatgcttctatgggtgtggttgctggccttatctacaccacagaagccatcacacagactgtctttcttcccattgttagaatgtgccctgaccaagcagcccacagggcctgggacagaggctgatctctgcctaactgagctcacctctcctycctctcctcctgactggttagattttctaggtgactgttcccctgatgacacaagcccgctgggccccagcagtgtttagaggggttgttgactcacgagatgacattcctgctgatgtgtgtcatgccctggggtggatgaatgataaatgaaaacagcgcttttaacttttgaacccactttctccttccttgtagccaagacactatttgaattggctgcagagtctgatgtgtccacagccattgaccttttcagacaagccggcctcggcaatcatctctctggaagtgagcggt

SEQ ID NO: 18733 - DNA, 601 bp, Human
ttgggatggggaaaaggcaagggtcgccttgaaagcttacattgggaagaagggttacttctaagagtgtaatcttcacatgcatgggaagcagggaggggggactacatttttatgactgaagtgcaaggaaaacatcaccctctcattgtaaagctccaagtgagccaagagcacatagtttacagtgcacgatgagcctctcactctctgcgcagtatctgtttattgcaactgaagcacccttgtgagtttgttttcttgcccggctatctccatttctgacttgctcattcacctyggggtgctgtcatattgaatgtttccctgtcactgacttcagccacctgcacaagggcttggagaccacacccctctgccctcccagaatcatatccctggaggctcagctagtctctgggtcagccatacctctgccctttcttttccctcctttctcctgtggcctctgacgtctggccatttaacagagcttagcatttttgctgggtggagagagctggagcctggaatcactccctctttgtgcatacggagggcatgaaaaccaaggtgtgtgcattccagtggcctggactct

SEQ ID NO: 18734 - DNA, 601 bp, Human
gctccaagtgagccaagagcacatagtttacagtgcacgatgagcctctcactctctgcgcagtatctgtttattgcaactgaagcacccttgtgagtttgttttcttgcccggctatctccatttctgacttgctcattcaccttggggtgctgtcatattgaatgtttccctgtcactgacttcagccacctgcacaagggcttggagaccacacccctctgccctcccagaatcatatccctggaggctcagctagtctctgggtcagccatacctctgccctttcttttccctcctytctcctgtggcctctgacgtctggccatttaacagagcttagcatttttgctgggtggagagagctggagcctggaatcactccctctttgtgcatacggagggcatgaaaaccaaggtgtgtgcattccagtggcctggactctactatcctcagtggtgaggtatttaaggaaaatacctctcagcgtggtgaggtatttaaggaaaatacctgttgacaggtgacattttctgtgtgtgtatctacagcatgctggtagctgccatccagtctgcaggactgacggagaccctcaac

SEQ ID NO: 18735 - DNA, 601 bp, Human
gacagttgccatctgggtctcttgttggctgatgcgagagcaggagggagcccactgatgcagttcatagagctcagcctcctgggcaggaaaccgggcagagaggagtagaaaagaattaagggtggctgcgaccagcccagtcactgaggcacgtttcccactggagacctatgagcacagtgataataaagccagttacctgcactgactatccctccagacaaaagctttcccaagaagttagtcatggctctgagagatctagttgaggatgtttggcaggggatctagtggttaygggtggctaagaaaaatgaggaaggtaagagtatcttgcagcctgtgttgggaggattaaataggatgccacacacagggccaggcagacagcctggtcagtaatagccatgacgatgggggcggggggagcaggaatgggagttgcagtgtttagctcagatgcatgcctgtgagagatgcttccactctcacagaaagatgagaccaaggaaaaggaggaggaagaggaaggaccttgacaaaccttggggcccacattgtctacacctcccttcctgctctagagcagaatagaaag

SEQ ID NO: 18736 - DNA, 601 bp, Human
gctctaagttgaattcgtgtcctgtttaattttctttattgctaaatgaatgcctgtgtctgtgatgctgacgtatgttcctaaggagaggggagaagttcattctgaacataaacttttcatcctctctctgtccagcaagaatggaatattccccaagtggcctgagccagcttggctttctttttgttttcaattatgtgggagttgaggagggggatgggaaaagcttcccaaacacaccctcccccaggcctgaggcacccctgggggacagagagtgttagaggttggtacaggygttagagatattgaaaggacatcccatgcaccccaggggctggtgtggctctgtacttccaggcaatattttgtggaaggggaaccttgtcagctccaggttgtggatgtttgaaaatcagttggtacccagtggctccatcctctggcaggcatgtggatttgtcaataaccaagtgaactctccaaaataagttaaaacttcctcccttctcagtttcaagatgctggaaatagctgttcataagccctggggaaatttagccctttggctggtaatgggagtatccgagatgagagg

SEQ ID NO: 18737 - DNA, 601 bp, Human
ggtaagtgtcctgcaaatcaaaggctggctaaatttccccagggcagggctccaggacatatctcacccccaggatggaattatacacacacaaccttcaagttgcagcccgaatctctgagtgtaattcgtccaaagaaaaagagaaaagagaagagggtcttcagggaaatcaagtgagatcatagttagacatgagtaagaacttccagatttacaagggaatagagcatctgatttggcatctgagagaggctattagatcttccttctcttaaggaggttgtaggcaactagttaygtgactgaagagatcagtctctactcacaccatcccaccccccaaacccagggcttcactgagttgtaccatgaaccagaccatcccaagaggctttttgagttctgacacttgctctgtgagccttcccttgctctgcacattgatgatataactttgtaactgcactaagagtgttcctaaagcagatagccagccgagctccagaaatctccctggctgcacctgcggaggccactgacccctctgtggagggaccgctcttcagtgtgtggctggcttctactctctgctcctctc

SEQ ID NO: 18738 - DNA, 601 bp, Human
catctgatttggcatctgagagaggctattagatcttccttctcttaaggaggttgtaggcaactagttatgtgactgaagagatcagtctctactcacaccatcccaccccccaaacccagggcttcactgagttgtaccatgaaccagaccatcccaagaggctttttgagttctgacacttgctctgtgagccttcccttgctctgcacattgatgatataactttgtaactgcactaagagtgttcctaaagcagatagccagccgagctccagaaatctccctggctgcacctgcrgaggccactgacccctctgtggagggaccgctcttcagtgtgtggctggcttctactctctgctcctctctcttggtcttcagccatccattgctcaccagtttctcaccaggagcataggaagatatgcatgtagggaggtaggcacggggatgacttgtttgactttagcaggtcattcaagaatctccttgcacctggtttcagatgctggggtcctgtctgtcacaggcttctgtgcctcctacccccttgagtttgtcacatggcccttcaggaaggcctgagatagatttgccc

SEQ ID NO: 18739 - DNA, 601 bp, Human
gctcaccagtttctcaccaggagcataggaagatatgcatgtagggaggtaggcacggggatgacttgtttgactttagcaggtcattcaagaatctccttgcacctggtttcagatgctggggtcctgtctgtcacaggcttctgtgcctcctacccccttgagtttgtcacatggcccttcaggaaggcctgagatagatttgccctgggtgggcctcctatgagaaaatcttaagtgaggcacccaggcaaaatggaaagagccttttgcccagagcaggaagcctgtcttccatttsagctgttccacctacttagcttaaaagaggcacttcgcctgtcttcagtctcagtctcagtctcctcttctgtggaatgggacaataatatctactctccttatcatacactgctgtgaggactgagtggatcacacaaaaaagcattatgtaaattgcaaagtgctaaatccacacaggagatttgaattaatccaccacactgaaggtctgtcaagggcagggactgtttcattcaccagagtatccccagtcttacacaggacttggcatatgaaaagtgttcagtaggccgggtgc

SEQ ID NO: 18740 - DNA, 601 bp, Human
catgtagggaggtaggcacggggatgacttgtttgactttagcaggtcattcaagaatctccttgcacctggtttcagatgctggggtcctgtctgtcacaggcttctgtgcctcctacccccttgagtttgtcacatggcccttcaggaaggcctgagatagatttgccctgggtgggcctcctatgagaaaatcttaagtgaggcacccaggcaaaatggaaagagccttttgcccagagcaggaagcctgtcttccatttgagctgttccacctacttagcttaaaagaggcacttcscctgtcttcagtctcagtctcagtctcctcttctgtggaatgggacaataatatctactctccttatcatacactgctgtgaggactgagtggatcacacaaaaaagcattatgtaaattgcaaagtgctaaatccacacaggagatttgaattaatccaccacactgaaggtctgtcaagggcagggactgtttcattcaccagagtatccccagtcttacacaggacttggcatatgaaaagtgttcagtaggccgggtgcagtggctcatgcctgtaatcccagcactttgggaggc

SEQ ID NO: 18741 - DNA, 601 bp, Human
ggaaagagccttttgcccagagcaggaagcctgtcttccatttgagctgttccacctacttagcttaaaagaggcacttcgcctgtcttcagtctcagtctcagtctcctcttctgtggaatgggacaataatatctactctccttatcatacactgctgtgaggactgagtggatcacacaaaaaagcattatgtaaattgcaaagtgctaaatccacacaggagatttgaattaatccaccacactgaaggtctgtcaagggcagggactgtttcattcaccagagtatccccagtctwacacaggacttggcatatgaaaagtgttcagtaggccgggtgcagtggctcatgcctgtaatcccagcactttgggaggccaaagtgggcggatcatctgaggtcaggagttcaagtccagcctggccaacgtggtgaaacctcatctctactaaaaatacaaaattagctgggcgtggtggcacatgcctgtaatcacagctactctggaggctgaggcaggagaatcacttgaacccaggaggcggaggttgcagtgagtcgagatcatgccactgcactccagcctgggcgacaaga

SEQ ID NO: 18742 - DNA, 601 bp, Human
gctaaatccacacaggagatttgaattaatccaccacactgaaggtctgtcaagggcagggactgtttcattcaccagagtatccccagtcttacacaggacttggcatatgaaaagtgttcagtaggccgggtgcagtggctcatgcctgtaatcccagcactttgggaggccaaagtgggcggatcatctgaggtcaggagttcaagtccagcctggccaacgtggtgaaacctcatctctactaaaaatacaaaattagctgggcgtggtggcacatgcctgtaatcacagctactckggaggctgaggcaggagaatcacttgaacccaggaggcggaggttgcagtgagtcgagatcatgccactgcactccagcctgggcgacaagattgaaactccatctcaaaaacaaagaacaaggaaaaaaacgaaaactgttcagtaaacacttgctgaatgaataaaataaataaataaatgtataaataaatgctctactttcaaccactactctgtttttcttttagaaaaacaatgtggtgagtgtcaacaaggagcctgttgccgagcctgacatcatggccacaaatggcgtgg

SEQ ID NO: 18743 - DNA, 601 bp, Human
cactttgggaggccaaagtgggcggatcatctgaggtcaggagttcaagtccagcctggccaacgtggtgaaacctcatctctactaaaaatacaaaattagctgggcgtggtggcacatgcctgtaatcacagctactctggaggctgaggcaggagaatcacttgaacccaggaggcggaggttgcagtgagtcgagatcatgccactgcactccagcctgggcgacaagattgaaactccatctcaaaaacaaagaacaaggaaaaaaacgaaaactgttcagtaaacacttgctgartgaataaaataaataaataaatgtataaataaatgctctactttcaaccactactctgtttttcttttagaaaaacaatgtggtgagtgtcaacaaggagcctgttgccgagcctgacatcatggccacaaatggcgtggtccatgtcatcaccaatgttctgcagcctccaggtaagtgtcgcatccccactgactctgcagccagtccttttctccatgtggcagttggtggagagaagaaaaactgttctaaacaatgatgagaataacatgtaattgtgatagttaaactgtgcct

SEQ ID NO: 18744 - DNA, 601 bp, Human
agtgggcggatcatctgaggtcaggagttcaagtccagcctggccaacgtggtgaaacctcatctctactaaaaatacaaaattagctgggcgtggtggcacatgcctgtaatcacagctactctggaggctgaggcaggagaatcacttgaacccaggaggcggaggttgcagtgagtcgagatcatgccactgcactccagcctgggcgacaagattgaaactccatctcaaaaacaaagaacaaggaaaaaaacgaaaactgttcagtaaacacttgctgaatgaataaaataaatawataaatgtataaataaatgctctactttcaaccactactctgtttttcttttagaaaaacaatgtggtgagtgtcaacaaggagcctgttgccgagcctgacatcatggccacaaatggcgtggtccatgtcatcaccaatgttctgcagcctccaggtaagtgtcgcatccccactgactctgcagccagtccttttctccatgtggcagttggtggagagaagaaaaactgttctaaacaatgatgagaataacatgtaattgtgatagttaaactgtgcctatgtgactgattgcag

SEQ ID NO: 18745 - DNA, 601 bp, Human
agcctgggcgacaagattgaaactccatctcaaaaacaaagaacaaggaaaaaaacgaaaactgttcagtaaacacttgctgaatgaataaaataaataaataaatgtataaataaatgctctactttcaaccactactctgtttttcttttagaaaaacaatgtggtgagtgtcaacaaggagcctgttgccgagcctgacatcatggccacaaatggcgtggtccatgtcatcaccaatgttctgcagcctccaggtaagtgtcgcatccccactgactctgcagccagtccttttctycatgtggcagttggtggagagaagaaaaactgttctaaacaatgatgagaataacatgtaattgtgatagttaaactgtgcctatgtgactgattgcagagtgaattgggagctgttggttttgaatgcaccacactaaggaatgtgaggacacattgctctttgcggagttgcccagctatattagctcccctcggacacagcccagttttctgtattcgcgtggatgctgtccgcgcgattcccagcactcctcttacagcatctcacctcagtgtatgttccttgcctccagtgcag

SEQ ID NO: 18746 - DNA, 601 bp, Human
gaataacatgtaattgtgatagttaaactgtgcctatgtgactgattgcagagtgaattgggagctgttggttttgaatgcaccacactaaggaatgtgaggacacattgctctttgcggagttgcccagctatattagctcccctcggacacagcccagttttctgtattcgcgtggatgctgtccgcgcgattcccagcactcctcttacagcatctcacctcagtgtatgttccttgcctccagtgcagttgaacctcagtcctgcctctcctcatgtgtgcattcacctttcttggygctctctccccatgggccaagttctaccatgagttatgaaacattatggagaaaacatgtctttggaaatgtgagccagaaagcccaccagtgcccctcagtcacggttgttatgaatgacatgctaatggtttcactctggtcaaacctgccttttctttcctcttcagccaacagacctcaggaaagaggggatgaacttgcagactctgcgcttgagatcttcaaacaagcatcagcgttttccagggtaagatgcctgctaggtttgcgcctagcctgagcagcctcaggtcctct

SEQ ID NO: 18747 - DNA, 601 bp, Human
ctgaggcatcctcagccccagcctgtgtcaaattcagagtaaagaaccaaggcaactccctggctttcatgggccaaagcgcaggctttcacaccgaggcctctgagcctcagatcatggggaagtcactgctggagagaacagacatagctctggaagccatctgcccaagagggcagcccatcccaagttcatcttacagtggccaggcctgccctgagccggggcctctgggtcactcttctgctgtccatggcattgcccatcctgggtgaggctggggctctcctgggcactgtaygtattctggatacagggatactgggctcgctatgtgtgtggagccatcccttccttgccccagccccacctccctctcaaaccctctctggctctttctgagcttcctttcctgctccccagcttgcccagtgctcagtgccccacttggctcttttgctacttcgggtcaggtggagcctcttgggaatgtgaagtgccttacagaaagattgcacttcaagaggagaggctgcagggagccatcctaaacccagaggcctggagcttaccgtgtcactttacttttgtacacaggggt

SEQ ID NO: 18748 - DNA, 601 bp, Human
cactttacttttgtacacaggggtctccttagtgccctcgagaaggattcttggccctgagcttctactcctgaggccacctctgtgcagccccagctccctcaactctaggctgtagtctcagtgggaaagcctggcttgggggtctcctaggaatgtccacctgaaggcacacttgataggggcttgcacaacttatgtctgccaaggccacctgaggaactccctggtgcctataagttccaccttccccttcctcttcctcgccccagcattttttctgagtaggggtggcaatggrcaaagccattgtcataagcagttgcaggtataactttcactagaaaacctgacaccttgtgttttctttcaggcttcccagaggtctgtgcgactaggtgagtctggtctgggtttgaagtcattgcagacctgtttaggccttacccccaagcaagcccaagcctgccatctgctgtatatagataagaacatcatggtgcagtaaaagaagcctggcctttggagtcagaacagcagggtgacttggggtcagacccagagcaccccatttccttctctgtaagatgaggataataag

SEQ ID NO: 18749 - DNA, 601 bp, Human
cactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatktccctattgtgacagagccatggtgtgtttgtaataataaaaccaaagaaacatacgtcctgtgtgcatggtacagtgtgctgacctgaggccgtcatgctcctccacacctcaattctgctctggagaagctcagaaaggagccccgagggatggttttggggagattccagcagccagccctcagacagccagacagctcatgggggtttgagcctgtctttgccaaacaggtttttatttcaccctcctccggtcctggggtttcaagttttcagtgttgccttcaccccgcacttt

SEQ ID NO: 18750 - DNA, 601 bp, Human
gcaggtggagtcactccaaggcacttgttaggaagctgagctctggagccagatggcagatagccttgttagctcgtaaccatgagaccttggtcaagtcactgcccctctctgggctttaatcttcccaattgtgaaatgagggggttggactagatcatctctatgaactcttctgagctctgactatctgggactcaacagtgcttacaggtttcatgcagccactgaggttacagcttaggtttacagccctcaaatctttacatggaaactgtgctgatcacaggaacctcatccyaaggcaggaacttcaccttctttccctattttcccagctgattgtcttcttgcatcctagatagttagcaatgtttgctaagcatattcttatcattaaacatattactgaggatatgaacatcatgaagtacaggaaggaggtatgcccttaagaaaaagaacaccagatttgaaatctagagaacctgcctcctagtctcacctctactcctaaatagcctgcttaccttgggcttgtcccttttcctgggccgcagttttgccacctgttaacagtgtggggttgggcttggtgctc

SEQ ID NO: 18751 - DNA, 601 bp, Human
agtcaccatctcatgcctttcattcactctgaccctccatagagggtatcatgatccatagaactggtcagtgcccttctatccagagacaccactggaatctgcttgtctctaggtaccagcctgcaagtcagacaagatacaggctagaagtaatagtccgtccatccatcctctcgtgcttccttcccaccctctctctgtgcttagtactgtactatgaactggggatacaaagataacactgcttataattatgataagacttggcatcagttaacatttactgagcaattgcttwgtgccaggcattctgctaggtctttgcatagatcagtacttatactaacactgtaaaatagataacaccttgtcctctgtttgacaggtgaggcaactgagacctgggaggtcatataactgttaagattatatggccacaaagtggcaaacctgagcaaaactacagggtctttgcctataaggagataatacagtatggagcagcaggctgattcatcattcctacccactttggggtatataaatgcccactccatatgtttttagttcccagggaacaaaaagaggtcagtttggg

SEQ ID NO: 18752 - DNA, 601 bp, Human
gaagagagagaggccagagaggcaagcctgcatgagttttggcactggtccctgggagactttgttctagcagattagacagtctaccctagagagtcagaaggggtgagcaagggcttccttagagcaggactaaaggaacttggagaacctgagactccgagccgccctgtctgacctctctcttctctcactgatggaaggcaggcagaccttctcccgtctgctaactctggagcctctgacccatctctcaggaacacttcagtacacagagacctgcgatatgtgtgtgtgtgttagggagcagggtgttagaatgttgagagagcttattgcaatcccaaacttggaaattagctgggctgtggggtgaaggtgaaagtttccagaactggctgctctaagctgtggggaccttatctcccatcaggaccatgagaaaccgatccactgtgccaggagttattgtttatgtagcggagacatgctctccagctggctgcaggggacagaacgtgggggacattatgtcccagctggtcctgggagggtcccatggggagacccgctggtcatgtgctttgcatgtcctgactgt

SEQ ID NO: 18753 - DNA, 601 bp, Human
ccgccctgtctgacctctctcttctctcactgatggaaggcaggcagaccttctcccgtctgctaactctggagcctctgacccatctctcaggaacacttcagtacacagagacctgcgatatgtgtgtgtgtgtgagggagcagggtgttagaatgttgagagagcttattgcaatcccaaacttggaaattagctgggctgtggggtgaaggtgaaagtttccagaactggctgctctaagctgtggggaccttatctcccatcaggaccatgagaaaccgatccactgtgccaggarttattgtttatgtagcggagacatgctctccagctggctgcaggggacagaacgtgggggacattatgtcccagctggtcctgggagggtcccatggggagacccgctggtcatgtgctttgcatgtcctgactgtaggcagagcagacctccagggacttccttcctttagtggtttgtctaaccaaatgagcaatagcagggtctcgcctttgaagctctagctggaagcatctttgacccccagcccacagggaaccattcttcttgcaatgcccgtggttcttcctgccttaggac

SEQ ID NO: 18754 - DNA, 601 bp, Human
ttggaactttgtgtagatgctaccaagaagaagaagaggggcccagaggcatgcagaacccagctgaaaaagaacaacccacttatgtctgaagttctaaaccagctttaactactcttgttaagagctgaggaagggacttaggagaaaggggaccaaactcattcctcctctccttacgaatttcagtataacttgttctaagctaacttttattgaatgttgtgggctgactgctattctaagtcatttgcttctctcaaacaccctaagaagtgctttgacccattttacagatgargaaactgagacccaaagaggttaagtaactttccaagtggcgaacacaggtggcagagaagattgaagattcaaactctggctgtcagcctccaaaacctgaatttaccactgatctccatggcattggtttggattagattacctttaacatcttttccaactctgagattctaggattctctgatgtcaggacattataaacctattataactctcctaaatttgtcaaaccaattctagatctctatgattacagacatgatacttttagaatcaatatttaaatcaaggtaggatt

SEQ ID NO: 18755 - DNA, 601 bp, Human
cacttcttccagcacttggctgcgttaccgtgctcagttggcaagccttgggggagaagagaggttcagaaggaagaccatctgagtccatcagaacaatgtgtgcttttaacaaggcaggggcgcccaaactcagtaggtccaacagaccaagttatgctatgaaggtcttgtggaccacctacccccgccaaccagtcaccacttaaaagatgagaaaacgccagctcacaggccaaatgggaggcatttagaagagacaccaatgaagagatgtctggctttgtattaattactgtargtaaattaataccaaatgccaggaagtaaagtagaggcattttcctattataaacccttgggacaagcccagagaccaccagcagtccagggcttgtgtacgctgagaactgaggggataacagaattgtgcaacaccttggtgccccaccgcccccgttaccaaatctcacagttcacagtatcgccttggcacactgggcttgtgtaatactcatggacttgacctggaatcacaaagcggactcagcttctgttacattcattcaccccagtgactctgggcacacactgtgcctct

SEQ ID NO: 18756 - DNA, 601 bp, Human
caaaattgtctccagacattgccacatgtcccaaatatttcctaggggggcaaaattgcctccagttgagaaccactgtattagattatgtcgtagatacaaatagccaaatatcagcaatttcacgtggttcaatctaacaattataaagtatttaacagttaaaactctttgaactttgtagatacatttatgtgcttcatctgggataaacgaacccaatgctttcaccagacgctcagaagaataaaaaacatggagaatttctagcttgaattcaacgttcaccagccaaatagartttctataaagtggggtttgtaatacatccctcccagggctcttttaaggatactgcaaggagaatgtgagtgagaatgtttttgtgggctggaaagtgtcacagagatatcatgagaatgctggctgagttcacgggactcaggtcctaaggttgacaaagaaaaaggacctttgtcacagctacttctctggatttctgaaaaggtgctgggatgtcagacatgtgtagccgaaggagtgttgtggggcagttggaatggggggtatggctggctgcacaggaaggtttctctgggaa

SEQ ID NO: 18757 - DNA, 601 bp, Human
ttcttttttctggatgaatcatattccattgggtatagataccaggttttgtctatccattcatctgttgatgggcacttaggttgatttcatatcttggctattgtgaatattgctgcagtcaacatgagagtgcagacccctcttccatattccgatttcctttcctttggatacatacccagcagtgggattagggatcatacgggtgtccaaactgggaaagaagaagtcatgatgttccttttgcccacagatgtaccgaggcttcaccaagatgccccatgtgcagtacatccayacggaagcttccgagagtctctgtggccttaagctggaggtcaacaagtaccagtacctgctgacaggtaatggccaactctagcttctaggccagggtttggccaaggtccactgtttcttgacttcagaagaacacatacggagtagttgactcaccaaatgtccagtaaattgtaaggagtctctaatgttgaattcatcccacttacccagtgctaggagcttgaggctcctacacttaggctggactttggaattagctccaccactcacctgggggaggaaatctcctaatttg

SEQ ID NO: 18758 - DNA, 601 bp, Human
gatgaatcatattccattgggtatagataccaggttttgtctatccattcatctgttgatgggcacttaggttgatttcatatcttggctattgtgaatattgctgcagtcaacatgagagtgcagacccctcttccatattccgatttcctttcctttggatacatacccagcagtgggattagggatcatacgggtgtccaaactgggaaagaagaagtcatgatgttccttttgcccacagatgtaccgaggcttcaccaagatgccccatgtgcagtacatccacacggaagcttcygagagtctctgtggccttaagctggaggtcaacaagtaccagtacctgctgacaggtaatggccaactctagcttctaggccagggtttggccaaggtccactgtttcttgacttcagaagaacacatacggagtagttgactcaccaaatgtccagtaaattgtaaggagtctctaatgttgaattcatcccacttacccagtgctaggagcttgaggctcctacacttaggctggactttggaattagctccaccactcacctgggggaggaaatctcctaatttgtagcttctcaac

SEQ ID NO: 18759 - DNA, 601 bp, Human
aaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtgg

SEQ ID NO: 18760 - DNA, 601 bp, Human
taagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcytccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggaga

SEQ ID NO: 18761 - DNA, 601 bp, Human
ccccaaagaccatcccaagtccaagctgatgcctgcaggttttagaacatagcacacattcaagatgtggccagcatcccggaggcccaatatcattgtggggtaataggggaaactgtccaggatgcttgtggcttaaccctgggtcagctgagatgctgcagctccgagtcatcgtggtgttgctacagagtctgggtcatccaggctcccaagtatccggtggatttcgtggaaaacagagaaatcaaatggggggtaggaaggaatatctgttaaatcagtcaacacatgttcagcmtcacatggactcatttggagatgctatgatgcaagcgagtggaacaacatactaccacagcacagcaacggggcagtcctgcaatggggtggggtgctgccttgacatcaggaagtctctatgctgggggtgaaggctggaaaggctggatcaagcagccagaggcccacagtgaatgagaccatttcaggggagctgacagaagacccaaccctgcttgaggttatttgctgctatcaagaagccagcgcccaggaccagagtccacatgtggagatgtccaagcctctgtggcttgag

SEQ ID NO: 18762 - DNA, 601 bp, Human
cctttgcagccttcacaggtcatagcattgaagtgaaagccagtggctcggtctccacacaccccacagatccggggcacgttccggtcaaagtctccagggtcaggcagggaagtgctggccgccattgcctccatccctgtaagaacagcaagcaggccacggtcagagccagagtcagtgccagggccagctggcatccttggtgccacccacccccagcctcatcccaccgcccccaccccccaccaccagggagctcagcaagggtgggcatctccccagggcccaggcctgagcrcagtgccttcggagccctcatacatgattcgccctacatagctggctcagagcatggcttggaatcagctgcctggtttcagatgttgcatctgtcaggttaatttgggtttagtggttcacctctgcatgcccccgctgtctgcattggaagaggtgttttacttccagggtgtaaggatcatatgcatgaacccattcatgctactggcactagctctgcctcaggcacagacctgaaccaggtcaggggcttctatcctgcccaacgccccctccaagggaaaatgagagtcctccc

SEQ ID NO: 18763 - DNA, 601 bp, Human
tcaccaagaccctcctgctcctgtggctgtgagcgccgcatgttccatggacattgtaaggaaggagatgtgaaaaatgcaagggctcccttcatggaaacaccttgcttcttctccctccctttccactggggagagcctgggaggagggctcacctgaagaagcctttgcagccttcacaggtcatagcattgaagtgaaagccagtggctcggtctccacacaccccacagatccggggcacgttccggtcaaagtctccagggtcaggcagggaagtgctggccgccattgcctccrtccctgtaagaacagcaagcaggccacggtcagagccagagtcagtgccagggccagctggcatccttggtgccacccacccccagcctcatcccaccgcccccaccccccaccaccagggagctcagcaagggtgggcatctccccagggcccaggcctgagcacagtgccttcggagccctcatacatgattcgccctacatagctggctcagagcatggcttggaatcagctgcctggtttcagatgttgcatctgtcaggttaatttgggtttagtggttcacctctgcatgcccc

SEQ ID NO: 18764 - DNA, 601 bp, Human
gtcagaggaacatctggagctgagaggagggaaaagaagataccactcaccaagaccctcctgctcctgtggctgtgagcgccgcatgttccatggacattgtaaggaaggagatgtgaaaaatgcaagggctcccttcatggaaacaccttgcttcttctccctccctttccactggggagagcctgggaggagggctcacctgaagaagcctttgcagccttcacaggtcatagcattgaagtgaaagccagtggctcggtctccacacaccccacagatccggggcacgttccggtcraagtctccagggtcaggcagggaagtgctggccgccattgcctccatccctgtaagaacagcaagcaggccacggtcagagccagagtcagtgccagggccagctggcatccttggtgccacccacccccagcctcatcccaccgcccccaccccccaccaccagggagctcagcaagggtgggcatctccccagggcccaggcctgagcacagtgccttcggagccctcatacatgattcgccctacatagctggctcagagcatggcttggaatcagctgcctggtttcagatgttgc

SEQ ID NO: 18765 - DNA, 601 bp, Human
gtgcccaggcctgcaccctgtgatggtgtggagaaaccacagccctggaaacacctttcagggctgccagtgttggctggggagccgtcagatcaggagggaggagtcatgacccacagaagagaagcctaggtcaaggcccaaagaggaagcccagggtcagggcctcagctctgcctctgtgtcccaacaacagataatttttttcccattaacggagaaatttgctatcctctaagccctgttctgtgacttatcctctgtccctgacacatcttcctgttacctgacctctccccayccccaaccactccaaacggtcccatagccaggagggtccgcatctgagcaacatccccaccccgactccgactccgattcctcagacccacagctaggagggcctgggttctgtcctagggccgggtgggggtctggatgcagatggcagacaggagtgagcaagagaaggagaaaaaggaatgagtgtacagagagcacccatgcccagctggccttgctccagcccagagagggccaggctggcccctcccagcatctactgaattcaatgcctactctagttaccaaataactgtcc

SEQ ID NO: 18766 - DNA, 601 bp, Human
ttcccagggtataaagtcaactaagaatggaaaagagagaaaatgagtctttggtgggaccaagctgtcttcaatccatctcttagagcatgtgaaagtgcctggaaatgcacaatggagtgagctccgacccactggggccacgagaggctgcctcgggtgtggcccacaagcctgccctttggaagcagaaagacctagattagaatgaatgctgataccatcatcttattagctgagagccatgatattttaattcctctgagcttcctcagctattgaaaaaataaaagtatttacrtatttagggagtgttgtgagaatttcagaagaaaatgcatgtgcttgatgtgctatctgacacacagtagttggtcaatacacagggtttctgtcctcatcctttcccttcctgtgcctcttctatggaaggcccacctccttgctcggacagcaggagcctgggcttttagctttcttcctgtggttttacaaatattgagacactcaattgtctctgggatgctatgccttggggacaaaacccagcccagataagaaatgtgcagctctcccagggttctgaggccgggggacttca

SEQ ID NO: 18767 - DNA, 601 bp, Human
gatctatagacctgtggaagatatacagagagaaagaagcataatgaggagctaatattcattgattccacacatttattgagcacctactatgtgccaggtactttactaacaccagggagaaaagacatacatctgtaaaaacatcaaacaagttaccacaatgtgtggttctgtgcaggacaggtaatagtataagcaaacagcaagaactcagttataaaatttcttgggttcccagggtataaagtcaactaagaatggaaaagagagaaaatgagtctttggtgggaccaagctstcttcaatccatctcttagagcatgtgaaagtgcctggaaatgcacaatggagtgagctccgacccactggggccacgagaggctgcctcgggtgtggcccacaagcctgccctttggaagcagaaagacctagattagaatgaatgctgataccatcatcttattagctgagagccatgatattttaattcctctgagcttcctcagctattgaaaaaataaaagtatttacatatttagggagtgttgtgagaatttcagaagaaaatgcatgtgcttgatgtgctatctgacacaca

SEQ ID NO: 18768 - DNA, 601 bp, Human
tttccagtgattctgtgatgccattctcctgcccagatacttttctcggcccctactgatgaccacgtccaaactaaagttggcctcttcctaactttcagacttcatgtcttagtgcttctggacacagcctctgttctgggcatgctggcattgctgctggcctgggaacatgacctgctcatgctcgcccctgcatttccagttgtgctaggtgcccgtccagctgggttttctctcccccaaacctgtatgagttctaccagttcttcagtgcctacatcatagccatctttttccrtgaagcatttcttgattgccctgatctgcatcaagccttgtttttttctgctgagcctcatttcctatgcctgctacatatttagtctttcccacacacattgacacccaattatcttctgctctgtaagactcatggttagcacagttttcaattcattacctatagacggagcccaagaagttcaaggtctctttctctagattacaagttacttaagggcagggtccatgtcttacaattctttcttttctctcccttcctttcccttccttccttccttccttccttctttccttc

SEQ ID NO: 18769 - DNA, 601 bp, Human
tgcttctcctctggaccggctcatcctcccagcaggcagacatacccggaactggcagaagtcggagtaggtggggtcgtaggtcttatggtgggcgtccagcagtatggcaatgatgcgctgctgctcctcagacagcttgggccgcagactgtccttcaaggcctcctcctccttccgcttcaggatcatctcccgcttcctctgcacttcctcatctgtcagaatgactgtggggtgggaaggggagtcaggagggctggccagcagctcctccaggaaaccttcctcctgcggttgrgggtaaaggtccaagataggaggggctttaacactcggggctccctcgggggtcctcctgccacggagactcccactccactgtgtgaagaaaaattgggtttgctatggtgaaaaggaaggcacatgcaagaagaagaaaaagaggatttgagaggggggatgatctgggctttagggagtcggggttctcaagaacaagttgtgggaccttgggcaaactctctgggcttttgttcttttgtttgtaaaatgagagatttggaccatgtaagttcttccaaggttcctttcttgtacc

SEQ ID NO: 18770 - DNA, 601 bp, Human
ctccactagtgcttctcctctggaccggctcatcctcccagcaggcagacatacccggaactggcagaagtcggagtaggtggggtcgtaggtcttatggtgggcgtccagcagtatggcaatgatgcgctgctgctcctcagacagcttgggccgcagactgtccttcaaggcctcctcctccttccgcttcaggatcatctcccgcttcctctgcacttcctcatctgtcagaatgactgtggggtgggaaggggagtcaggagggctggccagcagctcctccaggaaaccttcctcytgcggttgggggtaaaggtccaagataggaggggctttaacactcggggctccctcgggggtcctcctgccacggagactcccactccactgtgtgaagaaaaattgggtttgctatggtgaaaaggaaggcacatgcaagaagaagaaaaagaggatttgagaggggggatgatctgggctttagggagtcggggttctcaagaacaagttgtgggaccttgggcaaactctctgggcttttgttcttttgtttgtaaaatgagagatttggaccatgtaagttcttccaaggttcctt

SEQ ID NO: 18771 - DNA, 601 bp, Human
tactctttgaccagtagtcacacttcctgggaattcattgtaaggggaaaatttccgataagtgtaaatatttggctacaagtatactgttttcttattaaaatgctgaggaaataatccagatatccaatggtaggggattaggtacattattgtattccagaatactatgcagcccttaaaaattatattctggatgcgtactaactggtatggaaaaacaatgccatataaaaaaaagcaagtcatcagattgtatacagcacaatttcttttctaaatatacatatgtgttttttttaaaaaaaaaaaaaaaaagaaaggaaggaaagcatgatgcctcccagactctcagctgagctggaggggacaggtcctccagggccagagtggtccccagagctcaagtggaaggtggacctcaataggaccaacacgttcaccttcccactccaaatttcaccttctgaagggcccaggattaaaatatcacgtaaaggaagcaggtcacctccacggagggggccatgggctgaagcctggcttagaggaaacagcatgggcccgggaggctgatgctacacagctggaatcccagctt

SEQ ID NO: 18772 - DNA, 601 bp, Human
cagaagtctcatcctgccttccccacaccctccgcccctgcctgcaggcagcaagatcaaagccaccagggatgcagccactgttcttctatgtcttggaacaatagaacccctaagtgtggaaagcagcagaaccagagagctactgggctggcccaccctgggcccagttggagcctaggtttgggctccagtccaggctcagcatcacctctgtccagtcacagagagcgtccataccagtgtccctgcaagctctcttagcaaggcctgctccattttcattggcataccttctgctctgggacttctcaagtcatactgaagacagagaagccaaccctagcatgttcaggatcagtttaacccattttgcatcaatggctgggcagctcctgtacctgccatatgtacctcactttagccatgagttgcaaggacagactaggggacagaggagaacatgatgaaaggaagagggcagacttcaacttaacctcgggaagagaaactgagagtagtgctatttgtgtcagggtacatgtgggagggcaatggataggggccttgagcatgggagaaattggaggctggggttcct

SEQ ID NO: 18773 - DNA, 601 bp, Human
ttgctctgtcacccaggctggagtgcagtggtgcaatctcggctcactgaaacctctgcctcccgggttcaggcaattctcctgtctcagcctgcggagaagctgggactacaggcatgtgccaccacacctggctaatttttctatttttagtagatatggggtttcaccatgttggccaggctgctcttgaatcctgacctcaagtgagtcctgcccaccttggcctcccaaagttctgggattataggtgtgagccaccgtgcctggcaccttcctgtcttttttctatgcaaatatrtatatacccacaaatatacatagagagagggagtatacatttaacatactggagcttatactaattctttatcctacttcctatatcactcaaaattatttagcccagttcttagagggttgcatgatgttacatcataacagtatactctaagttattgagccagtcttccatttatctatttttgaacattttgattgcttccaatttttgctatcataggtaattctgggaggaataactttatacatagccttttgttcagtgccccactcaaacagatggccagcagtgaacaca

SEQ ID NO: 18774 - DNA, 601 bp, Human
aactaatggagttttttaaaaaggaaaactgccgtgtcctccttcagatagtctaatgacacaatgtctaacatctcaccatccttgtcacttttctctagatgctcaatccacatttaaaacacaaaaatgaacaccatccccatttttgttttgactcattatacaagtaaaacatactcattatcaaatctttggaaaatacataaaaatgtaaaaacaaattaaatttgctcataaccacacttcacattttggcgtattttcttcctatctttttttcttatttatttattttaattttttttttgagacagtcttgctctgtcacccaggctggagtgcagtggtgcaatctcggctcactgaaacctctgcctcccgggttcaggcaattctcctgtctcagcctgcggagaagctgggactacaggcatgtgccaccacacctggctaatttttctatttttagtagatatggggtttcaccatgttggccaggctgctcttgaatcctgacctcaagtgagtcctgcccaccttggcctcccaaagttctgggattataggtgtgagccaccgtgcctggcaccttcctgtc

SEQ ID NO: 18775 - DNA, 601 bp, Human
gaaaaaaaatcacaacgtgctagagttggagggcccctcttaggaactcttagagatggctcctacataacctctgcaggactctcctagggtcagggagctcagggcctctggacacagccatggggttgttagcgccgagattaatgacctcttctattgagctacaatccacgtgatagtacactcatttgtggtttacagttttgtgctcaataaacccagaaccagacttctccactagccatgggacttcctttgaaccataactaatggagttttttaaaaaggaaaactgccrtgtcctccttcagatagtctaatgacacaatgtctaacatctcaccatccttgtcacttttctctagatgctcaatccacatttaaaacacaaaaatgaacaccatccccatttttgttttgactcattatacaagtaaaacatactcattatcaaatctttggaaaatacataaaaatgtaaaaacaaattaaatttgctcataaccacacttcacattttggcgtattttcttcctatctttttttcttatttatttattttaattttttttttgagacagtcttgctctgtcaccca

SEQ ID NO: 18776 - DNA, 601 bp, Human
accatgctcagctaatttcttttattagtatttttagagacagtgtcctgttctgtcacacaagctggagtgcaacagaatgattatggcttactgcagcctcaaactcctgggctcaagcagtcctcctgcctcagcctcctaagtagctgggactacaggtgcacaccatcacgcctagctaattttttttgagacggagtctcactttgtcgcccaggctggagtgcagtggcgcgatctcggctcactgcaagcttcgcctcccaggttcacgccattctcctgcctcagcctcccragtagctgggactacaggtgcccgccaccatggccagctaatttttttttgtatttttagtagagacgaggtttcacagtgttagccaggatggtctcgatctcctgaccttgtgatctgcctgcctaggcttcccaaagtgctgggattacaggtgtacgcctagctaatttttaaattttttttgtagggatggtgtctcactatgtggcccaggctggtctcaaattcctggcctcaagtgatcctctcatcttggcctctcaaagaaccagggttacaggtgtgagccactgcacc

SEQ ID NO: 18777 - DNA, 601 bp, Human
tcctgggctcaagtgagtctcccacctcagccttccgaatagctaagactacaagcatgcgccaccatgctcagctaatttcttttattagtatttttagagacagtgtcctgttctgtcacacaagctggagtgcaacagaatgattatggcttactgcagcctcaaactcctgggctcaagcagtcctcctgcctcagcctcctaagtagctgggactacaggtgcacaccatcacgcctagctaattttttttgagacggagtctcactttgtcgcccaggctggagtgcagtggcgygatctcggctcactgcaagcttcgcctcccaggttcacgccattctcctgcctcagcctcccgagtagctgggactacaggtgcccgccaccatggccagctaatttttttttgtatttttagtagagacgaggtttcacagtgttagccaggatggtctcgatctcctgaccttgtgatctgcctgcctaggcttcccaaagtgctgggattacaggtgtacgcctagctaatttttaaattttttttgtagggatggtgtctcactatgtggcccaggctggtctcaaattcctggcc

SEQ ID NO: 18778 - DNA, 601 bp, Human
actccacattcagatgctgtgtgttctcactgtgccttttttttttcttgtgacaggatctcactctgttgctgaggctggagtgcagtgttatgatcatagcatgctacagcctcaaactcctgggctcaagtgagtctcccacctcagccttccgaatagctaagactacaagcatgcgccaccatgctcagctaatttcttttattagtatttttagagacagtgtcctgttctgtcacacaagctggagtgcaacagaatgattatggcttactgcagcctcaaactcctgggctcragcagtcctcctgcctcagcctcctaagtagctgggactacaggtgcacaccatcacgcctagctaattttttttgagacggagtctcactttgtcgcccaggctggagtgcagtggcgcgatctcggctcactgcaagcttcgcctcccaggttcacgccattctcctgcctcagcctcccgagtagctgggactacaggtgcccgccaccatggccagctaatttttttttgtatttttagtagagacgaggtttcacagtgttagccaggatggtctcgatctcctgaccttgtgat

SEQ ID NO: 18779 - DNA, 601 bp, Human
ccgagactgccccgctctcccttcccacactctggggtgcggcagcgctagctcttagccctgtgggtgaacagcggccttgcaaccacattgaggcggcagggagatcatgactcagccgctggggtctgaaaattcttctcctccatcccaccctgccagatggagaagatgcggctcactgcttctccagaccctctcccctggggagggggtgggggagcaggctctcggctactctcggtgatccgaggaggacagggagggctggctctcctgggcaggaggtaaggcactggcagggggaggacgaggtcggcaggtgcttttctgcaaactggggacaattcagtcctgctacatggatccgtggaaggagggcttccacctcaaccaaccccttagacccagggcgaggaactgtgagcttggtgacagggacagctgtcatattcttctgtgaggctgtttttgtctgtttttcctccttgggtctctcagcaggtgggttcgtgcctggtgctccagtgatgggaagaaaacccacctcaccacagctactgcccgtgagaatataaccagggcaatgggatgttggtgg

SEQ ID NO: 18780 - DNA, 601 bp, Human
tggtccacttctaagacggagtttcgctcttgttgtccaggttggagagtaacggcacgatctcagctcactgcaacctccacctcctgggttcaattcttctgcctcagcctcctgagtagctgggattacaggcttgcgccaccatgcccggctattttttttttttttttttttgtatttttaatagagacagggtttctccatgttggtcaggttggtctcgaactcccgacctcaggtgatccacctacctcgacctcccaaactgctgggattacaggcgtgagccaccgcgccsggcctgtcctggcccacttctagctagttatatatgcttgggtgagtcacgccctcctctgtcagttttcctgaatgaggggattgactcgtttagcaacttacaagtgttttctcccactgaagagcaagctggaccaatacgttctgcagctaaaatcaaacaagggtctctccctagacccttgtaaaataacaacagcaataataattaatgtacagaagtttcacaatgtaagttctccccccataaatatctccaaatcagtggtacctgctaccctgtatattagactataat

SEQ ID NO: 18781 - DNA, 601 bp, Human
ttttggggcaccttctccttcagttataatgatataccttaaaagttttacatttacaaatgtctatttcacactctcattctaaagtagaatcgatgatgaccttttctccccgttcagccccataaaaactcattttcccctcttttcttttcctcccagctcctagacttcctttggaggagtggcctaggtggtggggcccagggctgagtaactgatatttccaggagttccccgaagaaggcagggccagagggagagctgggaaggtggtgacattacaaagacaaatgcatgytatagatgaggcaacagcattatccaaggctgaggtggagagcccagcaggccagggccacatcgtggtggggtagggtctgattcacattgaggcagaggtgagtctccttccttctccttctgatgggttggtggagttacaagccagggaaggaaggaaagggtcccagatccagacttgctctttctgaaatccagggcttcccccagggactgggtcagccacctggggaatgagagtgggggtctgagctcaaacatggtgtagtgaaaaggacaccggaccatgactccaaaa

SEQ ID NO: 18782 - DNA, 601 bp, Human
ccatattcacactagtttccaaataaaccacctctaggaatcaagagaaaggccctcttccactcttttgcccctgagattagacaaagataagggagtgaaaacactctctggggctgtttgaaggcagttttcctggattacagtatgggctggggggcaagcgctgggctccatggtctctaggcactgagaggtgtggcgtgtgtgtgcatgtgcgtgtgcgtgtgtgtgtgtgaaggtgtgtatgtgtgcatgtgtttgccagcatgagtctctgtgcttgtgtcaactgtgtgcrtgtttgtgctgctgtgtaagggtgtgtgggggtgagtttgcaacacgtgcccatggctcctggcttgaatggggtctggactggggtcactaatgacaagcagatgctggtgactgggtggcagctgtggaaaagaatgtctcctgggctgcttagcatggcaaattggccctggtggcagctgcctgctgtcccagacacggcctttcccagctcctcagacaagtgcaaactcaggccgggcttgggccacagcaggggaggatttggcctgagagactggggaaggcttggaggatg

SEQ ID NO: 18783 - DNA, 601 bp, Human
tgctgggtagggtcaagctcacactgaagcttggctgggtatgatgggctgggggagcgtccctgtaggggagtggatgtgatttccaggctttctggccccgtctcttccctcccatctcacagggcggagcctctgcacctgctggcgaaggcttcaccctctagtatgcgcatccgaggcagaggcgggagggtgggccccttctgtgccatctggaacagaggccacaccagcctcccgtgccccattccctccctggccttcattttttatagtcaccccaatacttgggctgggygtgttgcaaatgggagagaaagaggagcagcctagtgtggggtccggccctgggctgagaggcagacacctgggttcaagacgtgtccactgctaacttgttgagcttctttggagctgcggaccctgaccctcgagagggaactcaggtcttgtgacctcacagccacacccagacagccagctcacttcattgctttgagcttatcacccatcccacgaaagctggctaagagcagcccagcaggggcagtgctgaacataagggcgcttagcatgatggtgggggctcaggcgctgt

SEQ ID NO: 18784 - DNA, 601 bp, Human
gccctagagagaccgtgggcctccgtccagcctgcaaggtcccggctagttctaagagccaaataccaattttggctaagggtgagaggctctgaggctggggtggacactctcacctgtccctgtcctagctcagccactaacaccatgtggcatcacacaacagactggcctgtgtggccctagttcctgtctatgagatagggacatagcagggtgtggctgggctctgagaagtaggagatgctggtggactcaggattcctggcatttgctggcttttttcattcttctgctgtcyggtctgctcagccggctccctgcaagcatgaccagggactgctgggtgctcaatgcagggctgggttagcccggctccctcccgagagaagcccacagccctaggtcaagataagccagtgcccagctgcctgtgatatgaagcaggaggcagatgcgataagaggtgtcagggcgggcccgggaacttttgaacttaaggggtgggagggccaggaaggcatcagggaggaggtttcgtaggagcctgaatgtggagacactgcagagggaaggggcagagggactgtgtgagcaagca

SEQ ID NO: 18785 - DNA, 601 bp, Human
cagaaccaccttctgccagctcccaagtccaagctgggaatagccaggtcccttgactgggcctaggagtggccagcccattgacctgtgagtgtagggtggcacagactatggggcaaggatcctggctttgctgcatcctccctgggcctcagcctctgcgtcatcatctcactgagccatcgcacaggctgccctctagggctcccagaggctaatgattggcccattgtttcccagctagaaagtgaagaagaccgccctgggtccggagagcatctctggagccaggctgcccctrgcaagggtgggagttctagaaaattagcattctctgccacttctatcagcacacagtaagcctcccctcagaggcgtgggcagagaaatggcagaggtcccccactctgtcttcaccgagctcccaggccaggaggagatgcacccacataggccgcaggaagattgatttcctacaagatgcacagagaattcagtgagggcatggtgggtgggagcagaagttaattccagccagggatctgggaaggcttctaggagctggtggggtctgaactgggccttgagtagtgggcttaca

SEQ ID NO: 18786 - DNA, 601 bp, Human
gctgcccctagcaagggtgggagttctagaaaattagcattctctgccacttctatcagcacacagtaagcctcccctcagaggcgtgggcagagaaatggcagaggtcccccactctgtcttcaccgagctcccaggccaggaggagatgcacccacataggccgcaggaagattgatttcctacaagatgcacagagaattcagtgagggcatggtgggtgggagcagaagttaattccagccagggatctgggaaggcttctaggagctggtggggtctgaactgggccttgagtagygggcttacaagggcttagcacaaaatggagagcttgtatctttctgacacttcagaagaaatgtgtggattattctttcggtaatacttgcattcacaaaacccagggctgcagacaaaagcgggaagacaattgagaattgagaattgagaattgttctgattcttacttttttttttttttttttgccttaataagacctgggccaggcaaaactacctggggatgtgcaaatatatatgtacatatatataaaacaagtgactacaatgggaactgtccttgtttaagcaagttttc

SEQ ID NO: 18787 - DNA, 601 bp, Human
ggaagattgatttcctacaagatgcacagagaattcagtgagggcatggtgggtgggagcagaagttaattccagccagggatctgggaaggcttctaggagctggtggggtctgaactgggccttgagtagtgggcttacaagggcttagcacaaaatggagagcttgtatctttctgacacttcagaagaaatgtgtggattattctttcggtaatacttgcattcacaaaacccagggctgcagacaaaagcgggaagacaattgagaattgagaattgagaattgttctgattcttmcttttttttttttttttttgccttaataagacctgggccaggcaaaactacctggggatgtgcaaatatatatgtacatatatataaaacaagtgactacaatgggaactgtccttgtttaagcaagttttcaaatttaatgggttgtaaacagtaacgtacatttgaagtattttacctgctctttcctggacattgagtttcaacaggcctttgagtgccccttccaattctgaattatcaagtgtttccagatgtaaataatgcaagtgtattagatagttgaaggaaggttgtcag

SEQ ID NO: 18788 - DNA, 601 bp, Human
cagcctaagtggcctcaagtgggcatctttgcaagtgagcctttgctgatgtggtccatctcccctgtgtgagtgcacttagcccctgggacggccacaaagcatagtggaaggtgctggggcttcctggggaggggtcctccgggggcagctgcatggggagggccttcatgacctcacagcagcttccattcccttctctttccatgagtcatgtttctaaaagtggcccaggagtaagtggcagccagacggtggtggcggggcctatctggccaggcagagggagggtgaggctgargccagcagtggggaggaagaagagagaaggagagacagggagggcagggccagaagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctag

SEQ ID NO: 18789 - DNA, 601 bp, Human
cacacacaacttcagcaaccactgggtaggagacccacggggggtggggtgggaagctttggtgtcccatggtaagcctgaccccaccctcacagtgtcccttcctgttctggaggctctgggagacagccagaggacaggaaatcaggaaactgaggcctgccatgtagaggcaggctgggggtcacactgccagcactttcaggcctagtctctgccctcccagctcggccctgccccatgctgcctggcctccaggtcttcccagctgcgtggttaaaagtggggctccaaatcctgrctcagccactttcgggtttagcatgaccttgcgcagtgtgcttgagctttggtttcctgagctgcggagggggatatggtggtgcccacctctcagggtggccgagaagaggaaagggctcactccccatctgtaaactgagctcaacacagaggaggcgctcagtggattttagctcttatggttgtggatgtggatgtgctaggccagctttgcattagacaatggtctctggggcccttccaaagctgggagtgtgggggcagtggccttcctcaagaaggggctgctactgcccat

SEQ ID NO: 18790 - DNA, 601 bp, Human
tagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctsagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagaggg

SEQ ID NO: 18791 - DNA, 601 bp, Human
cacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagakgaaagagcagtttggggtaaatcaaggatctgcatttggacatgttaagtttgagattccagtcaggcttccaagtggtgaggccacataggcagttcagtgtaagaattcaggaccaaggctgggcacggtggctcacttctgtaatcccagcactttggtggctgaggcaggtagatcatttgaggtcaggagtttgagacaagcttggccaacatggtgaaaccccatgtctactaaaaatacaaaaattagcctggtgtggtggcgcacgcctatagtcccaggttttcaggaggc

SEQ ID NO: 18792 - DNA, 601 bp, Human
tctcccctgaccccctgaaaaagagaagagttaaagttgactttgttctttattttaattttattggcctgagcagtggggtaattggcaatgccatttctgagatggtgaaggcagaggaaagagcagtttggggtaaatcaaggatctgcatttggacatgttaagtttgagattccagtcaggcttccaagtggtgaggccacataggcagttcagtgtaagaattcaggaccaaggctgggcacggtggctcacttctgtaatcccagcactttggtggctgaggcaggtagatcayttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactc

SEQ ID NO: 18793 - DNA, 601 bp, Human
acacatggttaaggcctgttgctctgtctccaggttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtaygtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccac

SEQ ID NO: 18794 - DNA, 601 bp, Human
atctgtggtgtagggaaaagagaatcagaaagaagccagctcatacagagtccaagggtcttttgggatattgggttatgatcactggggtgtcattgaaggatcctaagaaaggaggaccacgatctcccttatatggtgaatgtgttgttaagaagttagatgagaggtgaggagaccagttagaaagccaataagcatttccagatgagagataatggttcttgaaatccaatagtgcccaggtctaaattgagatgggtgaatgaggaaaataaggaagagagaagaggcaagatgrtgcctaggtttgtgatgcctctttcctgggtctcttgtctccacaggaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctg

SEQ ID NO: 18795 - DNA, 601 bp, Human
acttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccargaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatc

SEQ ID NO: 18796 - DNA, 601 bp, Human
aagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtayattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcactt

SEQ ID NO: 18797 - DNA, 601 bp, Human
cctcttcacttccttctttctttccttccttgcataaacattgaatgtacggatccctttttggtgtttttagacacttctcaggaaacgtacgcattgatttgcaccttgtgtgtccacctgtaaacatcaaattagtgcaggccaaattcagggtatcattcatagcaatcccaaagaaactaactcttaaagaggccaattagtaacgcacaggtaaaactttgctaagtatgattctctgcctgggacctcattcatccttctgttcctgacattgcctcatgggtttggctgcccygttttgaagttacccaaagattattctgccatggcctctgttttttagaaattcaagactgaaggctcagtagaagggggttagcttagaggattgagccaagggtaaaatgatttctgggtagcagcccagagttcttgaaggatgtttattaggcaacgtgaacgggagaatcagcagtcagaagcggctgagaaaggaaccacgcagacaatgtccagttgtatagggtagagtgtgtgtgttgtgtatttacgttagtgctggggctttccttgggactcctgaactgggaagttg

SEQ ID NO: 18798 - DNA, 601 bp, Human
cactctaaaccagtgcacacgccaccatgcctggctaatttttgtatttttagtagagatggggttttgctatgttggccaggctggtctcgaactcctgaccttgtgatctgcctgcctcggccttccaaagtgctgggattacaggtgtgagccactgtgcctggcctaagtttttatatggcagacaatagctgtggaacaggaataataaacagcaactaactgtgctaaatgatgtgcatgcagtaaagcacttggtttctagccagcactgtgctatagaactttctgagatgawggaaatcttttgcagttgtgctgtccgataacacagacacctgtggctagggaacgcttgaaatgtggctagtgcaaccgaggaactgaatttttaattgtatttaatttatttgagtttaaatacacttaagtatccacaggtggctagtggctactgtattggacaatacggtcttagccttttcccagttcttatttggctcatgggaatttctaattactccctactttgcacagagttcccatagcacaagactccaagcagaggtgtgctggtgatgtttaacaagcagctctc

SEQ ID NO: 18799 - DNA, 601 bp, Human
tgctatgttggccaggctggtctcgaactcctgaccttgtgatctgcctgcctcggccttccaaagtgctgggattacaggtgtgagccactgtgcctggcctaagtttttatatggcagacaatagctgtggaacaggaataataaacagcaactaactgtgctaaatgatgtgcatgcagtaaagcacttggtttctagccagcactgtgctatagaactttctgagatgatggaaatcttttgcagttgtgctgtccgataacacagacacctgtggctagggaacgcttgaaatgtrgctagtgcaaccgaggaactgaatttttaattgtatttaatttatttgagtttaaatacacttaagtatccacaggtggctagtggctactgtattggacaatacggtcttagccttttcccagttcttatttggctcatgggaatttctaattactccctactttgcacagagttcccatagcacaagactccaagcagaggtgtgctggtgatgtttaacaagcagctctctgatgacggttgcctgtcttccctggtgtcaatcctccctccacacacagcttccagctggcaatgt

SEQ ID NO: 18800 - DNA, 601 bp, Human
ggaactgaatttttaattgtatttaatttatttgagtttaaatacacttaagtatccacaggtggctagtggctactgtattggacaatacggtcttagccttttcccagttcttatttggctcatgggaatttctaattactccctactttgcacagagttcccatagcacaagactccaagcagaggtgtgctggtgatgtttaacaagcagctctctgatgacggttgcctgtcttccctggtgtcaatcctccctccacacacagcttccagctggcaatgtgacatcactgatcaygcggttgggaagagatgcgcggtagccaccgtcaaacggtatttccaccatgcggacacaatagatgtaaaccacccagcgaacaaagataacagtaaaaggtagcaaataattaggaagtgatcagttgtaagtaattcttgcctttgtttttaatataatttattaaattgtaaatttaaatattttaattttttttttttttttttgagacagcgtctcaatctgtcacccaggctgcagtgcagtggcatggtcacagctcactgcaatcttgaactgctggactcaagggattct

SEQ ID NO: 18801 - DNA, 601 bp, Human
tggagtttgtatcagggttggccagagtggatgctggcaggggtcagggaggccctggataatcaagagagagacagagggagtttctagagtttactttttctttttctttcttttcttttttctttctttctttttttttttaaacagagtcttgctgtgtcacccagggtggagtgcagtggtacgatctcagctcactgcagcctctgcctcctgggttcaagcgattctcctgcatcagcctcccgagtagctaagattataggtgcgcaccatgacagccagctaatttttgtakttttagaagagacagggtttctccatgttggccaggctggtctcaaactcctgacctcaagtaatccgcctgcctcggcctcccaaagtgctgggattacaagcgtgagtctggccagcttccctgattcttaatgctgttagcctagtgcggtgatcctcagagtctgctccctggaacggcagcgtcagtatcacctgggaacctgatagaaatacagattcctggacctaagcaagacgactgcgtcagaaactccacaggtgggacccagcaatctgtgctttaacaaggcctcca

SEQ ID NO: 18802 - DNA, 601 bp, Human
ggaacctgatagaaatacagattcctggacctaagcaagacgactgcgtcagaaactccacaggtgggacccagcaatctgtgctttaacaaggcctccagatgattctttcaacaaatgtttttaagttgacacataatagttatatatatttatgaggtatgtagggatgctttgatacctacaaggtacagtgatcagatcatggtatttagcatatccatcatctcaaacatttatcgtttctttatgttcctacagatgattctggtgctagttcaagtttgaaaaccaatggcckggtgtagggttgtcaaacctggatgcatatgtattagatacatctgaggggctttaaaacgtacgactatcccagacataaaaggccacgtgattccatttacacgaaatgtccagaataggcaaatccatagagacggaacatagagtggtggtttcccggggctggggagaatggggaacttggcagtgtggggcttctcttgggaatgatggaagtattctggaatcagtggggatggctgtacaacattgcaaacatactaaataccacttactgtggtttgaatacatcccccag

SEQ ID NO: 18803 - DNA, 601 bp, Human
ggttgtcaaacctggatgcatatgtattagatacatctgaggggctttaaaacgtacgactatcccagacataaaaggccacgtgattccatttacacgaaatgtccagaataggcaaatccatagagacggaacatagagtggtggtttcccggggctggggagaatggggaacttggcagtgtggggcttctcttgggaatgatggaagtattctggaatcagtggggatggctgtacaacattgcaaacatactaaataccacttactgtggtttgaatacatcccccagagctcagstgttggaaacttaatccctaatccagcaatgttgacaggtgagatcttgaagaggtgatcaggtcgcgagggctctgcctcatgaatggattaatgttgttattgcaggagtgggtttgtgataaaagctgagttcagcccctcctgctgtctctcactctcttgcccttctgccttctgccacaggatgacgtagcacaaacgcccttgatacatgggggcccctcgacctcagacttcccagcctccagaatggtaagaaatctctgttctttataagttataaatctctgttcttta

SEQ ID NO: 18804 - DNA, 601 bp, Human
catcccccagagctcaggtgttggaaacttaatccctaatccagcaatgttgacaggtgagatcttgaagaggtgatcaggtcgcgagggctctgcctcatgaatggattaatgttgttattgcaggagtgggtttgtgataaaagctgagttcagcccctcctgctgtctctcactctcttgcccttctgccttctgccacaggatgacgtagcacaaacgcccttgatacatgggggcccctcgacctcagacttcccagcctccagaatggtaagaaatctctgttctttataagttrtaaatctctgttctttataaatctctgttctttataagttacccagtctcaggcattctgttacagtagcacaaaatgggctaagacaccactgaactgtacattttatgatggttaaatgatgaattttatctcaattaaaaatacgtactgatgtcttgggctcacccccagacattctgactggagcccaatcattgatatcttttacctttttcttttttttttttgagacagagtttcactcttgttgcccaggctggagtgtagtggcgcgatcttggctcactgcaacctccg

SEQ ID NO: 18805 - DNA, 601 bp, Human
ccacagctattccaaaggtttctgagaaggtagatttcaataatgtttataaaacaagcatcaagcctggtgtatagtgggtgctcaatgaatgtgaggctcctttgccttcccatttccctggtcgtttaatttttttttttttttttttttgagacagagtcttgctctgtcacccaggctggagtgcagtggtgagatttctgttcactgcaacctccgcctcccaggttcaagcaatcttcctgcctcagccgcccaagtagctgggattacaggcacctgccaccatgcccaactrattttttgtatttttagtagagatggggttttgccatgttggccaggcttgtctcaaactcctgacctcaggtgatccactcagccttggcctcccaaagtgttgtgattaccagcgtgagccactgcacccggcggtgctttaattctttttaactgactctttccgaggcatggattggcctctccctttgccactccctgaactgcaggtgattagagagagcatggagggggtaggggggaggcagggtggggctgggtacaggactttgatctgaccaagggctgccttggtgat

SEQ ID NO: 18806 - DNA, 601 bp, Human
gtgagatttctgttcactgcaacctccgcctcccaggttcaagcaatcttcctgcctcagccgcccaagtagctgggattacaggcacctgccaccatgcccaactgattttttgtatttttagtagagatggggttttgccatgttggccaggcttgtctcaaactcctgacctcaggtgatccactcagccttggcctcccaaagtgttgtgattaccagcgtgagccactgcacccggcggtgctttaattctttttaactgactctttccgaggcatggattggcctctccctttgmcactccctgaactgcaggtgattagagagagcatggagggggtaggggggaggcagggtggggctgggtacaggactttgatctgaccaagggctgccttggtgatgccacacttactgtctccgctgccaggtgagcccactcaggaggaggacgctgatcagcaggaaaacacagccggccactgtcaatagagagagggagttcagcaaagggccctgggcttggcatgggggcagcaggagccagggccacagggcaggctgaggacatccccaaagagcaaggcggaggctgcag

SEQ ID NO: 18807 - DNA, 601 bp, Human
ccctcagaaaggctcagaggccaggcctcgtttaaggacaccgagagcgcctggtaaaagaaatgttgaaatatgaagatgatgagaagcacattaacatctcctgaaagaggtcgggttttccagatgctgctctgctgaggttttggaggctgacatttgtttactttctaggcagatgcagactcagagtctgtttttccctcctaccaggaaacaatggcagtgtttctggaagcctgtcctctctgactggctacgtggctccttcctcccactcttgacccctggcagaggcccrgggtacagcccttccagatcagcttgagaggagctgatagggctgacttgagactttgctcacagcatcctgtaactggttcatgcgaattctgagttacgtcagtatctggattagtctttcactcacacattctgcagtgtaaggaaggggtcctttcagtcaaccaaccaacctaccaatcaactaaccaactaacaaacctactaacctaccaacaaactaaccaaccaaccaatctaccaatctatctaccaaccaactcactaaccaaccaaccagctaaccaaccaaactacc

SEQ ID NO: 18808 - DNA, 601 bp, Human
ggaaacaggtcataataatacgaatgccattgaaccactggatggagcagagatgcactaagggacagctgcttctgtgccaggctctccacttctcctgaggggtcagcaaccctggctctgccctgcctctcaccctcttccaaggaagcagcaagcattccctggctgtcagggtggcccagggaagcagctaagggaacaaaacagcctccctagggaacccaagagaaggacatggagtatgagaagtgcagtgagcaagaaaaccaggaatacttgtggttgaatgtaagtcactttttttttttgagacggagtcttgctgttgcccaggctggagtgcagtggtgtgatctcagctcactgcaactccacctcctgggttcaagtgattctcctgcctcagcctcccaagtagctgggattacaggcacccaccaccacgcccagataatttttgtatttttagtagagacggggtttcaccatgttggccaggctggtctcgaactcctgacctaaagtgatctgcccgccttggcctcccagagtgctgggattacaggtgtgagccactgtgcccagcctgcatgtaagt

SEQ ID NO: 18809 - DNA, 601 bp, Human
cctcccaagtagctgggattacaggcacccaccaccacgcccagataatttttgtatttttagtagagacggggtttcaccatgttggccaggctggtctcgaactcctgacctaaagtgatctgcccgccttggcctcccagagtgctgggattacaggtgtgagccactgtgcccagcctgcatgtaagtcacttttgattgtcgtgatactaataagatttcagaaggaagacagcaggagacctcgacatcggtgggctgagcatttgcatgagtatgtgtgtgtgtgtgtgtgtgygcgcgcatgtgcactgagtaagtcccgactctgcacattttatgtttatttttacaagctcagctggggaatggcacaaggggaaggaacatgctgaccgcggagggctgttcagatcatgcatttacacgatcaccagtaagaggaaaaatgtgtgagtgggaaactggacttgcccttggagccagaggaggccttggtggcttagagaagtagtggacttaggaccaactacgaggcagcatctagggtgcttaggagagggctttccttctcttctgtctccaacctttctcccca

SEQ ID NO: 18810 - DNA, 601 bp, Human
gagggctgttcagatcatgcatttacacgatcaccagtaagaggaaaaatgtgtgagtgggaaactggacttgcccttggagccagaggaggccttggtggcttagagaagtagtggacttaggaccaactacgaggcagcatctagggtgcttaggagagggctttccttctcttctgtctccaacctttctccccactcagggcacagggggaccttcattgaaggagcccttagagtccatctgatctggtctatttaaattttttttttttctcagaatgagaaaaaatggaagccyagggagatcaagggtcttgtccaaggaccactcttgtccagcaggagtggtcagggattccaccctggtcagcctgatggagcaaagcaacattgtggaccccagaagggagccaccctacctggaaactgactggtctccatttcacctgtgcatatgagctggggctgggtccaccttgtcttcccgtgggtcattttgcagacgctctcagcaggacctctgtgtagagccctgtatccctggacgcactgataataaaccatctgccccaccacgaaatgataaattctctctgtg

SEQ ID NO: 18811 - DNA, 601 bp, Human
tcagcaggacctctgtgtagagccctgtatccctggacgcactgataataaaccatctgccccaccacgaaatgataaattctctctgtggcttcattttcccatggtggaggttccctgcagtgacctggaagatggaaggaacgctctgaaggcaagttggggacagcaccgcgagtgagtccaggttgcctcttgctagggactggaccttggttcttactctcttgactgcttgctcatcctttcattcaaccaatatatgttgagaacgtctgagcgtggggaagtttgctaggcyctgtaggaaggcacgaagaccctgtcactcctgcaaggggtggacagtggattgggtaagaaaggcatgtgaaggatagcagacgttggcaatgggaacacagaggaatgagcgattcattctggttggtgcggccccgagacaggaacgccacaactgcctcttggaagacagtgcaggtgttgacagtggacaggagtgggcggggcagtctcagctgagacacaagggtaggctcaagcctatttgggccaatggagcatgaagaccaccttggatttctgctggacaagtgaggaa

SEQ ID NO: 18812 - DNA, 601 bp, Human
accctgtcactcctgcaaggggtggacagtggattgggtaagaaaggcatgtgaaggatagcagacgttggcaatgggaacacagaggaatgagcgattcattctggttggtgcggccccgagacaggaacgccacaactgcctcttggaagacagtgcaggtgttgacagtggacaggagtgggcggggcagtctcagctgagacacaagggtaggctcaagcctatttgggccaatggagcatgaagaccaccttggatttctgctggacaagtgaggaagtgcattcttgggggcagyggctgggcatcttgggatgatgtcggaaggattggggacaacaccaaagccaggaggagggacgggctgagggaacctcagagaaatggagcaccatctctgatcaagccacacctgaaggttgacacacatgcgccctttcaagacgtctcaaaatttcccatccccagaactttccactcacccaactacatcccaggcctgacggacctgtggcctgagaccatgtcttgttctgattaaatctctgaattccccacccacagcccccaacctggacatatggaattgtatgtgccc

SEQ ID NO: 18813 - DNA, 601 bp, Human
attgggtaagaaaggcatgtgaaggatagcagacgttggcaatgggaacacagaggaatgagcgattcattctggttggtgcggccccgagacaggaacgccacaactgcctcttggaagacagtgcaggtgttgacagtggacaggagtgggcggggcagtctcagctgagacacaagggtaggctcaagcctatttgggccaatggagcatgaagaccaccttggatttctgctggacaagtgaggaagtgcattcttgggggcagcggctgggcatcttgggatgatgtcggaaggaytggggacaacaccaaagccaggaggagggacgggctgagggaacctcagagaaatggagcaccatctctgatcaagccacacctgaaggttgacacacatgcgccctttcaagacgtctcaaaatttcccatccccagaactttccactcacccaactacatcccaggcctgacggacctgtggcctgagaccatgtcttgttctgattaaatctctgaattccccacccacagcccccaacctggacatatggaattgtatgtgccctctaaccccagcctgtgaaactgcgcacgtgc

SEQ ID NO: 18814 - DNA, 601 bp, Human
acacagacccaacagacgcttttaagttgagttgaatttgggttgaattctatttggccagttaccaaaccagggagtaagcccagacctggattggctgccgtcagattggctttagttgctgagcaaacagcctctgagcaactctgcactaattcttgtctgcaatgatgtcttgggaggacggagccacatgcatgtgtttatagaaggcagggcagaccttcttcctttgggtacacatcatctgcctgcaggagaagggtgcgctagcaggagttagctggaggacagaatcatstctcacctggaaggctcgcttggtccactggctgcattggactttgcatttctgtggttttcctttctttctgttcttcaggttgaggtgtcacttgtttcgttgtgttccgagtggctagaaaatatagatggaatgatgcagataatttcacaaatgcttcatagaaaacactgttcatgtattcattcacttgagaagcacacctgtccagggcccacgatgtgtctggtggtgtctggctgctgagcttacaaatacgaaaccagagtatgccctcccagcaccggcctctgggta

SEQ ID NO: 18815 - DNA, 601 bp, Human
tttctgttcttcaggttgaggtgtcacttgtttcgttgtgttccgagtggctagaaaatatagatggaatgatgcagataatttcacaaatgcttcatagaaaacactgttcatgtattcattcacttgagaagcacacctgtccagggcccacgatgtgtctggtggtgtctggctgctgagcttacaaatacgaaaccagagtatgccctcccagcaccggcctctgggtattcaagtgcatatggcaatgcccacgacatgtttttgagcgtgtgtatacgtgtctgtgcatgtcatrtatgttacgtgtctgtgtatgccatgtatgttacgtgtctgtgtatgtcatgtatgttatgtgtgcatgtgtgtgtctctcaccaaaagggactccttgcttgctgtcaattgtctctgtgttgtttgacagcagcaggagtggtctcactccacaacacactgatcctttgctccctaaggctgttcagaatgcttgaagttagagacgccatcttaacacaatgacaaggaaacttctagaacagccctctctattgtgaagagtttggcaaaggagttgagtctgagtgccccagtg

SEQ ID NO: 18816 - DNA, 601 bp, Human
aaaataaaattgtgtggccgggcactgtgactcatgcctgtaatcccagcattttgggtggctgagatgggcagattactcaaggtcaggagtttgagaccagcctggccaacatggtgaaaccccatctctactaaaaatgcaaaaattagccaggcatggtggagggtgcctgtaatcccagctactcaggaggctgaggcaggagaatcacttgaagccaggaggcggaagttgcagtgagccgagatcgcgtgccattgcactccagcctaggcaacagagtgagagtctgtctccaaaaaaaaaaaaaattgtgtttagtgaatgacttttcaggaaccactaaaattagttatcctgtagactggactggcccatttgtgtctatagggctgagtgaacaaaagctgggctctgtctcactctttgctgcagttcttttgttcttggtagtcacagaagggacacttaccagagcttgtgcattgacattggttgtcccaggacgagtggctagagtttcctgtacagagcatatagagtgacccgctttttattctgcggaaacctctcttgcattcacagttcaacatggttc

SEQ ID NO: 18817 - DNA, 601 bp, Human
atgggcagattactcaaggtcaggagtttgagaccagcctggccaacatggtgaaaccccatctctactaaaaatgcaaaaattagccaggcatggtggagggtgcctgtaatcccagctactcaggaggctgaggcaggagaatcacttgaagccaggaggcggaagttgcagtgagccgagatcgcgtgccattgcactccagcctaggcaacagagtgagagtctgtctccaaaaaaaaaaaaaattgtgtttagtgaatgacttttcaggaaccactaaaattagttatcctgtagrctggactggcccatttgtgtctatagggctgagtgaacaaaagctgggctctgtctcactctttgctgcagttcttttgttcttggtagtcacagaagggacacttaccagagcttgtgcattgacattggttgtcccaggacgagtggctagagtttcctgtacagagcatatagagtgacccgctttttattctgcggaaacctctcttgcattcacagttcaacatggttccttccttgtaggccatggctttgaatgtggcgtgtgggatctctggcgggtcatcgtcacagagct

SEQ ID NO: 18818 - DNA, 601 bp, Human
tatctctatctgtatctatctttctgacatgccttcttctcttctcctcgcttacctctctctctctgtatatatataatatatatataaaatatatatagcaggtagatatatacttatatgtaatctacataaaggtaaaaatatatattatttatatttatttatattatttttaatgaacagatatattattttatttttattttgtttttgaggcagaatctcactctgtcacccaggctggagtgcagtggtgcgatctcagctcactgcaaccgccatctcccgggttcaagcrattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagatatattttacatatctatagatcgatctatagatatctatatctatagatcgatctatagatatctata

SEQ ID NO: 18819 - DNA, 601 bp, Human
ggagtgcagtggtgcgatctcagctcactgcaaccgccatctcccgggttcaagcaattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagatatattttacatakctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagat

SEQ ID NO: 18820 - DNA, 601 bp, Human
gcgatctcagctcactgcaaccgccatctcccgggttcaagcaattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaa

SEQ ID NO: 18821 - DNA, 601 bp, Human
gatctcagctcactgcaaccgccatctcccgggttcaagcaattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaacc

SEQ ID NO: 18822 - DNA, 601 bp, Human
gctcactgcaaccgccatctcccgggttcaagcaattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaaccataagtg

SEQ ID NO: 18823 - DNA, 601 bp, Human
tcactgcaaccgccatctcccgggttcaagcaattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaaccataagtgtg

SEQ ID NO: 18824 - DNA, 601 bp, Human
ggagaattagagagataaaatatgtaaaaccataagtgtgtgtatatgtatacaggtatatatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcytgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccacc

SEQ ID NO: 18825 - DNA, 601 bp, Human
tatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcttgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccaccccaacacatgcgtggacttctccattaccaaaatccccctccagagtgctacatttgtta

SEQ ID NO: 18826 - DNA, 601 bp, Human
agaaacctttcctattaatgactctggttaatttctttcttttttgttttgttttgttttgttttattttgagacggagttttgctcttgttgcccaggctggagtgcaatggcacgacctcggctcaccgcaacctccgcctcccgggttcaagagattcttctgcctcagcctcctgagaggcatgcgccaccatgcccggctaattttgtatttttagtagagacgaggtttctccatgttggttaggctggtcccgaactccagacctcagttgatccaactgcctcggcctcccaragtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcaaggcaataaagggaaacagatttcaagggaaaaaaatcaggaaaatgaggcattaggtatgtgatgaaggaaagaatttttaggaagaa

SEQ ID NO: 18827 - DNA, 601 bp, Human
gtatttttagtagagacgaggtttctccatgttggttaggctggtcccgaactccagacctcagttgatccaactgcctcggcctcccaaagtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcgaggcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttctaaagtactcagcagattcatagtggcaagaggcacactgaagaggtaataaatgaatgatgaagaagaagaggggactatagaaatattctgtcaagtatccttgatgtg

SEQ ID NO: 18828 - DNA, 601 bp, Human
gttgcatacccatgtgtttgctagctcttgtatagaatgtaagaggaaaggacatatgtcagagccctttgcttttatgtaaaagccaagggagttcaggtaaatggagtcaaggcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttstaaagtactcagcagattcatagtggcaagaggcacactgaagaggtaataaatgaatgatgaagaagaagaggggactatagaaatattctgtcaagtatccttgatgtgaaagagaatgaaggacagaggaggttgtggagttgcaaaggttttcaaagataagagacatttgagttggtttagatgcttggggggaaaggcagggaagttgaagaccaagtggtggtgggcatggtgtctctctagaagtaaaaacatatgggtcattaagcataggcaaaaaccttatattagaag

SEQ ID NO: 18829 - DNA, 601 bp, Human
gtcagagccctttgcttttatgtaaaagccaagggagttcaggtaaatggagtcaaggcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttctaaagtactcagcagattcatagtggcaagaggcacactgaagaggtaataaatgartgatgaagaagaagaggggactatagaaatattctgtcaagtatccttgatgtgaaagagaatgaaggacagaggaggttgtggagttgcaaaggttttcaaagataagagacatttgagttggtttagatgcttggggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcag

SEQ ID NO: 18830 - DNA, 601 bp, Human
ggaagaaaaagtaacagttttaaatgcttcgaagataattgagtaagaaaagcataaaataggtttcccttgcttttgacaacatggccatccattgaacacctttctaaagtactcagcagattcatagtggcaagaggcacactgaagaggtaataaatgaatgatgaagaagaagaggggactatagaaatattctgtcaagtatccttgatgtgaaagagaatgaaggacagaggaggttgtggagttgcaaaggttttcaaagataagagacatttgagttggtttagatgcttgkggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcagcagaaagtgttgggagaaatttcttatttgatgatcttgatttcttcattaagatgtaaatctgggttacctgctgaggaaagaagcaaacatttagattatgagcctctcaggggaataggaggggatcactgagc

SEQ ID NO: 18831 - DNA, 601 bp, Human
ttttattcttggctggaaaaatggatgagatgcattgtcagattgagtccaaaagctattctgtctttcaccctcttgaaagttctacattcagagtatcttttgtctcgtggaagataaatatattcagccaatactatccatgttttcacattgaaaccaaaaatgaatcaattatttcagtaaagcaaggtgtatataagttatgatttgtatttccccatttttatttacctgtagtgttttctaaaccagtcacagtctggatttactttacattattattatttattattatttwttattattattattattattattattatttgagatggagtctcactctgtcacccgggctggagtgcagtggcacaatcttggctcactgcaaccttcgcctcccaggttcaagcgattctcaagcctcagcctcctgagtagctgggactacacgcgtgtgccactgcgtctggctaatttttttgtatttttagtagagatggagtttcaccgtgttggccaggctggtcttgaactctcgacttcacatgatctacctgccttggcctcccaaagtgctgggattacaggtgtgagc

SEQ ID NO: 18832 - DNA, 601 bp, Human
ggctggtcttgaactctcgacttcacatgatctacctgccttggcctcccaaagtgctgggattacaggtgtgagccaccgcgcctggcctgcatgattatttttaaatgaccagattcattccacatttccagattatgctttgatactagaaatttagaaagaataaaaccccacaagaataaaaatctagcaatcaactgcatgaatatattttagtaaaagttggagcaacagatgataaaattccacaaattcagtgaactctgagaataaatatggaaggtccgcagttaattaycctgcaaagaaaacgaaccttgaactttctgttaatagactttgcttcccaattaaaagctagcagtttgaaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaa

SEQ ID NO: 18833 - DNA, 601 bp, Human
aaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacytaagagccatgaatttgatttagaaatggggttgtatgtgtgtgtttttctatcacatattaaacgcacaatctgtaaaaaagattcaggaggatgtttgggaaatgttttctgtgatatttatttttcttcagaagaagtgccaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgac

SEQ ID NO: 18834 - DNA, 601 bp, Human
agttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacctaagagccatgaatttgatttagaaatggggttgtatgtgtgtktttttctatcacatattaaacgcacaatctgtaaaaaagattcaggaggatgtttgggaaatgttttctgtgatatttatttttcttcagaagaagtgccaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgactaatgctaacatttaaatatattcagaaattttacttttcatta

SEQ ID NO: 18835 - DNA, 601 bp, Human
gagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctgaaaaatcaactgaaaaaagttagcttggtaggtgaaaggcatacaaaatgtattttaacatgcatagcatggaagaatcacaggaggatgattacccaataacccaataggagcatagatgtagatatacccttcttcaygggggagggaagatggggaaaatatggcaatttggaaaatagtaaatgattttttaggggaattcaagaacctacaatggcctgggacaaagtctgttgggcccacagagcagatagtggtttgtaacaaaagtctgttcaggtgtgccgacagacttcagtctctcttcatgtgaaatgagttaaattaatgaaaacttaagcaagagggccagaggaaacttttcctcctggtgggatcagactgtaagtagatacgggagtatcagagtaaaacttatttcagcatttgctggtctc

SEQ ID NO: 18836 - DNA, 601 bp, Human
ttcaaccacaagtcaggattttatgtttctgttaacaaggttgatggcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttytgtattattttaatgtttgatattcacatgatggttgttttaaccatttttttttactttaaagaaaaagctataaactagttatatgatcttttcttcttcctttcatatgatgctgctaactcaatagagagacacccgattacaaatgctattgatggaaagaacacttggtggcagagtcccagtattaagaatggaatcgaataccattatgtgacaattacactggatttacagcaggtatagttcctctttttttgtcatttccacttttgaaattgcattttacatttgcta

SEQ ID NO: 18837 - DNA, 601 bp, Human
gcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttctgtattattttaatgtttgatattcacatgatggttgttttaaccrtttttttttactttaaagaaaaagctataaactagttatatgatcttttcttcttcctttcatatgatgctgctaactcaatagagagacacccgattacaaatgctattgatggaaagaacacttggtggcagagtcccagtattaagaatggaatcgaataccattatgtgacaattacactggatttacagcaggtatagttcctctttttttgtcatttccacttttgaaattgcattttacatttgctatttgtttagttagtggtttgtgggtgaaaggatactctttcttatc

SEQ ID NO: 18838 - DNA, 601 bp, Human
catactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttctgtattattttaatgtttgatattcacatgatggttgttttaaccagttttttttactttaaagaaaaagctataaactagttatatgatcttttcttcttcctttcatatgatgctgctaactcaatagagagacacccgattacaaatgctattgatggaaagaacacttggtggcagagtcccagtattaagaatggaatcgaataccattatgtgacaattacactggatttacagcaggtatagttcctctttttttgtcatttccacttttgaaattgcattttacatttgctatttgtttagttagtggtttgtgggtgaaaggatactctttcttatca

SEQ ID NO: 18839 - DNA, 601 bp, Human
agggagggagaacatcaggacagacagctaatgcatgcagggtgctttctatcaggtgtacagatgatcagtgtttcccaggctttaaaagtccacaagacaggcttggaaggccaattccaggtggtaaattgagactgtattcagagcatgcacagacaggagatttagtcctagagacattagatttctggtttacctgcacccctagaggcctaggaatcaactccctccttcttgccatatccaaaaatattaacaacattttgaggggagccttaaaacaagctaatcgaccccmaaaaaacacatagatcccaggcatcagagaaggagaattcagtcttcaagaccactcccagctgggccttcctgctttcttctgagcctaaacccagtgattaaagaaccagcctggacttccttaaggtgatgttgatcaaatatacccacttcaagcctggcaccactttcttcccaggctggctagttttacattttagtacacagtccagatgttttctcttttcttcatagtacctttagagagaggcttcctttatggttctaaatgaggctaaaatttgtgcttcctccctct

SEQ ID NO: 18840 - DNA, 601 bp, Human
catttctgggccagggatctaggctgtaggtccccacagcacttctgaccctatctgaaggaatacatacagtattgccaggtgttgtcatagcaccaaggctggtgggttcaaatatccttaagcctcaaagtagaaattttaaaaagtgggaggggtggaaatactgaatgaaacaccacctttcaggtacttgcatagtttctttctttttccctctgcattacaaatacatacgcaatactttttcaggttgttttttccaaaagcaacaataaactactagtggagtaaaaaatayggaactgaaagtccaactgtttgattaagtgtatgttataaccattgtatgactttgagtgaatttctatttttaagaaagtggtatttggaaccacaattttttaaaaagcataggttcaatgaaaacagattattatagaataccttggaaactcctagaaacatcaaggaaaaaaaataaacaatggaagcctatgtgagtacatataatatgtctaatgatattcataatgctcaggtttttttctaaatgtttgtggtttggttttttttgtttttaatttccaaaagtggacac

SEQ ID NO: 18841 - DNA, 601 bp, Human
ttcccttcatgtataccacaaatatattccctgaatgacagggaaagccaacctgaaaataaaagtctactaaggccgggtgtggtggctcatgtctgtaatcctagcactttgggaggctgaggcaggtggatcacctgatgtcaggagtttgagaccagactggccaacatggcaaaacccccgcctcttctacaaatgcaaaaaattagccaggcttggtggcaggcgcctgtaatctcagctattatggaggctgaggcatgagaatcgcttgaacctgggaggcacaggtggcagygagccgagatcgcgccgttgcactccagcctgggggatagagcgagactctgtctccaaaaaaaaataaataaataaaaaataaacataaatttttaaagttaaaagtctattgagggtggaggatacaaatatagatatgtttgacacttttgtaccctcttttcagttttactcttttttatttcttttttttccccctttagggtaatgacttgagcatcagcacagcccaagatgaggtgtacctgcacccatctgaagaacatactaatgtattgttacttaaagaagaatcatt

SEQ ID NO: 18842 - DNA, 601 bp, Human
cccctttttttaaaagagtgaactacctgacttgaaccaaatatgctcgggtctgattaactgctgtaaggcggctttgttttttttatttttaaaacaatgacatttttatctgacagaattttaacttcaactgtgtctgaatgagctctttacgcttctcgttttctactctaataataaataacacaaggtgtcataggaacttccttctaaatcaggttaagttagacattcaaatgtgaccccagcctgacaacccggtatacctttaatgaaagcaatgtctccaatattggaktttttattgctgacaccaccacctctcacctccctgtccctcatcatttccctgtgctgcctagtttgcctttcactggtaatatttcaacttagtctaatcatcattaccatttcccaaaggagagaactgcagaatcataaacagaaccattgccaaacaatgtacctcttttgcataggcaattcttctagaagctgggttaaaatgccatggagatgagaagcagcacttaggaattaattatgtttttcacatttagcaaatagaggttgtcatgatgtttaaacagtacaaaga

SEQ ID NO: 18843 - DNA, 601 bp, Human
cggtggctcatgcctgtaatcccagcaatttgggaggctgaggcaggcagatcacgaggtcagttgttcgagaccagcctgaccaacatggtgaaaccccatctctactaaaaataccaaaattagccagacatggtggcacgtgtcagtaatcccagctactcaggaggctgaggcagtagaatcacttgaacccgggatgtggaggttgcagtgagccgagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagccattgagattttggagttgttaccacagcataaccgagtccatcgtgacttcatcacgatataactcatgagtattgcttgaaaataaatacagaatcttttcaaggcaagatatttttacacaacttttagtgtaaattttgcggtttgggatcaaaaaagattatacagaatttatataataaataatctagaaaaatt

SEQ ID NO: 18844 - DNA, 601 bp, Human
gcatatcttactctggtgggaaatgtagtaaaacaaaaatattgagaacaatctttaaggcagcaccaagacaacgtttctgaaatagttccaatattattcatagtggcttgtataattatgtcctctctcttcatccatcatcttttctgtattttcaaggcataaaaataagagggaagagtcagctaaagcatttgacttagttgacaattctttgatagctcatgcatctctaaaatttagtactatattattgccaacattatgtatttaaatgaatgcagcttgatatcaagaraatgaccatactgaaggggaaaaaaaaataaactgcagccttcttcatgagtaacacttgaaactgttaaacacattaaaatcccatttaacaaatagcagaacctaatgaacattgggattgctcagtgagtactaatgtggaatattactgggaaagatgtttgagtgttgaagtttctcatagctcagaatggttacacagattaaggagaggaatgtctgttgttcaaaagacaaatgaaatttgtcagttcactgaaaatatttttgtttttgtatcttttttaaaactgtttct

SEQ ID NO: 18845 - DNA, 601 bp, Human
acatgaacatgtatggagatgatcatcctgcatatatagatggcaagataggtttctgttctcaaggagtagcccataagctcatgccaacataagtactggctttagtaactcttcaaaaccccgttgtgttaaggagacttatcaggcccagaaattctgtttctagatatatatccaaaagaactgaaaataggtattatgtgttcatgaatatgaatagcaatattatttatgatagctcgaaggtagaaacaatccaaatattcatcaactgatgaatgaataaacaaaatgtggyatgtacatgcagtgaacattagtcattaaaaggaatgaaatactgatacatgctgcaatgaagttatctagaataggtaacttcatagcaacaaaagcagattgttagtttacaggggttagaggaagaggggaaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccc

SEQ ID NO: 18846 - DNA, 601 bp, Human
aaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccccaaatgtcaaagttcctctctatgtacaacttgaaatgcttaattttatatgatgtgaatttcatctaaactaatgacaagaaaagtaaatgcctgtgacactgcatttttcattgacagggttcctcagtgargggggaaaaaagcatttaatgattttcaaatgacacatgtaacctaaacactataggacagtgatatttgcctaatctagaaccttctaccaggttgtccaagatgtgcccctagagaatatagcactcaattaatagtgttggatgagtttatttacaggtaaagataattgccttgtgtttagagggtgccatctggcactcagcagccaggatgattccatccaactgcctatatctggtgatttcagggttaatttccttttctgcttcctgatcatatatgagctcatacatatt

SEQ ID NO: 18847 - DNA, 601 bp, Human
atatgagctcatacatattcaaaagtactgtcaagtgtctaggattagcaaagtgggggtaaaagcaatgaaaattttagaaatctattgctgaaaagcttacaatttggataaagatcatcacttttgaagatatgtttacaccttgtaatgagccttttagctttgctctctggcttgattcccaaattcccagcattgattcccaaatctaacaagttatttggtaattgtgaatcactgatcaacaaaaatctaccatcactcctgagaaaggaactgaaaaatgcaggccatagcragaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgttttgtagtaatttttatttggtttcaacagtcaatgaaaataggttaataaaatgtctagtatttcataataacctactgtgtgttacatattatacc

SEQ ID NO: 18848 - DNA, 601 bp, Human
ccaaatctaacaagttatttggtaattgtgaatcactgatcaacaaaaatctaccatcactcctgagaaaggaactgaaaaatgcaggccatagcgagaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgtttygtagtaatttttatttggtttcaacagtcaatgaaaataggttaataaaatgtctagtatttcataataacctactgtgtgttacatattataccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaa
